United States Patent 7,892,730 (COMPOSITIONS AND METHODS FOR CANCER) - sequence listing, part 4

SEQ ID NO: 287 - DNA, 5494 bp, Homo sapiens
cagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccgtgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttatt

SEQ ID NO: 288 - protein, 895 aa, Homo sapiens
MRMSVGLSLLLPLWGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 289 - DNA, 210528 bp, Mus musculus
  misc_feature (1)...(210528): n = A,T,C or G
cacttgcttttcttcatcactatccttttgatttttaagccttatttcttaatgccgactctggtctcttgaaatcttagctattagcgttgatattgttggttcatgatccttctctgggacaaggaatgggaacatctagagcacgtacaatacaatctaataaagacgtattgttgtgggaaatattaaaagatgaacctaccaactctccgtggtactcgcttccgtgcttctgccgccccgccaactctctgcggctagtccccaaagcatctggctcccttgtcccgtgagccactagttccctctctgctaaaatctcctgtaacctgcagtcccacactccagtgaccaaatagatccaccatcctcgaagtttgataacacaatacctagtaatccggtaaaatcagactcttaatcttatagttaaccaattagatttatgtatcaataaagtcaaaatttacaagatgcctataagtaatttcagagccaactgataatgataaagctttaacccaatatttctaaccttatgaaattgtagctacttatgactgggaattgccacgcaggttcatgtctgtggccacggctcttcttccctactctgagatgttctgcctctctttgtctctgtctctctgactctctctctgcaactcttagctctgcctcccttttccttgtccaatcacaggcctctctgcactaatgtaattggacagggaaaagttctcctttcaaatcttttacatttacttatgggaagaaattgtttataaagcaaactgaatttattaggtggccataattttccccccagtagcttgattagaagcttgatgcttgcaattggccagaggtgagaactgtggtctcttaccctctttcttatcttgttcacaaagttcccacttagagccctaataatgtaatattgagggttcttggattatttttttcctatctcaaacaaagggcaaaagaaactgattgtattaaggtccctgtggcaaggtcacattatgtgcttcgggctgactgcaaatgtgttaacctacccaggctggnnnnnnnnnnnnnnnnnnnnccccccccccccccgagacaaggtttctctgtatagccctggctgtcctggaactcacttgtagaccagactggcctcgaactcagaaatccacctgcctctgcctcccgagtgctgggattaaaggcgtgcgccaccaagcccggcagctctgtatccttctactccctggaagtcgtaggcacacaccaccatacccactgttcatcatttacttgcactttttgaagaacttcatgtctcctgcagtagcaaagttatatagtggctcacaatgtaagactgtgacaggcctggcgcgtactatgtagatctggctggcctcaaactcagagagagccctttgcctccagagtgctgagttagaatttgccatttttcttggtggcactagctctacttacaggcctgtgaatgccagtggttctcaaccttcctaatgctgtgaccctttaatacagttcttcatgttagtgaccccaaccataaaatttttttcactgctacttcataactgtaattttgctactttaataagtggtaatataaatatttgtgttttctgattgccttaggcaacccttgtgaaagggttattggacccccaaaggggtcaaaggccacaagttgaaaatagctggtttatattgatttgttttttttttttttcaggattgttaaaatgttctgaatcatcaaagccctaaatgaatgttcttttttgtagaattattgacattgtaaggatagacttgaggatcaataatggaagaagtttctcttgtacttggcgatttttacataattgaaatctgcttctttcctgtctttggacttgaggaacccagacaatgacgaattcactgcaggtggtgaacactagttatgtagtggagactcaaaggatgtatcttttggttttccaagttttcttcagggaagaactgagaatgcccagacaagctttcccataggcccctgcaggtcccagcacattgcccagctgtagatcgccaacagtagattcttagatggttgttaggtggccggcagccctgacataggaatgaacggcagtggcctaatcaccatgctgcttttgtgacactctgggtcctagaccctatcttgagccttgtcaccctcctttccaggaggcaacagggagacactgggaggcaaagtacttctgcccagaatacctaataatggctgaagtcagtcagccctggggccaggcctgtctgtcatcaaagtttatgctcttcatgatcacacgttccgactgtgtttcttttgctgggtcagtcagatccttccattccctttatccatattgttcacccttctgagaaaaaaagactgctagtccatattgctcactgtgtgtgggtgtatcctgtagcattaccccccatcgttttgttttttaacaaagaaatccttccacattgagttttttcctgtgtgtagaggggaggtgggtacagtctctggaatgtaaatacaagtttggatttactattttaatttcttttttaaagccagcctttactttggggagagttttaggaagatgagctgcagagttgccattcggagggcagtggtgtctagttgtaatgacgtgcctttgatgaggaaggaaggaaggaaattcttacatgggtggaggaagtggagaaaagagaccaaagtgtcctgatggttcccgttggctgagaaagaagattgtgtctttggcatgctggttcttcattttctccttcctgtttctaagcagttccatggttgtaaagcattattgagtagccactgctttttatcctcattcaggtctacatgtcagggtttccacttgtcagggtttccacttgccttgtgtgcaaaggctgaaaggaacagatacatgtagaggcgatgcttcagatacgttgcctcaatcctcctaatactctctgcttacaaatcaggattgtgcatatttgagggtgtggcggtccaggcaaaaacagttgaaatgcttctgaggtttttaccctagttgcttccttttctagtgagctgggcaaatgttctcaaacaacttacaacacccatgaggcagcaatatgaatgaacaaaggcctagcatcttgtcagatcttgaaacttttaaacaatacattaaatgaacaatatacagagatgtaaaagttgcctgtttctggaaaatgcaagctctaggagacgtgtgctggctgaggatgtgactctctcccctcttctcctccatggaaaagcatgtttgaaaatcatttgaagtccatgtgcctgtgtgtttatgttttgtcttttctgatgtgtcgaaaacaagaatcccaaactgggatccttccaggctggagggcaacacaagctggcgacaagtgtcagaagacaggtaacatcggggactgaatgtgtcacatgccagggagcctgatgtcccctctaactagagcagatgccacttagagcctgtttctcattgccaggaagtagccctggtggggaagtgcctgtgacagattgtccagttttccagttttcatggaaatctggatttctacgtaacttagtaaaaaccttaacaccattgctacatgggtcaaactaacctgccttgttgtttggtttcctttaggttcatgggtcatcatttggaatgttctccattcttacctttgaaagtgttatgtcagctgggtgtagtggcacatgcctttagtcccagcactcgggaggcagaggcaggtgaatttctgagttcgaggccagcctggtctacagagtgagttccaggacagccaggactatacagagaaaatcgtgagcctcctcacgctagtattaatccccagcccaaacagctcagacatggaacgtcatcacatcagcttctaaaattgctccccaaggaagagggtgaaggtttctgggccaaacagaggtgaaggcatagagcccgtgtcattcccaggactcagtagctcatggcagaaaggaaggaatgagaggtgcgttattctattctcccagtggtggaactggaattctgattcatctgtgggttggctcacaagtctgtgccccttgaccacttatgcagatggtgtaaacaacataaaggtagcttccccagtccttgcccagtgtctgctctgaacatgcagctgtaggaggatttagtgctgcctacatgcttgttactgtcatctgcttagaggcagcacaagaggccttgtagcagaatgggcacttttgttgtctgtgtgctgtcctggggattggaccttgggcctgaccatgctagacacatgcagaaccactgagctagaatcccatgtttgttttcattagagacagagtctcattaagttgctctggctggccttgaactcactttgtagccttgactggtcttgaacctataagcctcctacatcctgaacagctgggataagtatgagtcaacctgtcctgttggcttagatcagtggttttcaacctgtgggtcgtgagccctttcacagaagtgtttttcaggtatcttgcatatcagatatttacattacaattcataacagtagcaaaattacagttatgaagtagcaacaaaaataattttatggttgggggtcatcacagcataaggaactgtattaaagggttgcacaactgggaagggtgagaaacactggcttgaggtatagcccttaccccaaggtctgatctcactagttcaggctggccttgttccccatcctgtggttgttccttcttccttccctcccacttccctcctgtctttgttttcctgtaagcagcatcttagagcatagctcctaaacaagaccacaccctccccacccggggaacagcctctgaacacccagcatgtgtctgacagcaatctagtttctgctacttgctttagagaagaggaggaggaggaagagaaggaaggggaggggtggggaggggagacagaggctgggtatgtatctacatggcttagttatctgataaaaaaacagatcaatggaaagtttcagagatttaactaaaaaaatccttcaagaaaaccccattgatgctaactggcacgcagcttctagcaagggtgggaaagcgtcaggaaagggccaagggcatcacggatctactcttgttttcttttactaatctgatgatccctaatactctggcctttttcaacaacagggtaaaaaggtgttaattttttattattatttttttaatttctttatactgtactaatggatatttcttactctcttgtcctctgttgcagtaggcaatatatatatgtattgcctatggctggtgctacatttgaattacagaatttggagtgggctctaaacaaactgggtgtatgggcaccagtaagaacattctgggttttgatgttaaatgtgatctatctggtggccatcagggacacaaccttcagtgtaaagccaagagattgttcttcttgactcttaattctttcatggtccttaattgttctaccttcaaatgtgttcttagaacaaatagttccaggccagtcccaacagccatgggtcttccataaggcagctgacttcagttgtgcttgaactgggaccaaaccgtgtaagtcctaactgtcccccagaggtagccggccaaaggtgggctttcccatgttaagctttgtggaatgagtagcacacagaaaaagtacttgtgtactcaattcaggtcactacatccagctggagtttgacatgctgcagttttttatcagaagcatttaatgcaaaggatctcccagggcccagcttcttgcctagccccaagtcccttccagcaggatttgcttatttggaagctccactctcacttttcctgatcttggcccttttcctgccctgtgatgtgcacagttcaactgtatctgtcacttccttgaagcagcgtttttttccccctgcttcatacgtgacagatccttcccacctctttgagtgtctgtcctgtgtggtggatccaggagagccagagtttcctgctaattccagggtttggttacagtggagttaaagtttgtgctgttattgctggaacaggcacatgtttgggcccaagagcattgtgttggaggagaggttcttgagcttggcccaatatctggtgtttcccaggctcgagtggtgcttttttttttttttttaattcccctaggccaggtctcttcagcctctcagagagctgttctttggcaggatctggggagagctggtctggagcacttgggagcaggtgtcccggccacttgtggcatttgagatcgagtatcagtgacttcactcaaagcatacacaagtgtaatcagaaacgctgggcctgtggattcctgtaactcaaaccccagtcactatgggactgattgcataggaaatgaccttaagaagaacacttatgtaagaggatttaatgtggtttttcatgtcataggattttagagaggttcctttctccctgtgtaatatggtcttcagtagaagcagtgagtggcctgttagcatggtatgctcagactgcttgccctgcatgcagggaatgcctttcccgtgggcatcagggtgcaggttcacacttgcatttggccagagaatgatggatctgaatgcaacgatgcctaggaactgaccatgcagtatctcaccagctgttagtacatgttctacatgtcaagtgtagaacagaaagccaccatctggtgagtacctcttagtttctgctctgaccttatcaaggcatgaggccagtgccagggatgagcaatcaaagctgtcatggactttggagctaagatttttgcattctaggagggccatagtggtaagaaaccatcaattgcaactgcggctgcaccttcaccaatggccttccatggcctcttacagtgctgagcctcagctgctctgcgtgaccccttcatgccttcaaaaccagtaccacctgggtgacccttacacattaccaagtcccgctgcagcaggagtacaaccttggctatctctggaacacagcctctttgtgctttcagaaaacacttcccagaagatgtcacctcaacgatgctggtctattcttaatcagtgctaatttcttagctccagctaaccagcatcaatttgatgggcacttgccactggtaatattctttcattaatgtctgacattaacacttggcagttttgttagaattatcaaaacaaaacaaaacaaacaaacaaacaaaaccaaaataaaaaaaaaaacaaaacccaacaatgcccatgtacatatgtgtgcatgtttaatgcctatgtgcacatgtgtacatgtttaatgcctatgtacacgtgtgtgcatgtttgagactgagcatgtgtgtgcagcagattgatggcttggagtgaaaattttctccgagaaccccgggcgtgttgagttgtttataactgccttgtttcctttttcctatgttgataaaacttcctttcctgtgtttgagcagaaggtgtcaaatgtttcctgctgtttatataattgaactgaagttcctaataattttatataagagagagtggattttgtcttttcaaacttataacaggacataaattgtattttttttaattttgcattttttcgcaccacatgcccagcaaacacccaggtccactctgtggacatttgcctggaactcactgtgtcagactcctaagttctgtctgtaggagtacttcctgtgctcggtgaactgcctcacgtgactgttgctgggaaaccctactcgactgttgataggcagtgagaataggttagcgatgcatgaagatctctgggcagcatttaagaaggtgttgacttctttttaaagctcaatttctctgccacaaaaaaatggtttaactctagcacatctctggtgggttccttggttcaaagattaggttcacatcgctaaagctgatactgcccactcccttcttatcccgtaagcgtcctgtctgttgcctgggactaccttagccatctctgggagcacatggaagatgatggatagggaaggcagcttccctggatggagctgggctggtggtttaattgttggtgatttgagtactaacactgcttataaaaacaagtaagttgaactaaaggattatccctagtaaaaccacattttatgggtcttctttgactaacccttaaacagtgttagcaccaggtctttgatgtggagtgggtaccctaaggcatatttatgttttccttagctttgtggtctctttcttccagatgtggtcagaatggatctctgggggggtagtcttgaatgacttccagaccagtgagatgcagtgttaggtctgaggcctttgaaatccacaccactgacaccaaacagaacccagctcctctttaaccaggaaaagatgtcaggtgtcattctgcatcaatgcgtgacttattccaagctgtttacctctggggtattggaggcatgactttaagcagccaggggtagcttgatcacctttcatgatggagtcagataccatagataggggtggatgtttatgtggtgcctctaagtataatatccctaaaattcaaaacctgcttaaaaaaaatcaagtaatgagagtcaaccgaatattaatacataattaattgccagccatactctgaaatcctagcatcctgaagcattgaggcaggaaagtgttttgcttccagctgggacctagagctacatcactgggatgctgtgtgatagcttaacctctctgtgtctctgttcggtccttcacttttaaggtgagaggaagtgtccagggtacctgttagggtgactgtgtgagaaatagagattgaaactgcatctgatgcttgctgtttatatcagttgctgatggaaccatagggccagagaaatgtcccttctctttctgttttgaacgatttctactgacctcttgtcaagaccccacgcttgggaagcaatgctcctggagtagctttgggagttggagatagaagatcaagcctcagggaaggtagcctcagagcctgcctgatagaaaagattgggttccttaagctcccgtgaattcacttcctgctccacactggaaagggtgcttcgtcgtgctgtttgctgttgctttgctcttttggaattcgtgttcttttgctagttcagatttctagatcagagtccagtttctacaacaaatgtgcacagttttatgtatagcttcaaataaagcatattttctccttcggaacattttactaaaattttttgtaatcgtggtattcttttttgccacagtaaaaaggccgttccccttgccccccccccccatgtagacaatcaccatcacttaaaaattaagagtagtaggtcattgttcttgctttcgagtaacaaccgttcatttaaaattaaaaagaaaatgttgaaaaattatttgtctacacttgcaaatgacaactattgatgcttctttattctgtgatttaaatcagatctaacgaaaggtcagctctgccttcttgagagtcatcattcatcggctctttcatgcttcttcttgcagatgttaaagcatttttaataattaacttcaaacccattggcaaagaacagtaccctcgagtgaatattcaactggaaaatgcctctcaattgtacccagtagtgtttgaactgtgtttgtatttgaacgctcgagcaaagtcaacagccctgcaaggcatattacttcgctttttaatattaactttgcttagatttgacgcccaccgagcaggaggtgggacggcagaacacacttagagcacagtcgccactggaagactgggtacactggggacactggggacacgtgtcttcatgcttttgtctcagttctcagatgcattgactctcaccccagaatacaagcgttccccgtggttgatttgaacatgatgctggtgggtcccgtgttgattgctgagcaaacaggaaggtaaatcctcaattctgtatttccttacttttttctctttcaatattctcaaaacctttaagtttctttgggaatttctggaaggaattactgaatagaaaaacaccatttgggcttcatttcaggtgaacttcacaactgtgactatgtctatgtgttcctttgtggtctctctgatcacacctgtgaaggctgtatcctgggccctgcattcctgaggacacgtgactgtcttacctggaatacacatcccctggcctgttggtcccctcttttttcctgtctggaatgagactttgctgactgctttaatgaagtacagctcttaagcctgctgtccccttcctgcttcctccctggcacaggcctaatgcctgactaacaccactgtggggtgcttctgtgctgtgtgcctgtgcgctgctttgttttctgtcctggagctgtgcctgttacctagtagaaactctggaaatactttggctgaatgaatccagtgaatgagtaagtgaaacttgctcagggagtttggtatgtgggagagggtgattctggtgactgtgaaatcattaggaggccattgtcaccggcccctgggatttaatgaaaacccacaccaagagcttggagaatcaaggtcactgtgctaatgtctggcagtgaaggagagagcaaaagggaacgatctggaacaatctagcttggcaataagagatattcgttcgctgcaactaagttaaggaattgtgggaaacgcttcagcgttttagaaagcaagttgtgtgtattaataggaaaagaaatcaatttatttctgaatgtgtgttggtctgcaggatgttttttcagaggctctagcctccctcccccactaaattgctgattttactttgaggtcaaatttcctaaagtgttttaaaagctagccaggaaggcaggctttggcctctagggaatgtatatctttagatggcgacatttttctgtatctgggaatcaaattgggattactgaagatctgaatacttaattagctttttaggatcttcagtcactaacagaattagtgatttaaatatgaaattcattgttcttccacttgtcaaatgcttctcgcatacagaaggataggcttggagcagaggccatgactgcatcctgtgctcttcccgcgctcaccggaccccctggaggacccggcagtggcatcttcaagttggatagtaagcatcttgtttgtgagccaggctctgttgcctttcttttaagatcttgaacctggggagatggtgtaccgcattagactctgagctttaggagtaggtagaccatgactcactcactgaattttaagttagtaacttgggtgattctcagcaaatatctagaggcattgcaattaaaaactcaagagttgatgtctgtgaggttcctgctgatttgagctctttccttgccttggaagcattgacttttgtcctgttgcttcttatctgatatatggaaggctggggattctaggaaggaaagatgttggtggtatgtcctttgcggctccatgttgtaagattgttttgtttttctatttagctagagatatccaagactgttatctgcattaacattctgtgctctaactacatttagtgagaagaagatgtgaacatactgacgtggatgggtctctcggtctctgtctctgtgtgtgtgtgtgtgtgtgtgtgtgtgtgtgtgtgcgcagctctttggctttgcatcttgccagctacagggtgggtgcctccatagcatttggatatgtaacctatacttcaatcataacaataaagagattcttagcaaccattaccactaaggttttcattagcttgggcttctttttctgaactgtgagtctattaggattttggtgtgtctcaccatggtctctatagaccagaaaagcctattatgtgtatttgctgatgctgggttatttgaatctccatctatttgtccctggcaagggaatgttattactgctctggtttttgtttcttaaatgtagctagcatcaaggcttatttgttttctttatcagaacctttaattgggtttatttctgctggtagctggtattggtgcctaaggcaatatagctggggactagtgtctctctgtctgcctgcctgcctgtctgtctgttacttttgtaggcactcaattcatactaggcaaacacttgctcagtcagtcattgagttacatctccagccttgtgttgttgttaagtcagttttcctgtggagtacaggcttgtgttaaattctttattctccaccttctatctctcaaatcctggcattaccagcaggagctaccacaccctgcaaaaagttcctccggaaggaatcaagtctgatgtctgtccagatgtatggtcataaggtgagctgatgtttgccctaaggtgtgatgcagtctaccttctgaatcatcagtgtaagctgtgatatcagatgtggcagcaggtggcgcttgggggtggtgacaactggtgactgttgttgcaactggcctcactgtgcgcctgcttcactgagctttagagaatggtttgctttcgctgctgtgagcacagctgacaggtaataaatacaagggcttccaggtggagcttcagtagctcacagttagatggaattcagtggtggtttgctttcgtctgtccagatgaccacgaatacaggagacctgctacaagaacaggaaatgtaagccttgtagtgagtcccgtgaaggtaacacagcagcgagctcatgccttagacccattaactctcatcattgatccagacatcaaaagcaatgatccaggggcataacgtggagcttctccatctgcctttctctgttgaggtcatttcagtgtccagcaagctaaatatttgtagtttgtgaaacggaagatcaaagaggcatagcttgaggtgaaagtagctccagctccccgagtaggagtgatcatcaaataattatttccatgtgttgaattttcactcgttggctactgattcatttcaaatacatgggaggaactctatctccatgtttaattaatagagcaagtatgtaaacatcactaaacttggttctgtcttccagataagattcctgagtcatacaaaggacaaatagcttgaccaaggccgtgtggttaaccagtcaatgacttaagtcttgctggctcagtccagttccaggacatttcgtcatcagttagaatactcttttaagtggattgtgaaacctcagcaagcaaggttaatgggggctttattgaggacaagggtaattgggcttcattgaagaatacttaatgagggcttctgtgcgttccagctgtgtgtgttttactttctgtcaaatgcttctagtatgtggctagcacagctcgactgagtgtggccattgctgacttgcaggccattagattttacaagctgtgaaacacaaggggccttgaataggagaagctattcaacatttgctcccggtggcagttgttaaagagttgagttaggactccaaacacaacatggaaatcagtattgataccaagtgtaagtcatctggctatgtggaggctgcaacaaattatcatgaactcagcagcttaagcatcacgagtttgctttttgacagttctgagggcctgaagtctatctagtactggctttaatggtctgaagtgaaggtgtgggtagggctgcccctccctctctgcagggtctaggagaatctgctcttttctcttgcagcttgtggtggctccagaattccttttcttgggctgatttatttgtctctgggagatcagttgcctttctccccaacaccccttgtatttggtatcaggctggttcctacatgttgaggacacttttgactgtatattgggacaaaccaggcctctccaatgcaatatctttagcctaattgcatttgtaaaagcccctttccccaaccccttgctgccctccctttttactttgtaaagaaacatgcataggttttagggattatgatgtaaattccattcaataggccattgataggcctggcacatgatgacagaattaagacctttcatctgtcctgtacaagtatgcacctaatttcaaaaacaatattgctaactgcttttacagttcagagggtaaaatgtgtaaatattccatggccaaacaaatctgaggactattgggtaggatgtctatctttgaggacattcacagtgcagtgaattcctgctataaagaaagtcgcttaactttgttgagtccaaaattccttggacttggattacagagtacttcttttggaagggcatacctgttcatagttggtagagtgcctgagaatggaaggaagctctgatcaaatttttattcccattagtatttctaaagcatgaagtatatgttaaccaattatgtgttgttttatgacttaaaaaccaatgcaaatatgtagagttaaatgaccatccacccaaccatccatccatccatccgtccatccatcctttagttattaatatagtcttacttggtagcttaaactgtcctggaacttattctcaaattggtctcaaacaattggccacctccaggccttagcctcctgaattcgagaagtatagattgtgaagtctgcatcttgcaataagtgagttttggtgttgtgcttgaggagttttaggggttaaaagctatgagttatgaagtgggtggagttgttctgacatggaatggtctagaggactctcatagagaaagatagggtgggggtaggatgcttgcagagctcctagtatctgccatcttgacatccacataagaagtttgctaactcttctctaagtgataggagctgttaaaggcagcttgaatattagggagggaaagagttttggacataaaactactgcgtacacctttaatcccagcacttgggcgtcagaagcagatggatttctgagttcgaggctagcctggtctacagagtgagttccaggacagccagggctacacagagaaaccctgtctcgaaaaaccaccatcaacaacaaaaaaaaccaaacaaaataataaacaaaacaacaaacaaaaaacaaacaaaataataataataatttaaaaagtaacaactgcagttggaggatggggtgagactggatggtagcgtcagacagttttaacataagctttacctttctaatgatagtactgtatgtcaaccacaactaatattgagaaatgattaatttgaatcattttattcagcattcctgctttttatataacactctctctctgcatgctaacatccagcatgccactgtaatatccaaaatgaattcaagaccacccagtaccttcccccttagaaaaggactttccaaactgcactagcaggccaagtgcagagccagataaggaagctggttgactaaataaatgtaaaaacatagttttagtggtcaaaatgactaagcttccaactgccaaaataatattagctgttctcagagaaatagccataacaagatagcagctcccagagaaatcccctaccccgccccacactaaattctgaggaagactgcagacagccctgaccttgctagaattctctgtgatgttaatagctaaaagttgaccaaattataataacccaccatggtggcaagcaaagtgagtcactaggccaaagggttacttagtcactatacaaaccaaccaatgcctgaaagggttacttgctacactaatgaaaaccctgttgctcaaatctgtcccttacaaaggtataaaaagtgtgttctttctttgttctgggtctctcctctggcctgcttgctgagaggggagtccccaacatgttggatcaataaaaatcctcatgcgttttgcagcgatggcagtctctgtggtctttgtgagtaaggttcttttgacaaactccaacaccacatcctatccagaggcttctagattgtatttctcctttttctttttggtgatggccttggcagtgttgaggagtactggtcagatgtgtttatactgacctacaattaggattggcctcagaattttctgattagattgttttttgcaggatcagggaaatgagatattcttctcattatactttttgtttgtttgtttttgtttttcaaggtcaggtttctctgtgtagccctggctgtccttgaactttctctgtccaccaggctggccttaaaggctcattgtactttttcaggtggagaaagcaccgtggtttcttttctctctgctggtgtgacctgggttacctcagaaggctaagacagtgacggcaagcttctttgctgtcacgtagcccacacaggaggaattgtgctcagatgaaatatctaccagtgggcatgtctgtgcagaactttttagactattaagttaaggtagcatgatccaccctatatgtgagaggcatcattccatgagattggggcccaggctgaatagaaaggaggaaggagccaggtagtgagggcacaccttttaatcctagcattctggaggcaaaggcaagctgagctctgagtttgaggccagcctggtctagagagtgaataccaggatagccagggctacacagagaaatggtgcctcaaaaagaacaaaaaaggaggaaggaagagatgagaagctgtagaggcagtgtgtgcacctcatgcccctgctttggggctttggggctctccccgccatgatgggccgtgtctggaaatgagccaagacatactctcccttacagtgctgtttgcagggagttgtgtcacagcaaacatgagcaattcatacatgttgtatcgaaaaattaacattcttaatgaaatttctttatagaaaaagagatactgtctctagttggcagcctcatagcaaattttattagctgtactggaatttatttattcttagctggggagagacttgcaactggttatggagtgaagagttcttttcccttcctaggttccccttaatttttctgttttggtgtgcgtgtgtgtgtgtgtgtgtgtgtgtgtgtgtgtgtgtgtgtatttaggcattgttttagttagcgtgaacagacaccatgaccaagacaactcttataaagacaacatttctttgtggctggcttacatgttcaaaggttcagtccattatcaccaagatgggaacatggcagtgtccaggcaggcatggtacaggaggagttgagagttttccatcttcatgtgaaggcagctagcagaatactggctgccaggcagttaggatgagggtcttaaagctcacacccactgtgatgcaactactccaacaactccaacagggccacaccttctgatctttctccccagcctttttcctgcttctgttgtagatatggtagaggtttggctggagggcagcttagggtaggaatagcagtaagggataaggttggggtcccacagtgctgaccttcagcaccagaccaatacattttgagtgtttggcttatttatgcaggaatgaccaacactgattgcttttacagctcacatagaagaattagagtccacagttgcttccaggctgaatgtagaaacagtgcagtgctcagaggaccgacggaagagaaaagacagaagaggcctttatgtgccctggacttgtgcatagattagattctttcccaggaccaagagaggaactagtaactaagccattggtttgctaataatctgaacaaaaaagtagaaagtcacataagccaaataaatggagtctaaatttttcatgtcactgttttatttatttttgtttgtctatttatttgtgtcatgtcacggtgcctgtggcagtcggaagatgacttgtgggcgtcggctctctcctacatgtacagttaggaatgaccttgaactccccatagacctacttaccaagccttctgaatcgaattacattttaatagttgccttctgttaagttcaaaattacctttgttgttgatctttttaaagtcgtccgtatttttttagtgtctaacaagtgtggtacctcagaggtccagagaacagaaggggatgatcactgagccctggctgtgtagtgagcaagcacatgatcgcctctttctcattggctgctggcatttgtatttcacaggtctttgatgtgtaactgaggatatgtgttagtgagctttcagctatctgtaaaactgcaagcatagatgctgtgctgctctgccccaaacattattctttgccccaaacattattcctttattactagaacaagtaattgggccaagccattgattctggtgtaggttgtcctctgactatgggagttctgccagtctcaggtgctgtgcctcctgcacttgggcccacagagatagaacagctttcctgtgtcatattctatagcagctctctcctagtgaggaagaattcgtttagtccagtgatgtggccgtgtttgtgtgctagccaaactctggcgaccaagaatatctactgggctcgtttctgaagagctgtgctcatttggaatataaacctttcatttacttgagagaaagtccaaataatcttgtaatgggtaaaatgagggtaaagtcacctgctttgtgaagttcagagtgaacatagggttggaagagcagtgccctgtattctgagcaggaacgactcttgttacgtttgcttttccaactcccatctctgtgggtttatgacagaagctgtgtgccttgttatgttgctgtgggtgcagtttattcagcaggaaaagctttaggaacagaagaacacacagagaaggcatctgggctcctcccatgtggcctccacagccaggactacagccctggggactggctggcacctctttttgattctcctgcctgtggaagtctgacaggagaagacattagtaaagtttttgtaggaggtcactcgcctgtgatctggtaactttgggactctaatgaataccattttgaatgtgccagggcataggcaccatgccagtccctgtgatattataaagccctccttggtgctgaagggcagtgccatctccatatgtgtgccagtgatgtagctgccttaccatcttcaactctgtctgccaaaaacaagcgtgatttttatattcagattttgggtcccactactttgctaaaagcgtgtaccattggtctttagttttttcaaaataggattgtggcatatctcaagggggagatttgacttctttcccacttctttctccccatctccttgatcagtccatgatatgcaagactagatctttctaggacacagaaaaagcttcctatttattttgcttcttgacgctgtgcctgcgcctctagcacagaatcttgggtcctaagccaggaaaacctagtggcgctcaagagcagaacctctcccgagaagaaggggctgccaggagctcatggcttgtttctaggagattgaatattacctggagagaaaaccctggtgactgtgcctgtcatttgagtctaatcctacttctgatggctctgtccctggctctcttatttgaattggattcaagtgacttcctcttcttgaatgtctcctagagcaggttgctcatccaaggttcagcatctttattttcaaggcttttttccttatcctccatattgccttcaagtgtggcaacttggagcagacgcctgtgaactttagtataacttctctaaggccagacaccacagttagccgagtaaggcatttgctgtgcacatcgtcaggggacctgtttgcagtggttcaaggtcagtgtagatcctgagctctggatatcttcccttaggatttaaaggtacagcaaatattgtcttcaacaagtgacggcatgatatgcatgcatcatattttatcaggcaagtcactgtgatattcttgaaaatatagttttcagtagctaggtgtggtgagcatgcctataatcctataatcccactacaggatggcaggatggtcccagatgtgagatcttctggagctagaccctgtctcaaaacaacaacaacaacaaacaacacaaacaagtaccaaacaacaccactccctccaaaaagacccctcccaaaatgtctatagtgggagttttactgtttgctgatttatattgctatgagattaaaaataaagttggaaaaagtactgacatttagaaaatgagaaatttccatggtatctgttgaattctgttgatctcttgtgcgtagcatcactagtataaaatttgactaaaagaaaataaagaccttgtattttcatctttttctgtgattgaaacatgatttttttcaattcagttctttcctaaatcctgcgttctcggtttgttcactttcccccatatgtcctagctcttccgtgagagccaccccttccttgcttggctctcatcccctcatctcctttaccctctcttgaagcaagtccttagtgattcttcctcctcagagcatcttacactaaccagttcctgttaaacctgccactcccaggtcttgctgcctggtggcaccagtcagatttccctatcccacaacctcaaccgaaacaaacctccttcagtacataacttcccaatatgtttggagtggaaacttaagagtcctttggaaagttagttgtgttgaatggtgttttgctggggcaaacacgtgaaggagtgttttcccaaagtggacacaggtgaaaggtaaggtagactggtgagggaacatttctctgaggtagatgcagataaagaatgttctgctagagcaagcacatgaaaggacacatgatgaaggattctttgctaaagacacacatgtattggtctgccttacgtgcatggttgcgcttcatttgctgggactccatagagagaaacttgccagagaacttctggtggtgtgcctcagattcttgctgctttcacggactttggctgattggcagagggatgtcagttgagagagatacatgtgctgaggcaagacccatagagaacatgtgatgtttagagggctctaaactggactcgacaaatagtgatggagacagagcttggcttgcttatagagctagctgtgcaatgcttgtgggactccagtcttctctgatcttcaattccctgagagaggcacagtcgagaacttctcctggtgtccctttgggtccctcctgctgactccagccaggctgaggcctggctatctctgctaggtacttccaccactgctgattcttgtttgctggcccaattctactgagctggactgctagtgtatttgtgaagttttgcgagtgggttgacctgctgctgttgtttcctgtgaactgaactgttgatttcctgacaatgcagatgggatttgttccaaagaacctttctaaacaggtccacttccctgtatcctttcttttccactacccctggtgggtggtgggctagaagggaggttaaactgtttaagaatcattattaaaaatagaggttgaaaaattaaagttacacatgttaggtgaaataatagtttcctagcctcaaaatctcatgtaatttgttggttacccacacatgccatggtcctcctctgttcccctttccatcgcttagattcagctatggtgactcgattccagttccgttggaataacctccacacttcccctttcctgtctctatttgcttagaaatagttgttcttcagtttctccattacatgtcatgtctaaggtcttaggtcagaaaccaccctagtattgcctctcactcagcctctggtggcctgctctgttggtgtagagaatagaatctctggcatgaagtagttcttgagtgaagaatggaaagcaatgatatttatgaatattttaagtgctgcttaaaaactctgaggaaaggactatccattgtgtgtggccaaaatgccatggctaatataccacactgccttcctgagctttcttagagttgttctcgcaaaggtatttctggcccactggattatctaaataggcgtgtggtatggaatatacctactctttctgtttttagcagatgaaggcacagcattccttcatctggatgtttaggaatttaggctcttatactactttttacctttttctttaatatttattttcttattcttagttctgcatgtgcatgtgtctttgtgcatgagagtgagttccggttctcacagaggccagaagagggcgtcacatccccctgacctggagatgaaactgatgacaagtcacccaacctgggtgttgggaactgaaactgggtcctctgaagagcagaaagcactcgtaaccacctagatattttcaactcccccccccgccccccgtattgatttatatcaacttcttattctctggattttatgccaggtcataaaggtcagataacttaacataagataaagatgacatgtattcatgaggataaagaaatacaggggaaaaagtaaaaccctaatatagggttgtatgattacattcaacatgccttgacatgagtacatgtctcatcagcctaaagtgtaaaatttaaacataacactaaaagttttaataaatactttatatttgagcatacagcaggggctctagttttctttcagtgtttatctaatttttaaatcaacttaaaaaaagatttagtgtatgtgtgtgtgtgtgtgttgggaccacatgtgtatgtgtaccatatacacacaggaatctgcagggaccccaggaagtggagttctaggcagttgctgggcgctttttcggtgtcttctgcagaagcaacaagtgctcttaatctgtgagccatttctccagccccaggttttttttttttttactttactgtttttatattaaattaatttttaagatgatttttgtggtttcccattgaattaattttgccagggaggttgtcttttttattttttttttatttttatttttttaaaaaagcctaacatatacattgtcccattttatttatttatttatttttagatttatttattacatgtaagtacactgtagctgtcttcagaaacaccagaagagggcgtcagatctcgttacagatggttgtgagccaccatgtggttgctgggatttgaactctggacctttggaagaacagtcgggtgctcttacccactgagccatctcaccagcccccttatttttttatcaacttgaaagaagctagagtcctcttgaaaatagggaaccttaattgaggaatcgcctctctcatattggcctttggggatgtccgtagggcatttccccaattaatgattgatgtggaagggccttgcccacactgagtagtgccagcttctggaccagctgtcctgagttgcataagaatgtaatctgagcaagctactgggagcaagccagtgagcagcgttcttcccaggagtcagttcttgtctctaggttcctgccttggctttaacttaatggactacaacctagtcctacaaaaatctaggatatgtaagccaaataatccctttcttcctcagaatgcttttggtcatggagttttattacagcaatagaaatcctaactgagacacgagtccatctcaaagtgataaaatataagttgttaagaagacattgccagcttttaacttagttgcatgtcattctatacagacaccaatcactggtgttagaaacgtggcagaagttcaattgcagatttcctactattgtaaataattattaaaaatcccagcagtgtgggctatatacccacccttaaccatttatgttcctggatgaaagcacacacacagcctttatatttttaaataagccttaggcagcacaatagctgggcaactgtctgcccaccatgttgttagaatctacctttccatcgataactcccagccatcactcattatttctatgttccatctgggctgctcttagctccaattggcaagcacacaggatcacattttttttactcctaccccttggcagccctctctctctctctccctccccttctctccccctccctctctccttctctcctggtcattcttcttctatgggcaactttttctttctctcttctgttgtttctcctctgacccaagcccttggaaactcaactctacttatctctcttctgccaagctattggctgcaggcatctttattgaccaatcagaattaacttggtagcagggtcccaggagctatgtacaaactccaggttttgggggccgcacttagcattacaatagacagttaaagacaaaaaacctcaacacccacctctactgcttactgagtcacactttctgagccccagaaatttgcctttttctttagcactttgcattttaaataagctgcagaagctagcgcaccagggccctgtatgcagtgaatcattgctgttttgaacagggtctatttgaggaggctcacaggtcttttactctcacccatacgtaaagttgtcatctgaagactgcctgtcaggaaaaagtgccagtattgactttgtaaaccttgaatactgctagtgtcctttccaaaccaaatacagatgatcaacaaggaaacctttcctcagacggttgagtccactggccttcagaacagtagccctctgagaactgactcaggtagaaaggaagtgagaatctgatctcttctctccagctgagtggaattctctggaaagtcctagaaatagggttgggtggatcccttttgccttccccaggggcatttatagctttccctagctgcccagggcacaagggagtggacttaatttaaacaggacgggaccagttatagcgttcttgggattcctggtgacacaggtaagtctccattgagttctaggccatcctggtctagatcatactgtgtcaagccaactagaactatatagtgagatgctgtctctatagtaacaaaaaagaagcaatcccaacactagcattttgtgtgtgtgagtccaggtttggtgttatgagctcatgagatcacctcagagaaggtgggaaagtcaaggtgtggagaaaccgtttcacaacaggtttggtctgggactggactctgaagaaacttacagggtttatcttccatccatggtagagctcactctgctgctgctgctgctgctgctgctgctgctgcttcttcttcttcttcttcttcttcttcttcttcttcttcttcttcttcttcttcttcttcttcttcttcttcttcttccttcttcttcttcttcttcttcttcttcttcttcttcttcttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttcttcttcttcttcttcttctttttggtttttcgagacagggtttctctgtgtagccctggctgtcctggaactcactttgtagaccaggctggccttgaactcagaaatccgcctgcctctgcctcccgagtgctgggattaaaccaccatgcccggcttcttcttcttcttcttcctcttcctcttcctcttcctcttcctcttctttctttctctttctttctttctttctttctttctttctttctttctttctttctttcttttttagtttttcaagacaggatttctctgtgtagccctggctgtcctggaactcactctgtagaccaggctggcctcgaactcagaaatccgcctgcctctgtggtacccaccttataatgcatgcctggatggacactgttcttggcacatccttggtacgtcacattaggaacagagtctaaatgggataggctgccattcctacctcgagtgtctggacatttgtagtggtcagcatgctcacagagtatatattatcagtgtagaatggtgtatgttcctcagtctctgagagagccctgaccaatgaatggttcctcatcccaaatcttggctttgtctgtgtctagtccaatgcttcatcatagcatgtactgaaaaagttgctcattggatacaggcagtgtgggcttaattatgctcaggaagggttagggttagggttaggattagggttagggttagggttagggttaggggtggtgtcatccattttgggttctctattagacttaaacttcctggtgttgaaatgtgggcaagagttctgacccagagaatcatcctgagctgtttcagtcccgcttaaaaaacacttttataaaaactgtagcctattcttacattgacatgccaattctataaaaataaacaggctgtgtgctaagtagattaggtcttagcatcacaaaaggagatagggacctgagaatcacagagatgtgtcctcaatacaaccccaagtcattaccttagcaagtgggagagtttggaaacggaaacagcttcttaactctgaagcttggctttcagagaaaaggtcatttgcccatcatcagaaagctatagaaagggtttgatctgaaaattaactaaggcaagcagaggatcccgggacactgggtgactaatactagtcattccgttacaaatgtgaattgaaatacagtcccagaagaatgtgttttgggcatgatactgcatggcctgtaatgccagcacttggggaggcagagacaggaggactggggctcaggctcattcttgtctacatagcaaacaggcttgcctgggttccatgagatcctgcctcaaacaacaaccacaacacaatggacaagatgtcatgctatgtcaaagaatagagttgctacactaagcaatatagcttgttaactagagatgaccaactgcttaacagatttcaagaatttggaaaccaactacaaatttagctctcagtaaaagcatcaggatgacttggaaaattcagccaaagttggttgagcaaaatgtaagtgctgaaagactcagaaagttttttgtttgtttgtttttgttttttttttctttcccctaaaaggcctcttgtgtccaaatgagaaacaatttgtggatcctttgtctccagtgagcctatttctaagggttatttctatggaaaggattagctctgaagatgaacagtgaacatgggatgtgacccagacagcttctagtatatgctccaatttgtttatataatagactgttgtatatttgtgtcaacgatgctgaacaagcatggcacaaaatgtttgataaacagacttcaatgagcatatgagaacattgcagtcaagtagtgatggggacacggggcttaaagacatctgtcatagtactcactggattatcttcagtggagttccatgttggggtttcccttcttggtctttattaattatagagctatccatgagcatactttctgttattaaagcagtttgaaatagtaagcaaaactatattcaaatgtatgggtaacttggcaacttttcccccaaaagaatgtgatgagtctagtccttttaattcaaaataatgaaatagccagtcatcttaagtccaaacattagtggttccagagagctatttgcccctcccatcccagtctgaacagaggaaatgagtgagtgattaggaatgagtaagagccggaggacttgggccagctcatctgtggaaaggaagaaggaatattaatatagtccaagacagtgtagaaaccacaccaacacagcagcattaagtgtttgcccaggaaatttgagactgagaggcctttcgtccacttgtgggtgtgttgccggaacacccagtatgcttaggcttgcctaactaccttatcctagaagaggtggattcaggcgtgagaaacagcttttctagtctaagagctgattcatgaagccgtaacgctggcttagtgaattgtttcattaattgtcttttgagccaggggctgctagtgaatacctttattcctagcacttgagagacagaggcaaaggcagggcaatgtctgtaagttgaaggcctggctggtctacatagtgagttgagagaagtgggggcagagtggggagagggaaagagggagagagactgattttgaatttatgctttctacaagtctgcctctcacctgtaagtctagggtcatctgtttatagaatgattctagctggacttctgtgagtgcggcatcctggaaagtacaagagtttctgaacccatgtaaggctcgctccctatctcagaatatactgtgatgtgggtggggctatgcataataatgacggctgtctgtctaatatgtcatcagcaacttgtcatgctaagatggactaggattctgtttttgtttctaaagtctcagataatcaagtcagcaagaaacataagaatgttagggacttagcctcctagttttccaagtgaatatgtatccctgtctaaagatttcctccttctaaagttttattaataaaacaatgagtgtacaggatttccagcccacttcctcttagaaagaacagggcggggcagcctgtatcccagctgggacaggaagggcccctgctcccacgtctggccttggctctctgcccttacaagctggagggagggcttctgggcgagcagatgtagcctcaagtcagtatggttctttgcctactctttggactgggccgacgggccagggagagacacgggtttagtctgggagttgacacctgtaggttcacctctctttggctgctgtgattttgttggggctgtgacataaaaatgactctttaaagtctggaggtataactctgaaataagactgactatcttagattccatttttgaatcacaagctcggagatcagataactataaagatgttgaaagcagatattttcaacagggagcggggaagatattgttccctagggaagagcacaccaattggttatccaataccaaatcgtcaatcctgaaaacatacaaacaagtaacattgtacagactgagcaggctgtacttgtatatctaggaatatatgtttatatacatatatgtatataataatagttaaaggaaaaagaggctatgaatttgaatgcaaggaggaggggcatatgggggtattggacagaggcagggaggggagaaatgaaataattttccaaataaaagaaggaattaaaacaaattgtttgggcttttgattgggaatggactagaaccaatgaaacaacaaaactccttgtaatgcaagaaggatgatctatgtggccggtgtttagcaactgtgaaaaattcatttaatgtgtgatgttgggatgggtgaagacaaagcatcctttgttgacattggtgatagcattggtgatgcagctcaagcaaagctgggctctgagctgtaggcttgcccatcccgagctcactgtgaaactgcaggctcttcctgtgctgcaggctcttcttcatgtcccaaagctcagttaagtccccagtgacctgatatgtaaggcgactgagtacaggcttttagctagggctgagaaggaagctgtgttgagttcagcaggaacaaggaaatcgcccccccccccctttatctgatgagacccatcacatggaaggacttaaaagaaagcaacagcagctagatagtgatgttgcttagctcatagaatccttgcttggcatggatgtgaccctgggttagatcctcagcagcccatgaaaccaagtgtgggcatgagtgccttcctgtcagcaactgggacgaggaggctggaggatgagaagttgaagtaaggatggggccagctttgtgatacaagagatcattcatcaaaaccagacaaacaactaagaagataaaatgttctaaccacccttaccccatgatcccagtagaacaaggccgaacacaccacttagaaggtaatccaaaacaaggtattaagagctgttacagtaaggtttatgtaatagatgaaatgtgagcaacatcctttctggtttctgactgatggcaattcttagattatagactctcattttattgccaggctgaacctttgaaacgaaaatttgtctaacaggttccttctgcagatgtgggaatcgaggtcccttgggagggtgacagacctttgcactgacacatcactatccacagagcccaggcttctagatggtttaagcctctgtacaaagcttgagagaccagattttataggtgcgaagttttcaggtcactgtctaaagtcacaacagcaaagggatgtaaatgacatcttgccagggcccagcaagtgtccttaacctagtgtgagacccttagcaaacatttgcccactgcctaagaatagccaaggcacagttcaaaggaccagccacttcctcccactgacattgacactggttgttttcagtggagagaaccgtggatgttttcagcactgtccctgtgccacagtgagctggagatctcagagttgctgaggctaccgaagtgaatgagactggcttatgtgacatcattttgtcagccttgtttctttttcctacatggccatatctgtatatttgatactttaatgaacattctttagtattatatcttaattatttttgtgtgaaaatattaatgtttaatatgtgcacagtgttctatatggttcctcctaaattcttagactaaaattatggaattttgaatttttataatagaagtagatcaaatagtctgaagattcataaggctctggatgtacagtgacagccttcttcccggcacaggccttatccatcttattttattcccattgagcatttctcacagtgctgacttagtgggaaatacatcgtgttggttctggttccatttctgttcaagcttactgtattcattctggatttatgcatgtctcatcagtgttcgagtagatgaagataatgactcagatgctctcttgtcatcttaggtccaagaaatgtagctctagagaaagatggctctgcctcgcctaagattgaaactgggactttggccagatacagaggcaaccataaaccaaaactccttagcacactgaagctttacaaagagctcaaactgctctacaatgtagctgtaatggactcatttcctagtaggaatgtggtcttggtctttgtacagtcttggaaaatggtttctgagtcttcacctctcaacttcagagcctatttgttttaagttattggtttctcttcttactcatgttaacccccttttccttacatagcttcccattctgaagccaacactgacctcaagcctgatcctcctgccttggctctgaggtgctcagaacttagacatgtactagcatacttagttcactgtcttcatttttaagattgagagagagagagagagagagagagagagagcaccagcctaattgtactgctgctgtggtttaagtctggcgtttctcagtctctagagagagagcagggttgttgtggatgcagtgctctgataggtcactcagacactggagagctatgtaagggcctgggagcctgagaggcttgggtatgatgagtgggtgccatcaatcctagttgtggagcatgcagtggaatgatcatattcactgtcagatttaggtaaaccctagtttcagtgatgttatggggattcctgtagactttctcacttaggtagtgagtggctagttttatactggctcaacattagacatgctaaaggaccagtacaagtgtccatatgagtccttatctaccaaacacttgtactccttctcttcctctgttgaaggatttttaaataaatcctggagttgtggttaactgcttgccccaaggtttatgttcctgaataaagccacacacagcctttatattttaatatcccttaaacaactcaatagctgggctactgcctaacttccatgtggttaatcctgagttattatgtactaattctatgttctaccttggctgctctggacccagagggctgtccacttgggtcgcgctctggactgtgccatcccagcttcttcacgtggctgttcttcactcttctcaggcaggccctagtctatcctctcctccacactgtcctgtcatggtggatctctttcttttttgttcctggtcccaaacctggaaatcctaaaaatcctgcctctgtctatactccccagctattggctgttggtatctgggttgtttgtttgtttgttttttaacaatcagaactaactgggtgcgggttcccagaagctctgtgcagaagttctcatgaaaacataattagcatcagaatataagcaactacattcctccctcctcttctcatctttacggactataaattggtgtcagtatagatatcctgaagttgggtagataataaaaatagatgtcctgttagaacattggatggatacaacatactgaaaatgagtgtctttttttttttttcaaaagtttctcaacttctaaagaacattttttattttaaaggggtggggggactttgtccttctcaaaccctttccttatgcttaatagctttttagggaaagaaagcacttgacatctgcttttgcttatatcctccaggccagtggacaaagggatactgtctcaatgctgaggatggaaattctctttataatctaactttggtcagaagtattcatcctgccctgattccctttctgtctcattaaaaccttagagtgactgtaatataaagtcatcgtgtcatcttctagtttcttcactttatagcatgagtatttttgattattgtacatatataagcgtcttttattgtgtgttgtctgatgaagtgggaatgtctggttttgttggcgacgcggttgtgccgtgtgatgttttcctggcagctgtctcaggagcggtgcttttctggaggctgcctggtgaaagggcgcgcaatggttgctgcagcagaggcttgaggacacatggtgtttagaaaggacatcaggacaacccaacagacagcggacggtgcactggcattggcttgccctggaggtatttgttggccttcgctgatgctggtcgtcactgatgatgctcttgtattggtccaccttgctttctttcctgatcttcgcttgtcgtgaattcacagaaagaagcacaccagagaattcctgatggtgtttcggctgccactgtggcagacttgtgctgattgcatgaacctcatggtttcttctggactgagcagctactgcttattcatgtttggggctttgctagtggactggactgcagacaacacagcttgaaatcactcacgttcccccttgttctcttagctattttcctcccctacctttggtcagtgggctgtaagggaggttgaagcatttaagaacccttattaaagtgggtttaaaaatatacttgagcctatagtctcaagtatttctggcaagtaaaaacttttaaattaaaagaaactttagattttacacatgtgacatgtgtgtgtggaggccactggtttatgtcaggagtttcttctagctctttcactttacttactgatgcacagtctctctctctctctctctctctctctctctctctctctcaatatttattttcatgtgcattggtattctgcctgcatgtctgtatgatggtagccgatcttctggcagtggagttgcaaacagttgtgaactgccatgtgggtgctgggaattgaactcaggtcctctagaagaacagccagtgatttttaaccattgaggcaactttccagcctggaggcgtggtctctcgctgagccctctttgcttcttgagccctgggatcacagacaggcagccagaaatgcctggtttttattaggtgctgggaatctgaacactggttccatttttgcactgtaaacacttcatctactgagtgtctcccagccccaaacaacatgaactcttaagtggtggtaccctaaatttagatgaaccatccatttggctgtgactttacgattttttaaatagagaaacatatactgtattaattgactataggaaagcaagaaatttttgtagaaaggtctaggggcagaaactttgatagagctcagttgcataggcggctcacgtgttgctatggggccaaccattcatttcacaacttgattaaccagtgtttattaaggaagtgtgcgtgtgcgggtggcgcaatggcatggtgaggagatggattgggatggtgtttgctttaaagttaatgaggaccagacaaggaaattgcaaaggtcattagggggaaagcccgccttccttcctaagtgggatggaagaataagcaggattagtcatcgcctcctctgtaccctctcccattcagctctgctttgccaaaagcactaattgtatggtgttgtaattatctgtttatgttctatctccagtaaactggctggcctagtctcatgcctctctgtgccttttacgcaggcacagtgctagtgggttgtttctacacacatgattcatctgtctgaaatagtaaattaggagacatttttggccggcaggtatttcaaaatattggcaaatattttgaataggtgaaggggattgggaggcatttttacccttgagtataaactgctcatttacaaataatactaagggccggcagatggctcagagagtgggtaggggctcttgcctttgcaagcctggagaatggaattcaaacccttgaatacacacacgtaaaggtgcaaggagggagctaacttcccaaagttgtcctctgatctccatacacatacatcatgtgcacgaacaatagtaaaaagtgaaatgataataatccagaaagtttggcttctcatgacaccacttttctatgactattacatttcaaaaaggagttggggtctgaggcctccccaatagccataactaatgcttactcttcacacacctgttttcagcctttctgttctatggcttgagtgtgtgtatgtgtgtgtgtgtgtgtgtgtgtgtgtgtgtgtgtgtgtccacctacatgaattgaagctaacagtcagcatatctaaggacacggcagtgatacccacatgatttctcctccctccctccagcatccagcatccatatcctggaagttctagtggaaattagcatcttagaatggacagagtgaactttgtccttggcccttttcctttaagacttggatacatgaaaatcagtgcttctcaatctaggggttgcaacgatccttaagacctaggaaaaatacaggtaattacattacaattcataatagtcacaaaattatagttataaaatagccacaaaaatgcttttatgattgggggtcaccacaacctgaggaactgcattaaaggatcgcagcgctaggaaggttgagaagcgctgatgtaagggcttcctcaataggccttgaattgctatggaaagtaaagtcaaccctctaagtaggagctcctgaagtttgcgagcctctgtgcagcaacagaaacagttaactgagtggctagcatacggaatgagagagagctctactagtcatattcctaacagaagatagcatccaaagacagactgctaagcagagctcacatctctggcacccacagaaaagccgggtgtggccatctgtgtccatctgtgaccccagtacaaaggaagtggaggcatcagaactctggagttcactgaccagccgaccgagctgagtaagctccgggttcagggagagacactatctcaaaggataaagaataagtgaaggagacacccaaggctgacctcatctgacctcaacacacacaggaaagaaatcacgagaactaaccaataaactggctattaaaatgagcagacagttagaaaagatgaaatactaattagcaatagacatgtgaggcccatcaagccagggaagttacctgggaccttacccatgtatgccatcctcaacacacagtaacatagcctagcccctgcatgcacagtcggtccacgggtcaccctgccacttactcctcatgaaagaggcttctgttagcaacagatggagactgctatagcaacccacaactgatcaaatgcagacacgtgcaatgtaagccctaccctgaaggctcagggggcattgaggaagaggggaccaggatgcctcctgctagatagtgctgcctggacaagacaggaaaagtgcatctgtaagtctcaccaatatggttgcctggacaagaccagtataatgacaacatcagttgacatatcaatgtggtggactgggaaaattccacaaggttccactcctcaatgaagaaagctacaggtggcccatgattacttagagagcaaatgtcaatttcttgcaagaacaacctcctacataggttgttctaatcccagctggacattgctggatctatggacacatgagcaatgtgaaatagactcagtggatttcttatacatatgcttgtgtgtgtgtgtatatatatatatatgtacacacacatacatacacatatatacatgtttttatatatacatgtgtttgtgtgtcttcatgtatatatgcatatatataattatcatatatatatataatataaaattaaagaagaagtcatgaatttgggagggaaagggacatgggcagagttggaggaagagagaagctagagtgatatagatggtatattcacatatgaagatctaaaaaagtattaaaaaccatgaaaaatgttcagcctcactagtcattagagaaatgcaaattaaaactgagattccatttcatcccagtcagaatggcagcccagttgttaagaaaacagcaaattctagtgaggatgtgtgcaaaagggagccttttatacactgccggtgggaatgtaaatccgtctagccattatgcaaataggcacagagattgctcataaacgtttacatacagatcttctaagtgactcagcccaaccactgctggctccttacccgatgtctctcagtcacttgatcccagagatacctgcacgttaacgatgcacacatcgtggcaccttttacacctactaagtgatggaaccaagctgagggtccagcaacagagaaatgggtggaagatgctgtggacagacacacaagggacttatttttcaccacagaaaagaatggagttatgccattggcagaaaaatggatgcaactagagataattgtattacatgaattttacatgagttaagccaccttcataagacaaatatgttttcttattgtttctaaaaacatctttttatgttgttacaaaaacaatgaggtctaaaaatataaaatgaatgtagaggcgaaattctctagggaaataaagaggagaaatggaggaggaagaagggtgagaagggaaggatggggataggagagataggatcgatccgtagcacatactgtatgaagaagcttggtggatgtcttgtgaacctgtcgtgacagtggatagtatgcactagttgtgtggttgaacacatgactgctcctttttcatcgtgaagctatgtttgccttcctggctcttgtctttaatagactctgagatagaatagcttgaagttgacaagagtgaggttacaattatttgtcagtaccaataactaatacttattaagcacttgctgggaaataggtactgccgaaaaacttgtggttaacatattgaattggtccttgaatcccccaaagcaagtgttacttcacttcagattttgtgaattttatgtgtgttactcttggaaagacttcgtgctttgaatcagggagattttgattttcatagcactgtcaaagctgggcttttcctaatgagaggtccgtagtttaaagctttcaactgttggttatgtgttctgttacgaaacttccataaggcagaattgcatattctgctgaaatatcaacgttgaaggttagcttgttggtaattaacacaggagttttattgtgtgcggcattcagcatggccctggggatgagggatggacgtgactataacagcaagggaatgaagaaaaggcagacccagggatacacacacagcaaagcaggggtcctgtggcctggcctctctgagggaggaactgtagcatcctggatgctcagtgtgtttgttatgtatggttgagtgggtggaccaggtaactgcacacaggagagcacagaggaggtgttaccacatgcagagagtgaggaagcagggctatggcttacacctggatccaggaggcaggtttagttaatcttggtaggggcatgactagacataaatatggggtggggggtagctacagtggatgttttttgtacacacttatcaacatcacatctggactggaagaaggccttggctccctctaaacttcagcctggggactggggggctttgtcattttccctgtggccgagggtttgaaaaattctgtctatagctttttagagcagagcatacttaaaacattaatggggtttccttgttgtgtgttttctgtttttctcctagattaaattttctgtgtgaatttcagatcttcaattttcactgccttgttttctcctttgattcatgtatatatttctgtgttttagaaattgctcatctctcctagcaccaagcccgccttagatagtgatcacaaagtgtctcccagggttgtcatgctccagcaggttacaaagaggaaaagcagaaagaagggcgctccatagagaggctatcatggtagcacatcttggcctatattctgagaattaatgtgaacctagtttatgggtattggccactgatgaaggattccagtgagctgacacttcctgtcctttcagtgatgacctgaggtcaccattgatgctctgggttgtttcctcgtatctctcattatcatgttgaattttcagctaagtatatttcacattgctagtgaaatgcatcgaagctctgtggctctgccacttgctgcctgtgatgctgggattctgttgtaactccttgcctgtgtggtcatttgtgaaatgagctaagggtaacagcatccacttgaaagaactcctggagacagagtgttcatccatgcttagcacagtgcaagtgaacaccacagctctgcctttatttattttaaaggtggccatgtgctgagagaacaccaagcctgcttcagatagagatcacaaaatatttcccagggttgtcatgctccagcgggttggctaagaggaaaagcagaaagaaggatgctctgctagagaggcaaaatgttcttcacaggagatggggccggaagtgagaacgatgaaagaaagagctggtgtggaaatgatcaacccacaggactcccgttcagttcctgggaggtgggaacccacggaagaatcagtgtgcaagctgatccatgctgactcatggaaaaacaggattccactggagattcagggcgacctgtgagaaggtgttctgaggggtcctagaagatgggcaggccagcacctctccatcacacttgctttttaagttctgggccatttgaagcaaaaccaaagaaaaaccaggctgcccgagcagggaatagattggctgcagtgaggagttctcacttggagaaaagcctgcggagacagtagtgctaggtatccactgctgtggttcgttctctgtctgtctgtctgtctctgtgtgtgtgtgtgtatgtgcgcgtgtgcacagttagtttggatctgtcctaggcagggaaagacaacttctctgttttcctactattgcaaagttctctttccttatagcatgtgacaaaaatatttttttcttctgattttcttccagttaactttgtgtctgggtttgcaatttttctttccttttttcttgattacttctaaattctttgtagataggtgtggttagaagtaaaaacagaaaagtgaaagtacatcagaaactgagtcgctccaaaatatgcacacataaacaggaaatatgtttcctagcaactagcttcgttgactttggctggagaccttccttctgtgacttgaagaaagagtcatggaaatacagctgtcagagaggtggatggccatgcaatgagtgtctgcttcctagaacgaagagaggcttttctttgtcatctcatctggaatcgcttcactcctcgagagcgatttggatactgagggttttcagaacaaatgaacaggtgcacagctgagccggtgccagaaagtgactttctttggaatgcttacagactttattaaaatgtgctgaatgagtttgatccttcaccattcccagcgcagccttacctcatgccaaaggcatggaaacggtgagaggcagctagaggtgatcttacatttccatagaaagtacagctctccatccatgaggccgctagcaatggccgtcagggagtcaagactgtgactcacgagaagagcctgctgtcctgtcctggggtttggcctgtgcctattttctgccaaaatagacatgactaacacagggagagcctagggcctcagcaaggagataagagatctgtaagctcagggctgtggagactggaatttgcacagctatgtaatgggaagagaagtgctggggttggagatctctaggatcagggagcagctgcctcgggtagtgaacagaaagaggaaagaaagcagggtgctgtgataccaagagtttggaagtttgagcatgttagccatgctgccaacaggttgtgtcggctgcatgacaagggggtaagggcagtaccacagaggaaggctgcttgcttgcagtacggatgtagttgaaatggatccatcttaatccaatgtagacccttgattaacagttggtaagatctaccaataatttagctgccacaatggaaatgagcccgctcaaattatctactttataacagaaagggccatgtggctcatatttagaatgaagatcagcgacgtgaagcagactgactggaaaccagtcattctgaatcttgctctctgttattccccgaaaagtccccaggaccctttggacaaattacctcatccagaacagagacaggacatatgcagggtaaggccagaacatttttattgtgagaaagtaaaggaataaaagtgagaaaaaaataaatatggcaaaaatatatagttgacggcttgaaggagcccccactggccaagtctgagtaccagagtaaataaagtacaggagcgacatagggatctgtcataagaagagcagggtgtgtactagccctaactacttcaccagtgaacaaacgatgaagaatgctgacaatgaatgaataatagtgtggaaagaatgttgcagtcaggatgctgcagctgtcaggacatataaggcatgtaaaggaggcatcatggacacctgggaagttttcttcttacctctcccctgccccttctccccctcttcttttttctccttcttctcctcttctttctcctcctcgtcctttttattccaccccgtctgtcttttccttcatcctatgcagcttactgtatatcccaggctggctttgaactcatgatccccccctgcttcagtttttcaagtatcgagattattacaggggtgggaaaggggaattttgcggtaggtcatgatacttggatggtcttaaaatgttttcctctaggtgaaacattagttgcaaggagaatggagtgacttctttttattgaacaaagtaggcattgctttgggatgagactaaacttggcaccttcagatgtgatattcagagagcgagcgtctcagggaactttctggctgagtgaaacataagccattctgattcaagcagagtcgccagaggaaaggacagacaaggcaagatggaacggccccattaattttaaaagggaggagctcaattcttctcaggtgttgtgaagacaaaggggtgtgtgcttcaggttaaagagaggcagcggggaatgcgtttctaaccctcagctggatcctgacgtggaagaaatgctattaaaaattcattattagggcaactgaatatggcgtccgtggtccccagttggtgacttcattgtgattatgtgagagcatccatactctctgggaatacttcctgaagtgttgaaaggaaaagagccatggtgtgtgagactgccattaggttcaagacaaaagtggtcagtgtgtatatggaagaaagtaagcacagatgttcagagaaatgggctaaatgttggtaaacaagtccagggatgtgctacatgaatattctttgttctgttatttttgcaacttttctgtcgatttgaaaattactttcaagttaaaaaggtttaaaaagttgagcgatgatgaatagactcacagggcagaggtgggagggtgagtagaaaagataaaaggttgagttgcctctgattttctgctgcaagagttgctcttctaagtcaactgtttgcagcagtgtcttggtcactctgtagacaaaggtatttctgtatctgttgcgtgagaacgtcgatcagcagatctaagacaagaagagtcagtgctgattccgtctcccaagtgctgcgattcaggagtctcagtagacaggggaattgaacccaaggctttggcctgcgaggctgtattccagcccctctcatttcttcttggatgttttagctgagtagattgggggcaagttctctgaccatcggaaactactactgctgcatttccacagagcattctcaagaatagaagtattgttttctgaagattgtgaggctccgagaggagatgtacactgttgctctttgtaaatagcaatgacttctgcattggcttactacttagagtgttaattatagatgaaaagggggctcaggctaagctagagatttttctgaatttgggtggtcatttctcctcttaatggtggaaatgttatctgattaaatgagtttctttccccagtgggtgcctctaatcctttggttgatttctttatttcctgactttgttattctagggaaagcttcagtggctgatggagctgtgaccttttgagcagggtacatttggagcacagagccgggcatataatatacaagacagcacaggtaagtgaaaccctgtatctcacacaatctcaaagaatccatggatccgaatatccctgtaattcctcctcctttgttttgggattgattgtaactctggtggcagagagctaatgtccatggaaaggccgttaatttttgtgagggtcaggaagaaaattagagaggccagcttctccattagaggaggcaagcaaggtggctaggcagaaagacaaagggcacatatggcaaataaccttctcttgaatcctataaaccccaggagtctgaacgattccaggaaggctgagggccgtccagggccagaccactttaattcaggtttgctttcaattggagtctttatcttaggagattacaatgagcaaatatgcttccttctttgtggtggggcagttaatgtcattgctgccccagtcagtgccagtggggtggaataaagaccttcaccaagtgcattggttaatgtcataaagataactcagaggaccaaaatatgtcaatgtcacatgaagaaatggaagcaaagcagtttctctgcggatgaacttggccaagagcaagcccaagtttcaatcgtccactaccctcctcataccgccttctcctgtttgtagtttgtagtttctggtgtccctacaatctgtctgtcatggacagctgtgcctgttgcctgtgagttgtgcctgtgtgtgtctgaattggggtctgtcccttacaaatggctttgttctgagttcattaaacaacagaatatggaaatggaggagggctactttacaaaacctttaaccgagtcttacaagaggaagaatttactttcctgaaccctgctgacccagaagagcatttaacactgcagactgttgttatcaagacacaccctgatgatacttccaatatttatgtggtatttgttttaaggttcttccaacctattgtctgcttatagcaagtgatgatcaccgcattcacacgcacgcatacattactctaggtcagggtttaggggagcataccatttaaggttaaagcaatgcacttagcttagtttgcaaaagcttgcgtgggaaatccaagacatagtaaggtgtgttacattattctcttaagggaaggctaaactaaacaggctgagtacacagtaggaaagcaggctaaatacacaatgattttgagcagtcttactaacttggttgcaaggccccgcaaaagttcagattctctggggtcaagaagtattttcagaaaaaatgcttattcaatgtgatcagacaactccacatacagagcaaggatcagaaataccttactggccttacttacttagggagaggaggagggaggggggagaaggagggggaggaggagggagagagacggagagggctcacaaccatctgtagtgggatcctatctcttctggtgtgtctgaagacagctacagtgtacttacataaataaaataaataaatctttgggccagagtgagtgggcctggagtgagcagaggtcctgagttcaattcccagcaaccacatgacggctcacagctgtacagctacagtgcactcatatacatgaaataaataaataaatctttaaaaataaataaataaaagtcatatttcggggctggagagatggctcagtgattaagagcactgctgctcttccagaggtcctgagttcaattctcagcaaccacatggtggctcacaaccatctgtagtgggatccaatgcccacttctggtgtgtctgacagctacagtgtactcatataaataaaataaataaaaattttttaaaaactgggaaaaagttctatttctgctttcaagtacatgagaatgtctccgatgctattattctgctgtacttatttcacctctcatatttaaccaacaataagtggttatttcataacttacaattggtgctacctggccaatcccttagtgctctcaatgagtatgtgatcttctttcctgatgtgcaggttgaatttggattattggctattaactcaaatggggcttttatctgagaagatctcagttaacaaatacaagctatctaggttggcatcacctgtagatcctggctatctgtgaggtggatgcaggaagattattttagctgatgagttccaacccagtccagataccatcgtaaaacactatctcaataaaaaacaaaaaacaaacaaacaaataaacaagcaaacaaacaaaaaaccaagcaaacataaattcagtcaagcgtggtgtcacatattatagtctcagcacttgggaagctgagacaggagggctgccccattttgtaagtcattttatgctccatagtgagttttaggttagtctgtgctgtacagtgaaaccttgtctcacctcaccctgacctacctgataattttaattttaattcacctgataattttaccatggaatctcaaggtataacttctccagactacaaacccaagaccttttttgtttgtttgtttttaggaaactagtgttttttttgtttctggaaagctagtgttagtcttgggattcaccaggaaagccaactccaccagtttgagccacatttaaagcaagctttagtaaatattaaacactgactaagggataggctttggtcaggaccattccctagaatgtcccagcaggagtggccttgaaccacgcgtttcagggacttatagggacaaacctagaggccatagtactttgtcatgaggctttattatttttttaagaaccacaactcgaagctcaaggaagttacctggtttctgggcaggtgggacttgcagattagctttgggcattccactagctatctagatgctcagcactgtggctggggtctgagtcgtctccagcggctccatcattttgctgtgtctattcttcaaggctcttgccttaatttcagtgaattgctcctgccacagtctctcaggcttagtatttgtaccaaaggctatcattgcattatgaccattttcaaacataattttctaggttttatttaaaattgtcgtatagcagaaatctaactatcccaattcctgtcttaggagtgctcaagtgattagaaaacaaatcagcttttggtacatagcctctatcaattttcttaagtcttttacatcttaaaaggtaaattacttcttttacttcacctgaggataagcacatgccagttagtgccccttcaaaactatactggctcacatctgtgctcatgtcacatgttcacagtccgctcccagtcttttcttgctaatatgttgacgatttagtccttgggagccggactccccgctctcagtgtctcactagcagggagggcttcctcagccccagtttattatgccgtgcaatctgttttctgtccaagagccatttttctttctatccagaatcctagacatataagattccatggtggctctctgtctgtggacatctttcttcatacagagcacagaaaagaaatggtttgccagtgtgaattagaggggtcctctcaggtcacgcccagtattttagcaagtttctattaggtgtataaggcaaaattaaaagcttgcatttataggatgctaagaggagtttttgcttctggaatacttccaaaataggtgtcaagtatgatggctgatttcatagtttcttttttatggttttttcagaacaagcccaatcgtatatctctttagatggttcatagttttgacagatgtttgccagatttgtgtgtataactaacaatgaacctgggctgtagagcttgtggagcgtgtctttaacccacaagatctttatcctttgcaggctacaaggatggcatttatgatgccagcctcataaccttagaaaggcaggcagtggttatagtgttaggaaatgctgagctgtgactggacgctctccaaaggctgcctggtattttttttttttttcttcacagaaaatagaatgttagaaagttctgcagtttttctgcctttggatttcaacttggattggtagttccttatgtctttgccctcatattcttgttgttgttgttgttgttgttaattaatttttttagtgggttttgttttatagatggttgggttagttgaacattctagaaactccacaaggggctggagaagtgaggcataggactgatgaagctggccagccataaccacacttctccagggaactctggcaagccctctgggcttcctgtcccctagtgcatgcctctgggctgtggggatagaatgcaattgcctgtgctttgggtctgttggcctgggccaggtggtggctgagcagccaatgctgatcctctgagtctcctgcttccctcttttaccataaactcctttgaaggttatgattagtgtgaacctgtagtctgattaagatgttcttgttcatatgtagaaattcggtaaaactatttctaacatggttcacccaggtacagttagtttcttaccatgaacctgagattttggtcatttcagatgttcatatctgttaatatgttcaagattggagcttgctggctgttgtctggaagagtgactgcgaatgtaccttggtcgccaggcccagtcattggaccaggcaggacagcactttgctcagtgtgttctctggttcctagggctctagtaatttaactctgcagtgacactgatcactcatctcttaccttggctcccgaccatcagccatttacacattgtctgtctgtctgtctgtctgtctgtctgtctgtctgtctgtctgtttgagacaatacacgtatagttctaaacaatggtttgaaaggttaagattctttgaaatacttttgactagtttgttgctggcttgccagtttaccttaaaaatgcccacaggacagtttttatttgcctctatagtggtcaggtgctaagtggttggaaacatggggcagaggaaggcataccagctttattggtagccaggctaccttggctgcatttgaacttgttatcagtctggatggttctggttagtcaattagctttgctcaagcatgcttttcccacctcgtaactactttgatctgtgcatatgccatagcagggctcccaagtgttttggttttatggccacttcacagtcttcagtctctctctgtctctctttcccctcctccctctccattcatatgtggctagatgtttgtgtatgtgcacatgtgtgtgcatgtgaggtcagaggttgatgatgggtgtctttctctgtcactttctatcctgccattttgagaacacgatctctcattagacctgtagtttcctgactgtggtagactagctgactagtgagccccaggatgtcactgtcttcctttcccagtcctgtgatttcaggccttattcatggactcttctgggccaagctcaagtgctcagacttgcccaggaagcacttaactgagctttctccctatgccctttatgtcattaaaagttattcgggactccaaagacctttcctagtaagaattatattcagcatatcatgaatgcagaataatggcgcccatagatgtccatgttccaaccctagaacccttagaacctggagtgtgcttttaagtagcagatgatactgtaactatagtgaagacctctagatgggaagacatttctaaattgtctaactgtatttctaaacatggtgttagaatatcacatgaactcatgggaacttccttttaagagtgaggtaggaaggctggggtcagaaaaaggagacaagagattgaagcagatagcaaagtacagcagagccaaagaattctgctctggaaggctcagcactccagagaggatcccaaccttgccacacatcgtaagatgatctgtggtcctgagctccgggactctgagatggtaacggccacttgttacagcactgggtgggaactgaagagtttattcaaaactaataaacccattgtagatgagtgcctgcctgcctgcctgcctgcctgcctgcctgcctgcctgcctgcctgcctgcctgcctgcctgccttccttccttccttccttccttccttccttccttccttcctttcttcttcctcctcctcctcctcttcctcctcttcctcttccttctaatttttcttttttaacaaaaaatgctggggaccaaatccagagccttgtgtgcactaaccaggaacaggaccacaaactacatctccagcctataaatcagctttcgtgaaatactgcccattagttaatgcggttactgctgttcatatttttgtaaatgtcttttccatcagtttacaatctggctgctttttcctgtttcctctgttctcagtatgtgacagtgccatgtatcatgcctcctccaagaactccatgcttacatgacgaggatgaatgtcgaaaagacaaagccttagtgttgtttactgtgaaatagtttatgccatgtggactagatagtagggcttggggaactgaagggatccatagaaccatgaggctggtgctctgtctacctcgtggctagaaacctacctggaaaactggggactgcatttctttttttctgagccttagttagaaaactagaggctttgctttttaaggaaaaacgacttaagagcttggagcaaacacattttgatatggattaggtaaacaacatcatctatttttggttttgtttgtttggtttttttttttttttgttagaacaaatatttgagtatttgagtccaggtagtttataagggatttaagtgacttgggctcgaagatctgaagtctatgaagtctaaaagcatgggccagtgtctggtgaggtgcttcttgctaaatcataacatgaaaggagcgccctacataacgagacagccagtatgggagcctggccacctgtgcttccatgggagtaacaccttcctggtgtcctcaaatcctaataacttcaccaacgcctcatctccaaatgtaaccagtggaaatgggaggtcggagcttgttcccaacacatgtgctttggggggcatgtccacactgcagcagtagacagtcatcaaaatgttcatctcccttcttcttgtcccaggatggactaggaaaagcacatgtttgcttagactgcatcattcagaaatagccaaaataatacacaattgcacggaggcagaggcataattgcaagggagtgcatttttggcatttgtagataaactgcacaaaatatcttttgtctgctccgcacaggcagcttttgataaattgtttgggcctttgaagttaacaataagcttcctttccttgggaagagaaaagttgaaatgagtttgaagccttagctttgattcctagttatttttcatggctttgaaaacacaaggagcgtgacctttctcctggggtcatctgaagtggttcctgctgttccctggcaccgttctggaacttaaggtccaggttctgggatcaagcgccttctatgttgaaagatgtatggggaacaatttgtgtttaaaggtcttgattttgagcttactgtaagtaaagcttagtaaaaatttcactaatggttaggtgtgtatttaacgtgtttatagagttgtatttaaatcggtaattgcaacccgtcatggtgactgggaacttgggagatatttcagtatcctgcatatgactgtgagctgttctttcagcctgtgggttggagaagcccatgtgttactcacactttatattttctgttcctgtctgcatcaatttgcaagggcagttttggggtggcagagaagagggcagagagggcaactttggtggctggagtccttgtgaggtagagagatccttgtttgagggccaccagtggggtgacctttgcaacctggagttgggggacattcctactgactttggagaccttttccagaggcccccaactgtctgcccttgctagtgtgtttctcttcctacaaagtgtgttgtgtaactaggaagcaggctcttttctaatcaaggctcagttatgagtgggaggagagaagcagtcagtgaaacttgaccttgtggactgagggcttcatgtctgaggaactcatgttttcagtgaacagtaccacaatggtggcccgtattaccatatatagtcgtgagaagctgatgagtgtgcctatatattttttgtatatattctgggtcattgatttgaagattcctgggatagctgtctttgagcttagctagatgggacacagtgtgatggtgggctatggtaccctctcctctcttctctagatgttcattcatcactcctggatactgtgggttggtgaaggtcaaaatggtttgtttcttgttaagagccagtcctttgaaaacagagggattgatgtcatcagtgcttagaggtgtttggaatcattggtttggggacttggcggtaccttattatacaccatcattttgatttgggagtttttccattgatgaatcattaaatataaatggtttttgtgggcagaagcaaactataatgcagggttgagagctgtgtctaagtttcatatcggttccttggcctgagagcttcctcccagctagctcaggagaaatcagatgagaggcagcctcacaggctggcaaagccaggtcactgccttgccctagagggctcctaaatgtgcgtatgtgagggcaatttggaagtttgaagaggctctctggaaagatactgactagctggtttttgccagggtcctgctgccccactccatttctcgaggatgccccaaatccttccatagcagctgctgcagattcttgatgcttcttgagtgccgcatctctgccagcctagctctggacagatgcccttagaaatgaagtcatgagacagagtttgtgcttttcctccatcctgctgtcacaacagcagggtagatccgcctttgtcccagcagtgcttatctgctcctaagtcccagtcatgtgtgggcatgtgttgttttcttgtcctcatcctttggtcctatccttttcctctctcagacacatgggcatcttctcgatagtatttgctcactttaagatatatttcttaaactagactccctgtaccacatctttgattgatttttttcctcttaagatgcatctgtgtctcagcccactccctgaaaatcctgctgctaataatgtaacctgatagctacacttcacttgcacagaacattctttgactcacctactctgtgtctgggaatttggggtactgatgccaggaggcaaagagatggatcagataagtgagactgttggtgttgaacggagagggggcacaagatatggttacaaatagcagtagagattagaaatagaagtatgtttaggctgaaagggtaaaggaacaattctacctctaagtactggtcccacagataagaaaaggccatggtggacattaattacaagccagtggtgggttcctgtgtccagtatttctgataccatctgaaacaaggagctgcaatggtggatgggcccatgggggacagctgtcataaggaactattttggtctaggagtgttgctgaggtaacatcacttggaggatggataattctccatgtcttttgagtcaggagatgagtgatcttcagtgataactcttagcccttgagatctttggtagatcttcctattttgagagcatcttggctatgtgcctaatacttaggggttctcagatttggctaccctgttcctgttgagggcctggagcactgagcctaagaacagcaattgcttacaagggctttcctctcagtcttaacaagactgtgtttgtgacccgtcaccatggatagtacatgctggctttgtgtatacgtatgagtctgcgaggacttcctttaaaggcgatgaccattgtcttctgagagcagaaataggacctgaaaactgaacacagcttgcacgtagcagctgagggggaaaaagctggtttgtttgtttcatattttttaaagtcggcatcaaggctttgtggtcaagtctatcctggagtgtcctatgtagcccaggctggcctggagcttgatcttcttgcttctgtgttctgagtgttgggattataagcaagagccacaacaccctgcatggcgactgttttgatttttcccttaaagatgtatttgttttattattttatgagtgttttgccttcaggtacgtccacgtaccatgtatgtatttggtggtcatagaatcagaagagggtacaacgtcctctggaactggagtttccgatagttgtgagccaccatgtgggtaatgggaattgaacttggctcctctggaaaagcaatcattactcacgaccactgagccatctctccagctcaataattgccttttaaaaaattggctgggagaaaactttagggtaaaagaaaatcatgattggccaaggatatttgagggaagaatcttttttgttcaaaatgtgctttgatgtatcagatttgtgtcctgagtgtgaatgtggttatgtaagttacaaagttttatagatctgtatacaaaaaagaggaaaaactagtgagtagtgaaatctgaagaagtctgcaacttagtgattattattattactattattttttttctttttttggttttttgagacagggtttctctgtgtagctctggctgtcctggcactcactttgtagaccaggctggcctcgaactcagaaatccacctgcctctgcctctcaagtgctgggactaaaggcgtgcgccaccatgcccggctttattattatatttttaaccattgttttgcagttatataaggtcaggagagctgtgtgaaaaatatactagaactctaatttctgcaacttttaatttaaagaacacaatgcacctattaaaatgtcccaaagtgggctggagagatggctcagcagttaagagcactgactgcactttcggagtttctaagttcaaatcccagtaactacatggaggctcacaaccgtccataatgagatctgatgccctcttttggtgtgtctgaaaacagctacagtgtacttacatataataaataaataaataagtaaatcttttttaaaaagtcccaaagtcagtaaaactgaacaaaaatgtttactaccaagtcctggccaagctgctgaggaattagaactcttggacacattgctgatagaaatgttaaatgattgagccccttcaaaaagtcagggaatttcttatagtttcagccagcatttctgcacctgggtatgtacccaagagagatgaaagtctactggcagagaagcctccaggctactattcatagcaactttttctaaaactctaaagcagaccgggttccttcctgttagtgaacgataaaggagctggtccctccctccatggaaggttcctcactagtgggtggctgctcagtggtcataaagaacaacatgacggaagccaaactcacaaggatgtgaaaagtaagataccatttaaggaacattccagaaaatgtgaaatacagagttagaaatctgaccattttacccaggagcaggtagagatgacagggagagaagatggagggcaaagggtaatggagaaatctaggatgagtgaactaacacacacactcacacataccctccctccctccctgtggtagtgacagtgcattggtcagagctgacagagctgagcatcaaaatggttagttactgtatgcaattgagacctcattaaattggattttcaagtggagacactgcctccatcaccagtaaacaaggatgcaccttggctttccaggctgtggagattcagcgtgttgcctcttgcctggggttggataagaactggaatttccttagttgcacttgctgctttgttggggtgtgaggtcctagccccatcaggactttggcctctgctactgtggaggtgggtactgtcataatccctgccaacacagtgctcctgggacagtgtaacaggttatggcctcattttagagatttgggttgaatgtgaacatttagtcaaatctcatccattctcttctgctttgcctttggtagagttagagtgtggtcaaaatttcattcagatcgttttaatcttcagctgtaagaactgaggtgaggtttccaatctcctccccataatagattctgaaatgtaatgtgtgtatatatattatatatgtactgtaatgtgtatataaatgnnnnnnnnnnnnnnnnnnnnccccgaggctttctccagtaggaggcttgcggttgatttactagattggtttgatcttatttctgttcagtaggcagctcagttgagtaaacaaacaattgctgatcattaaccaagggcctatgcatgtgcctgtcatgagtcattgtggggtcacacaggagaaaggggaagtcaccacttggtaaggtggaccagagcagggaagggcagcttgaggtcaccacagagtgcagaggagtcagcgtcctgcagggccatgccttgatatgtcggtatgggttttttgtttggttttttttgtttgtttgtttttttttgtttttcctttcaaaaccaaaacctctcaaacttcaaggatccactgactgtcgttttaactagagtgttctctcaccagcacctttgggtgtctgaggtggccgtgagactgttgaatggctggggctagcggtagatgaccttcagcagttaccctgtaagttgtccctgcgtagatttatcaagggtctttagtaggcttcacgcagtgtcaggttgcgttggaactcatggtaactgagggagcacaggttggagccccaggtcagaagagagcttctccctcgtgttgccacaccatcctgacagtgtgctatgccagcctgaaggtcctgagtctggcctgcagccaattaggaggatgtttctgtagagtctcctgtgaccaacttactcaattggtgtcctagtctggcacacaccactgatggctggcagcaggggttgttagttggctgatttggagactggatgaggtagttgaatgttacttctcatatacatcgggcttagtgtaggacactcagtctggatgctgttttgtgtgctggggtgggtattagctggttttgtgtcgcttgtcgcaagctggagtactagagggaaaggaggctccattgaggaaatgcctccatgagatccagctgtaaggcattttctcaatcagtgatcagtgggagaggacccagcccatggtgggtggtgccttccttccctggcctggtggtcttgggtaagcaggctgagtaagccatgagaagcaagctagtaagcagcactcctccatggcctctgcgcctgctcctgtgtccaggttcctgccctgtgtgagttcctgtcccgacttccactggcaaagaacagcaacgtggaactataaggcaaataaaccctttcctccccaacttgctttttggtcctggtgtttcactgcagcgatagaaaccctaggtaatacagggtgcatctcccgaatcaggcccctccccacctctctgctcttgcacagaagtacgatggtgtatcttcttaaaatgtggttttggtgatgcagatttggtttgataaggagatcccagctgcttgctttctagcctgcttagcctcctccctgctccccgaggtcgagctgggctttgctgctcagtagagctgcacggaaatgcagaaacaagaagattgttgtaggactcagatccgtggcaactgcaaggcagaaaaagaacacagtccttctgttatgtttgcactcgctcaggcagtgcttttggatgtttatatcgctgtaggaactttcgaaagcttgactttaggtgttctttgtattttagagacctccagtgagtggtggcttcacctctcagaaggatggatgagctcatggcgatggagtttgttgatcagccctagctaccaatgcgctatgtcatcttgtgctagttggttttttcctgtaagtggggcagctgagtaacccatacttgctgttagaactatggggagttacgattgctactagatcacagggtctggatgggcaggcctctgaagagctttggggttttacactacttcctgtgtggcagcacttactcatttgagctggcttgggtctgtggttgacctgtgtgattttaggtggtcaccactttgtttcagtgtcttcctcttcagaatacagttgggtgaggtgagctgagacatcaagtggacattctctaccctgcttcgtttgtgccttcatgtttcttttccacatggctttcacagagttcctaacatctgttgtgtagaaggaaatctgtactgtatccaacacagcaaggaaggtagctccaggctgtcctttaagagagcacacagaagtacctacctggcatgcttcatttctttcccattgtatactgaactttgctagttctgaggtgctggagagagaaaagaagagagtcccggcagtgacctctgccctatagatgttagtttctagggatagacatcagctacatttcagaaataatgatttcattacacttgtggcttgtgctaggagagtaccatgtgtgatagattgaatttgtaggggcggtgtgtgaccaggaggtcagaaaagtccccctgggtcataaccttctgctagagatctgtacaaggagagggtgggtgtcccaaggccagcgaaggggaaggggacaggggaaggattcccagcccctcgaaagagccatagatgaggcgggaaaggtttgggggtctgtgctttggttggggtggacagcactatatgtatgggggagagtgtcttcccccataggtgtgcctgctctgcatttccctgatgtcattgttcaggtgactctatagtagggacaccttccctcgctctacctctctttgcagcatttagtgatgcctgacaacctagaattacaagaaaggagtcaatgacacagggctctgcccatccctgctgtgttcagaggcctcatcaagtaattgaatgagtcacctgtccccatccctactgtaatagaggcctaggcaagtgcttggacgaatcaggattttactttttgtttctttttgaaactcaaatgagtttccagctaacctgagagggttggggctactgatcctgtgacagattaagcctttcattttaactaaggacaagtaaaaaagattaattttcttctttaaaaataacctaatgcaaaacaaaacaaagcaaaacttaatacttgtaaatggaagatttccctgggctgaaactgtgaacagctcccccaaacagctcaccttccaccccagcttagctcctctgtgcacagttgagtatggcttgcttgcctgtcctgatctccagctgcctttcccattcattagcagttatgagcaagctaagcagccctggatgatggacgttccaagtgtgaaccacagttcccattggatgtttcctgccacggcctttgcaaagtcaaagaatcccaggggagccatctggattcaggatttacctgctttctcttttttttctgttgttcttcttcacaaattggtataaatacctagcctccacttcttcttttgagcgactgaaccagacttttaatgaaaacagaaatctagccttgcatttcacagatttgggggctaaattataacataccctagttctgctaaactaattgtttgtatgggatgagcctctggccttttgctttgctcttttttacctcctggggacaggtctggagaccaaagatgtatgaagataatatgcacagaaacagcatgggtctcagtatgtggttcgtgattttaaaaagctaatgcagaaatctttctctgttggtactttttacaagatgggcaggatctgtgctggccaatgaggctgtgcgtataatggtcacagttggagttaggcatctgtctatttagatggcgtggctgtcatgtattagctgttaactgttgcacaacttaccaacctttctttaaagtgactcttgtcacaacagtagtattgtataagaagaccattatttgctattgtttgcatttattataatgtacataattggtgctcttattaagggctgtagcctgagcatgattgtctactagtgttccccagacttgcctgagcttataccgttcctcaggtgcttgttaaaagcaaagattctcaggcaccacccagatacccagacttgcttcatcagatccccatgggagaggcccggcagagccctattacacaccctggtttcagatattttgcatgaatttttggtgtgcgtccatatttggtactgtgtgttccagtcttgaccagaggaaacatggcctctggtcagactcttggcaaagactctttttctcaacatgtgtaacatattctcacactccaggttctagctacaaagaagaatggtatcatgtgtgcaacttggctagcctggcattctttctctctcttggtgaaatatcctaataacctgctcagcctcaacatatgtatcaacatgatgagcctgtgcacagttctgagtgttccctccagatgtgggtgggatgggaacaggaagtgccatggcgtgctctcaccgttatcagtggagagcaggctgcaagctctacttttttcagtggagacctgggagccagatgctgcatcttaacccagggcacagagattagtgcactctgagccagctcttctggaaaaacagcgtttggctgtttttcacacaagcctgcaaatttttctctctagcccagttacttccttgttagtgacaaagaaaggtgggtttgtcacattttactcacaggactggggttttgggagacattgcaaatggggttcccagcttggggttctcatcttagcaagggagtactctgcattcctgcggagatggggcgatttttttgcctccaccttattctgtgaggatttaaagtgattgatcttgatgcttctgtccccctccctccctaaggtcgtggttttacatgaatagaacttgacttgagattcggacgtgggttaaccttgcctttctgttctcattctcctcatgccataaggcagcttgatgagtgctgagaatcttatttcagtgtcaggttcattttctgacctgtgaacaagtttatccaggtttgtggcgattgatataacagaggagtttgtgtattctgtggcgccccttagaaaaagcctgtgaggcacccttgacagtagcatctgaagactgaaagagaaagtggttttgccctagccccatggcattcttagtgaaaaacgctgatccacacagttgtacagagaattttaaaaatatcatggcagggatgagcagttgacgagggacatggctactcatcatagcttggagagaatgcagtcagcttgctcttggtttcttttgccttgtgggtagatggaaatcaccaggcactccttgcgtctatcccgctctcagcctttaagcgcttagcagtggaatgagcccaggcctgtagcttcctttacttctcttgctgttctgttttgcaatgtcttttctcatttgtggatctttccattgcaggagagactggaggtagctgctcatgtcattggtttactgactgtaagcttatgcaggttaagtgtttttgatttgccgtatctacagactgtttatgtctagtgagcagcctcgtgggaggagggcattctaaagacgcgatgagggcttggccaatgatatgttgatgtaatgaggaagcaatgcctactccagacatttccaaattgccagtatcatgtggaggggaggttcagttaccacccacaaaggaagccttctgctcaaacaggtggaaaaactccaaccctttctctctccacccagtccatatacataacaaaacacaacacaaatggactgtgaaacaagacagccaattttgttaaatacctgtattcaaaactataattgtgtatgttattatatataattatctagcaagtaatcctaagccccccaaaattttaatgataccatgtatcttgccacgttactgtatttttcatttctataaaaacatacattttaattcagcattatagtttgtgcacatttatgtatgtatgcgtgtacatgtacatgtgtatgttcatgtatatacgtttgtgtacatatgtgctactgtgtgcatgtagaggtcaaaggacaacctttggcggtcagttctccttccattgtgggttctggcattgacgaacttcaaagaggatttttttgtttgtttgttttgttttgctttgttttaatctgttggccttctcagaggctcttaacaaattttctaacctctttgaaagtgaggcttcaatctcacaccttctagaaatgtctgaggcacctaacaagacaaagtatcttataaggacttagaaacagtatactgatgggacttaaagtatcactcagtagtttgatctaagtgctagactgcagtgctacactcggtttttcacatttaaaaagatgttttgtgctgggcggtggtggcgcacacctttaatcccagcatttgggaggcagtggcaggcagatttctgagttcaaaactagcctggtctacaaagtgagttccaggacaaccagggctatacagagaaaccctgtctcgaaaaacaaaacaataacaacaacaacaacaaaaaccaacaaaaaccgatgttttgttttgtttttctgtgtgtgtgcaagtgcgtgtgtcatagcatgtgtgtagaagtcaaaggacaacatttgggaatcagttctcactttccaccttctttgagacgcagtctgtctcatttctgcaactgcactgggggttctgggctagctgacctgagaccttccagcctcttttctgtctcggcctcccttctcactatagtgatgctgggattatagatgtgtgctaccatgtctagcttctttcatgagttccaaggatcagacttagaggagcacggttagaggcctttatccatcttccaggctggagagttcaaattttgtctgtattcatggtgattatttacagactgcttttctcaaaaattgcctgtcaatttttcttggtctctatatgagtcatatagagttacaattacaaatggatgtttttaatgaactggaagaagagggaaaaattcaacgtactagatcaagtatcctccctaatgaaaaatatagcaaagtagttttgtatttattgcaattttttgtttagtgctgataaagttgatgatgtaatcattgtcttagataacttcctttgttcttacattgctagtgtgtgaactggtcatacccacatttgtccccttctctgcggcgctgtttacagttgggagggaaggggagcgtgaatcagccgctgctttggagaacattcagaggaagaacagaggacaacattgccggagcatagatggaaaaagaagagggcaggagatgagactacaggagccaggctgctccacgcagacttcagttgtctgtagaagagttcagatttgttctcaattggaaacacagaacaactggtgctttatgaagctcccctttgctctgtttgaatagcggactggaggccttcctagcagctgctgaccccatttctccttcctcccgtctccctgtgtcctgtagtcctgcactgttttcttgggagcacgtcaccagagcacacagcgtgctctttcttcaactgcttgactgtaaactgtgactgtggggcagactttgtgtctttctctactgctgggctgccagtcccaagcagcagtcacaaatcccaaccaaagagacgaccaggccagacaccgaaatcagagcgggccagtcttcccacaaatgacagtgtggttgattacagaagaaagtagaagcagtttgatgaaaaaccaacaacaccttggacaaggcgtcaaagttcacgcttctaatattggcagtgggcagcgtgccccagctgagactgagttatgtgagttgacttgtcacaaagcagaatagatgtaatgatgcaatgagtgtcatcccataaagtatagagaagcaattatgtcagtggaaaagggatggagaagacatgagagctgtgtgtagtttgtggtctgtgctggattcgtgctgcacccagtgctgggaagaggagatgatcaggaaggatggtcatatagttgcggaaactggagtgttcacagaagagtgtgtggcgcccagggattttaagagtaatgcaagtgctctgaatgagtggcatatcatttgtgtgtcctgggaaacaccataaaaatctggggttgaaattgtcacagtgagcctcctgagatgtactttctgtccgagcactgtgagccaggtgccgtgccaaaggtggcacctttgagatcagaacttttaggtgtgaggggtctgttcctgggaaaacagggccagtcctaggcagtaagtaatacagcaaggttgctgctgggaggtgagagtcaggtttagcaagagcattgaaagtgggggcggggttgagggtaaagcagagagaacacacttgcttgtcagcactcaatttccttctccccctttcaaaatgattctttgaaaatgttgcacatgactacggtgtaacttgatcgtgcccgccatcctctgcccctccgatgcctctctgaggcactcaacgttttattggctttctcggggcagggaagggggtcaatttgcaaggaagcttcagagggcagaggggggtgatgcagtagcaggtcctccaggtgtaggacagtgcaggacagtgtgtgctcttactgtgggtgacagagatggcactgcttcaggaatttatcttgttgggcatgcttaatggccagtagtgtttcagcctggttctctgagacccagtagtaataggactcttaagatgtcaccccacgtattcagaggactggctaaagagctctttaaaagtccaccagcatcttagagaatcttagagaagcatatttaaaattacatatccatgttctttcttttcggaaattaggatatttaaaaaggatcattattaaagcatagattcctttataatcctgagctaatacgcctacactaaggccatggtcaaggtgctgtgttgtaggccatttctttgggtggatagaaagaagaggttattgtgacttgatatcatggaaagattcgagatctgaattagtagcataactaatactttagtgtcttttgacatggatatttctcagcagagtatgcaaagaatgcatcagttgtaaggagccattcagaatacattgtaatattgatggaacgcaaaggagaaggcttgtgcaggttggaagtgtaaagtatttagaccaggacaaaggtcttgcagaaggttgatttgcatgttgtcttcacttagcttttatttgaaaactcacttgtgtgtaattaatgtttaaatgtatccatcttttataacacttcagctggtacttataacatttcaaggtttctgcactttgctgtagtagattagtaagtttccagaaacaggctaaagggcagctttcgagtgggagtttgggtagcatagttttgattctctagcctagattctctgaatatcatggaaaggccagacacaattctaagaagaaggtgtctgtgaggtcttcaatgatttctttgcttttccacatactgacatatgaacttagcctaaaccaacgctttaaaagacagccattttaattggttaaccaaaaaaaaaaaaaaaaaaaaaagtgaacagttgtctctaatgtcctccttccttggctgtataactaggttaattataatctcaggtgtatggtttttgatgttgctgctgctttcaaactgtggaaaggtgtaatttagtgctgttaccattgcttaagctctgataccgtgtctactccctggaagaatatgtttgtgttcttacatttttaatagtgaatatgctattaatgttaacactagtggcatccttgaggcctgggaagtacatgcccaattatataagacagtatcacatgaatggctggcaagtctgtactgaaatgctgactaacatgaggccttctgtaagttctggtggttttccagtaataacaaaactttgcttccttaccatctgaacctcccacatcttagtgcttattaggtctggatgttgtgctgggtggggctctgtaacttctcccaagagctctgaaggcaaggtatttgtctgcaggtaaagaggccgaaggttcccgcagtgctggcctcggaagtgggtgtttcaggtctctgtgtgtgtgtgtgtgtgtgtgtgtgtgtgtgtttccagcacttgctctccttccttcccctccctcttctccttctctatcttgttttttccttctcagttactttattaaaattgtctccctggaggtatttaaagttgatgcagatctggttttctgccatttttagccaactgcatagatgagattaaaaaaaaaaaagaattcaattaattggttttgaagatgcggtcttaaaaaataaaacaaaaacagaaaataacgactatgctgatgaggatgtgggaaaaggcaagccctgctgtggtttatggtgttttgaaatggctgcatggctgagctaccatggaaagttctatggcagttcctcaaagcataaaagatagaagtacacgtgacccagccatgccacccctggttagacggcccacccatgttctcagcaacattatttatgattgctaagactcgaaagaaacctcaatatttactgataagtgaacggagaaatagaatactctctacacacaaatcagaatgtgtttattttgcttttaaaagaaggaaattggggttggggagttgccccagttagtaaagagcttgccatgcatgcatgaggacatggtttagaccctcagcacccacataaaagatctgggtgttagtggcctgggtagctgctgagggcggtgggtgggtcagtggcctgctatgctcacgagtcttgtatgtattggtgaccctggttacctgaagcccatggtctgagctgctgcctaaaggcatgttaatgtacatgggtgctggagagctggcccaccccttctacaggtgagctggccccactcaggctactgcctggctcacctctgccaatggcttctggtgtagatatatgtggagaaagactaatcctctggggcaggtgttggggagtgatggccgtgtgtgtgtgtgtgtgtgtgtgtgtgtgctgctatagatgcctgggagaaaaataaccccaaacataagagggtgttttgttcttagttcctcagagtctcgtaatttccacattacctatgctgaatacaattggaacagacgcttagaaatggctttgctgaaaagcaatgactccactcgagtccacaagtacctaaaccgaggacagacacttgacacctgcacctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgttttataattatagttatcctagcacatttaacagattgctgggataagacaggaacagtaggaagtcattgaaactgaatttaattgtcagtgtgatagttggccctgattgacaacttggcaagatttagagtcacctaggaagcccctctggttgtgtctatctcggtgtttctgtaggggaataatgagggtgggaagccacccttcaaaggctgacaccttccacagttggtccagatataaagaggtcttaggaggaggcagtgtgtgcctactttcgccattgctttctgaaggtggtgtctgtcaccactcctgccaacctttgctgatctggtactggactccagcttcggtggccgccattgtggaaagggcggtacttggtcctttctagagtagacacttgttctggatatacatttgccttctttgtgttatcgcttctgtcaaagttaccgttcatggatttggagaatcaagcttttccatgaagcatttgctggccaaggaactcgcttcacagtcaaagagctgtattagtggacttgtgcccatggaattcactggtcttaaccatgacccccatcttcctgaagcatctggcctggtagaatagtggcatgcccttttgaagattagttgcaatgctaatcagagagcactaccttaacagggctggaccaaggctttccaaaaggctctatgtactcttattcagcatctaatatacggtacccaggaagaagggagtagaaatggagatgataccacttggcaacaccccattggcctcccagccagcatcagaccctgcttctgcaaccttctgacaagggctaaatgggagctgccaggctttcagtaccatattgggatttatgaggctatctactttggggactgagcagctagtgtgttccctcctctgcacttccagggtgtcattgtcagacatcttggttcctatcttataagacagtccaattaatgtgctgtagagtatgttggggttttgtttattttgagacagggtattaatacataaccctggctggtctagaactcactttgtagaccaggctggcctcaaactcatagagatcccactggctctgcctctccagtgctggaattaaaggcgtgccacccccaccccctctaggatgtatgtgttcatctagagaaccctgtctttggaatctgcatcctcatcttgttcagttcagagtgagttggtttctctcggaacctgacttccctgaaagctgttatcatggggtaattcccctctgagtgtgcttagcagcagctttcccagctagagggcaaaagcaaactgcagacacacccatggctcaccctcacacaggcaagcacaagccaaggttaccagtaaaactggaaaccaaaaggtatctggttgaagttatctggtcttgtcaaatgaaggctctgcaacttaacacactttaccttttggcttatcatactgaatattaggggttccatccatctgtgtgtaggaatgttcattgagatagcactgagaaggcccttggggttactcccagcattgacaagggttgggccctgtggattgcactgctttaaatgggtcttcactttcttcttatccacaggtatttgaactatcattgtgcaaagtgccagcaactaagtaccgagcagactgcacacactatagtaaagatgggtccttagactttatttcctctccacagcttatatatctgggcagaatctgtaatataaaaattacaatgtgattacattctatttttctttgagtgaataattacaataagtatacagaaaacaaaacaaaacaaaacccagcatattcctggtaaccttacacgattaaacgttacttattccacgtgaaaaacaaattattcccagggccccatgtgcattcatgttttaaataacttgttataaattaacagagtgtaagtaagcaaggtagttttttttttttctcatccagggcttttactggcaggctgcaatttgtagttaaaaagaaaggatcaccgggcagtggtggcacacgcctttaatcccagcccttgggaggcagaggcaggcagatttctgagtttgaggccagcctggtctacaaagtgagttccaggacagccagggctacacagagaaaccctgtctcaaaaaaaaaaaaaaaaaaaaaaaaaaaaaaaaaaaaaatcaaccaggtaatcttacaaacaaccttagaagaatcccaaatctaaacttgtagacaaccatcagtcagtttcactgtgactcctcagggtgcacatctcctcattaacagtttcttattaagtcatatcaggaagctgagggcaaacaagggtacaagcgatgaatcatcaccttgatcggtaagtagcccagttttaagaagagaagcatgtccattggtgctagttcggctgccgttgttcttgttccttgaccccaaaaacatccccggctgaactatatctatcaagagtgtgcctttctgaacttcaaatggttctccaagactttcagtgtgaaagccacgaacaaaaacatcttaacctacctttactaacaacaatctacatttctaaattcttttttgagggtggtggttaaaccaacattctgctccagcagcaatgcttgaaaaagatcagtcactaatattgtaagagccaatgacaccatccagtgagagctggaacccgccccctccccccttagagatttcacactgctcatagattatgagggatgagcagatcaaagctccacggtagtgtcctcagaacaagtagttctggccactctgcctctcccaggtgcacctatcatggtggggtgtgggatatttggtggcctgagccagtgtatggctctgagaaattattccatgcaacagatctggtataaaagggggttttggaggggtggctttgggaaggaggggagatgagtgaggacctggagaaggggtagagacatcagcagagccataaaggccaaaagagagggcagagagtaagagagaggcgagaactgagaaagggagagaaagaatgccaggaacagagggagctgagatgacatgtgggtccctttacaaacctggctcatttggtggccgcaggtcatgatgtcaacagctgctaggtctctgagggcaggccaatggaattgcctgtacactgacaacctgggccctgtctggcaatcctttagaatatacattgtattgtaggacagctctggaatcctgtcttgtactatactctttgtgtgctttgtttttcctcctaacagctttcaaattcatttggaaagacagtttgctaaaatgtcagtatcgcccgtagataaactcaagtcctgttacactaattgttctcgtcagacgcagtctgagatggatgtagtcacctgaagtgtccaggctttttaccatgatttggagagactgtagagaagaagtgtccattgataattagccctgtgctgatgctaaatggagctgctgtgttctgagccgcccttctgtatagctcaacttttgaaactgggcttcatggatttggaaactgatgaagttaattttaggcagagtccagcaagatccatgacacttgggccaagagccaggttttgctctataacctccactccatatcatcatgcatttattgctataagactttgttttaggtcagtaacattattcatactatttatagttaaagaactcgaggctcagagttaacatcttaatcgtaggtcattgaaagatataccactcactaaacaaaaaaccatatggttcgcaaagcacattcctccttgttcctcccaggcatgtctgtcctatacacatgggggatgattagcttcactgaacccagcccactaaactctcatggggatactactggctgtgccccctaggaatgccccgcagagtccccatggcttctcttagaaagtcatgtttaccttgcttaatttcaaagctcaaagtcctatcagctcccactcccactgccttcagcagcaattctttaaacagcagtaatcaaaccccactgttctcctaatttgaaagagaataattgtaaatgcagatcattttaatcctgaatcctcaatgaggtagcttcttacccagctcttttaatggaaccccccaagactctgagcaaaggtaaaacccagattggcagaggtctgatgactcagcacgtacctctgagctggaggcttggacaccctccaatggcccaattgcttcaagcatctctttttgatctgcgtttgttttctaaagagtaattttgatcttccagaaggagacatctgggtttcttatcattgctaaggtgaacgtgggccctgataccctccttgtcagccctgtttggccccggtcctcagtagtccacttaaagatacagtaagggtaactggttgactgtgactacagtggcaagaggaataatgaggtctctgccccattccctccaaggccatctttagggtccttgcctgaggcttaggttcaaatcgggagctttcctaagtagcccaggtcaaggaatgctttggcccatgcccactgtatgagcaccattcccttctgcaaggcagtcggctaagttgtcagagctatgtgacatctctctccctgctccgcttagcatcagggcctcagcattcttcttattttcaaatgagattcgaggagagatctcagtttcttggggtccattggttcagtagtttggtatcccaaagggaggcacaggtgtctcttattcctgtcagggcagttacttggttaccacactgaatagcacattggtggctcttttagaaaatgttagttggttttcaaactggatacttacatgagatttgtttttgtttttgttttccactatgcaagtatttgagaattaagcttcctcatgatttaggtggattaaaagtccaattaattatcttacataacctaatctcaaaggttcctagagttgtgtgtgaagaccagaacatcatctgagactgcacttgctgctgagttggttaaattcctcctgtgtgggagctatagctgtggggtgcatagaggaattggtataccctttgccagttctttagtcttggtatcgtttctatatcttcggtgggagataagtttaagtgattacttgcttgtgttaaattcacaggggcaactggatataatggtttgaatgaaaatggcttcctaggaagttgcacaataggaggtgtggccttgctgaaggaagtgttgtcacaagaggtgggctttgaggtttccagtgctcaggtgaggtccagtgtcactctttcttcttactgccaaggattcagatgtagaactctcagctacctctccagcatcatgtctgcctgcatgctgccatgcttctctccttgatgacaatggactgaacctctgaacctgtaagccagctccaagaactgtttcccttataagagtttctgtggtcctggtgtctcttcacagcaataaaactgttaggaggttttctttaccctgcgtcttctaagggaccaaggttattgcttctttagccacacacacttctgaccttgtggtaaatgagtaaatgaagtattcttgggtccaaggatagttaactcagtcactgaatgcctcccagcatgcaccaggccctgggttcaatccttaattcctcctgggtagttcctccaccttcagattctgcttgctgatgagggcctctctgactctgccaccctgacctactggatagacatttatttttagactgaggtgcatccagtgaaaagaactcaggagcccagctaaatgaatcgttttttctctaggacattaatttcatggttgttttgagcattggcgattcatagtgtctattagccaaggctcagagactctttgaagtaaagaaatcaaggtgactacagctgagggatggatttcagtggcaagtgattgacatctggaaacttagagatgcggaagaagagggaagctctgtgatgaaagcggtttctgcaaatatttaggaggaacatgaaacccttagttccccaaacctaagagtcaagttatgggggcagtttatctatgcatgaaccttcaaattgtttgattgaataagttgctcatagaaaagttaaatttaaattacattcttttataaattagaccaatccctgttttaaatctcaggattctcactacttgtagaaatctttgattttgctgtataagtccttaaataaatacatttttatgtggatcacattgacttacatcagacttttggattgggtatttcagttgatgcatttttctgacctagaaaatgaataatactgctacctcctactcctgtctgtgtgaagaaggatcgtataggcccagttccctctctgtgcctgtaatatcgcttttataagacttaccaaggtataggcagagaatcacaaattcatattttgagaagcttaaaatttggcaggatctgaaagtgtttgcctgtaggaggcacagcttaggatatgaattggaaaaaccagggttgtcgttcatgcaggcctgctttcttcaatggaaggagatgagtggcaccctctcaccatgaagcaggccacgagtgaaggttgtctggcacctttgctgctcttgggttaggagccaactgaggattagtccctaattctgggctttgtctctcagtgatgagagcgcatccctgtgatgctttgcacgctccactgatagaatctgtccttgtgcttatcactgctcctcctctaggtcccaggcctgagctctgcctatcagccagtagaactctttcttaaagaaaaagtcacagatgcttcgagaccttgctagggagtttctgagtaggtatgcccaaagctttgttgtgaagattgtcgcgtggaaaccatttccacatggacagttttactgtgattaaatgtgtgaagagaataaactacaaggtgagtctnnnnnnnnnnnnnnnnnnnnnnnnnnacatttcctgtaagtctcttctttgctaccttagatatgtagtcatttaatgtatcagatagaaattttgccctttctttattatgagttctagctaactttttattatatagaactgactgtattttagctgtcatttacgacatcataacatttgtttgcacattatcttccctttgtgcattgcagtttggattctaagcacccacatcaggaattcaggtttagtgagaattgctatctccaaaaggaaggtagagaccagtaggggaaggcgcttgacataaacctctggcttgtggaaatacacacacacacacacacacacacacacacacacacacacacacacacttttatctctagaaactgagaactgttggttattcaaacaaacaaactaactaactaacagcattagcagtgtgtgcactcgaatacagctctgcaattggtgcagagtggacttcagtgttacccatggatgtatgtaggctgaagaatgtagtttaattatttatgttagtggcatttgtttgttaccatcctctcactccagcagaattacaggatctggctttcagatagcataggccactcatttataatctgatggattatagttgaccacttgataaaaactataacaaatacttttctagatgttacaataaagtatattttaaaatggaccatgtagtttgaataaaaatggcccccataggctcatatatttgagtgcttggtcaccagagagtggacctatttgaaagaattacaagtattagaaggtgtggccttgttggaggaggtgtggccttgttggagtgagtttcaaaagcccatgccaggcctctgcttacatgctgatgagattgtaggtgtcagtcacttcttgagcaccacacctgcctgttgcaatgttctctgccttggtgacaatgactaagcctctgaaacttataaacaagcccctcatcaaatgccttctttttatgagttgccttggtcctgatatttaaatgacatgttaaacgaaatttaataaagatataaatgactgtgacacacagagaaagatttccttactgtggtcaagttggaaagagaaacaaataaaggggtccagtaaccctgagtcttaggagtaccaacgtgcgctctggtcttaagtggaggaagaagtggagcccagggtaacggggatgcataaacaaacaggtctggtcaggatgtggtctggtaactctctgagctctggttctgcaaggtggtgtaaagatgtgctgctgtctttgtatgaaaggaccagtctgttatctacaaggtgaccagtcctgctccagagccaggcctggatggggcctccctgtcagggataattgctcttctctggagtaaggaggtgtctgtcattcaaggctctgctatccaggatcccagaggactcaaggaaaggttaaggactaggatggcctgtctctagcttttcagccaaagtaaagaagacaccaggcacacaattgaggtgcaggtgtcaagtgtctgtcctcggtttaggtacttgtggactcgagtggagtcattgcttttcagcaaagccatttctaagcgtctgttccaattgtattcagcataggtaatgtggaaattacgagactctgaggaactaagaacaaaacaccctcttatgtttggggttatttttctcccaggcatctctagcagacaacatttatttgtagctctgtggaaagaatcactgagaacccttatccgtgaagtagtagacagccttccctagtcagacaacccagtggttgctctactctgcatctagtacatcattcaatggatgcccaagtctctctggcccatttttaaggcttaggcaattgttcctgacatcagttaaaaatgtttttgaataatttcattcattgactagttatagatttagggtctgatctagctgctcttttcattttgattgaagcctgtccaagaagcatgtcttggatagataggtaggattccattgtcttgtattgtgaccgtgccctttaccccccaaagcagagtacagaaagggctgtaactaaggctgagcaccactgttctgactgagagatttctgctaataaccagataaggttttaggaacttactagtttgtttaaggggggcgggcactgaggatactatagtttaagagtgaaaaaaattaaatactatgaaaagttctaatttatctacaaataactaaaatgaggtggtctctgaactgagtcattttaagaattggtatagacaaattgtctagttgtaattatgaagttagcaggacgagaatattaccatgtggcagcctcagagtagagaatgttttccagttgtagaaacgctgttagtgtccctttgtttggcaagaggatttaaataccagagcctggccctatggagactgtaagtcaacagaattttaagcccttcacagcaggcttcgttttcgttttataagtgagtaatctgactcacaaaggagagacactgaaaacaagagagctgcatttctttaaaagctggatctaagcaatgcagggtgcttcttccagttagtctaaaagacaacttaagctagtgtggggataggaagtctttccataaaaatccaacctcatgaactctgtgtatcttgggtattttcttggttgcaaaagacatcttgtgctttacctcaagaaagattaggatgtaggatgtagatctcccaggccaggaacagtctggggccagttaatttctgtgtgcccttggctcatgacattaactgttcctcctgacctttcaccatgcccctagcttctctagacttgcttgtttttggttcttgaggcagagtctcattggcggaacctatcatttacgtaataaatacaaaccacagctcttggccagttcataaatgactcttttcaagcctagcgtctttctgggttcagtcagccgtgtctgcgcgtggggttgtaccaagcagtgcagaaatggcagttgagagacatctgggcctgagggtagagcagaactgcccagcaggagttaaggagtagatgaaaacatatcctgtgtgctacttgaggaagttggttgattttggtttaaaacattttcctaatctgccttggaactgaacttttacataacacacacacacacttctatggggtgggacttgaggaaagggcaatgcccgggactgaagctgtaaacatgttctctggccctgagataatcttctcagccattgaatttaacattgtctgggacgcactggaagtgttagttgatcttatgttctcatttgtttgctatttttgcctctttaaggaacatagttttgtggtgtgtgtcattggcacagtttgttatggtagcttggtttgataattcatgtggaattttcttttgaagatatttcttcaaagtatttcaaaagtactttaaattaccaggtcctcattgttctttttaatttccggcaagtacctattcttttccacatcttaaaagaactcagcttcaaaaaggctaggctcttaggtttgcttctaaaactgttattaagttgttggactgtatacgggctatttggatatgatataatctgtgttcatgggactttctgacaagagagatagtgtcactaattataaaggaaggatgcctgggctataagagataagagtcagtgtacagaatcaaaagaattaaatgttttaaaccttattttggtaaagaactataaaataatagacatcaatattcagatatgaatatgaagatatgtaattacctaaatttaaaacttacatgatgcacatataatagtttggttaaaagtaattaagaccaaatatgattaggtaggtaatttctctatcactgtgagttatttccctcatttttgatagaccagaaaaaagagagacgttgttacagggacctgaaagaacagtcacataacaatacatgttttgaaatgcaggtagtttctccagtgaactgagaaacttggtttggtttagtatagcttggtagccaagagccgctggtaggcatgcaccaggtgctgaccagagtccgttgcattttaagcacagatgcaatgtgactcttgcccacaagaaactcggattcagtacatgcaagaaaggcaatttgtgtactcctatgggtagagatttaaaagcaattcaacctgcttccatcaaactagaggcgtggcttgttgctgaggtcattccagcaagaagtggtgctgacacttcacctcagcttgtaagtgtctcagtgaaagctgtaggaaccagaggcaaactcagcctccacagggtaacacaggggttgaggtttctctttctggaaagaccagtgttgataagcgaacccctttgagactgtgaacagaagttccaggaaaaaagcccagcacatgttaaagattctacgaggccagttgaattttgcagttctcgggccaaattatgttggactcttagtagttgggtcaaacttacgtgtttatcaggcaaatccttttgtaatacagtgacagacttcattgtgatttcctttcatttaattgtactgcaactactctaaagcatggtatttggggttgcctgatttcatcttcctgggtgatggtcattcatattgggtcctggaacatgagaactgtattttctttgttcaagaagatcctgttcattgtcccagatgtagtagttcccatcagtgaaccacaggagtatttgaccccttaggcctagctcgtgggtccggatgaggcccatgacagaggacagttgtgtttgctgatgtccacttacctcagtggtgtcagctgtcatctctgtgtaactctacccttagcccagggaaatgatgacgtgcctgtctttcctggaacttggtcacttcgcggggtcacaccccaaactgcattgctggcaggcgcttgtcaattctgtgtcattcagtagcgcttatttcaccctttcatggaacatagttgcttttactctttcctttagcttgcagtctttctctcttctctctggaatacagaccctgccccacccccaccactggccccaaatcctcttcttcctctcactttagcagattatagtttctataactctgtcttcctcctaggacacctctgctcacaaagccctctctctagtcagctcttcttcactgaggagtaaaaggaagggggagcctgtgtcagacaagctgagaagggctgagccaccagagctcttgaggaagttttttagcttcttttccaacccagcgcagtccctcagagaagagcacacattctgttccccaggagaagcctggaactctgggaattctgacaatttcaggaatttcagggaagcttgggagcgtacatccagttcacccatttggtttcttggttagtctctcacagccaaggccatgcaccgaagctgagatgtaaggactccctaaggacactggaaagctctccctgtgaagtgggctgacaccagctctaggtgctggcaacagaaagcctttgaatggggctagcacagtggttctcaacctgtgggtcttgacccatttgggggggagggtgtcacatatcagatatcctgcatatcagttatttacattatagttaataactgtagaaaaactacagttatgaagtaacaatgaaaataagttttatgcttgggggtcaccagaacttgaagaagtatactaaagggtggtagcaataggaaggttgagaaccactgttctagagagagactatactttttagcccctagagtcagatattatgcctctgacacatttcagcacgttataagagatagcagggatgtagaggctgttcttcaaagcctcttcactctttaaagccaaattcttagatttccaataatctattgtttgtaagaaagccttttcagggttgttgttgttgttctaataaaatgtagtcttagtgagaaaatgtatctaaattgctcttatgccattactggtctttctatattattcatgtttaattatatatcatctccctccaggaacaaataactgaactatgatcggcttgtatcgggcttcaaaagcaaagcacgctgctgcagcttccacaccatgtgtgcttggtgcagagttgtgacacagtggtcctcactgtctctcagggccgcttctgagcagcactgtctgtcaacagctggccaaaggctagtgaatcagattgccactttgcaaaaacaaacaaacaaacaaacaaataactcccaaaacccagtaaacaaaaaacaatgtggcattcctgatgaaagagatttgaaagggctggccctacaaatgtagacagggagattgtacagcctttaagaatggctgtaccaggttctgaggaataggagacacccccgggcccacaacatttttctgcctgtcactgggtttgtgtctagaccagtttctaccttactttttttttttttttttttttttttttttggtttttcgagacagggtttctctgtgcagtcctagctgtcctggaactcactctgtagaccaggctggcctttgcttcccaagtgctaggatcaaaggcatgcgccaccacacccggctttctaccttacttttaaaaaatgtattttctttgaattataattatattttcccttttctttcttcctttcttccaacccctctcatgggatctccccatcaatgctcaccctcaagttcatggtctctttttcttcagttgcttacatgcctgtgcgcacgcatgcacgcacgcacgcatgcacacacgcccctgatcattctgtgtaatgtcatttgtttgtgatctcaggtctgaccacttggtgctggatgaccacttatggggctgcccctcgggaagaccttttctcctgctctgtgctgttgccagttgactgtattttatttttctagggttgaggcctcatgagcctttcccctccctgttggtctattggtgtcattgttgtttaggtcttgtttaatttccctttttaattggatcccaattaaatgtttaaagtcctagttgcaaggataagtggggatttccactctgtagacattcgtccacacttgtctgttagttaccatgcttgtctagttccagaaaggtcttgtgtcttcacagagcacctccactgcaaaagtaagcctgtggctttgactgtgctttctctatgctgagtaccaccatccaaggaagctccccagggtgcacgcactgccctccctcacagttcagcttctgccctcacagttctgttcctttacaaggagtgtttccaagcctccttttcctttctgccctcaagctcctggctaacaagacccttgttaccattgcatagaaggaagggatgctaaatgccttcttaagatcagagtccaaataacgtggaactgggaaatgtcctgggacagactcaggggatgggactcgaggctagcacatcatggccagcgttatagcccaagtggtccagcacacttgacttgggatgctttttctctctggtgtgacagtggagaagttatgcagcctctgagctgtctactgtctactacactgacgaggttgaggtttctaggctccttccagcatcccacccagttcttgcagggattgaatgtaagggcatgtcgtgtggcagaatacaatggagttgaggtacaattttatatttatcatcagggatgcaggaagacctttaaaaactcctatcttagctggccgtggtggtgcacacctttaatcccagcactcgggaggcagagacaggcggatttctgagttcgaggccagcctggtctacaaaatgagttccaggacagccagggctatacagagaaacccagtcttgaaaaactaaaaaaacaaaacaacaacaacaaaagaaaacaaaaacaaaaaaccaaaaaaaccctcctatcttggctactgtacaaactgtctttaacaagtagctactacttttttctcaaatggtataattgaaacttcccttttttgaactatgttcctgttttgaccccattttttgaaattacttattatcaaaaggaaatattgacagaggcttggcatgttgttctctgggtagctggtggcatttgtgtccatcagcagctacctgtgagggacaccgtgatcttctggtgtctctcgttgcagagagtaagaaggccacttagcaggtttctgaagtacaggttgggattcgaaaggtttctcttgagggctcttctctggggtatagattggtaagggcctgctctccggacatgaccattgggtaatttgtaagtgtggattctgaatgatgtgtcttctgattttagtgacttctgggcaggaacagcacatcagaccctagatcccattccacaacttctttcctgtgaacactctcctttgtttatagcacctgtggcactgctgtgggactcttggtttctgtggctgggaggggactgaagccagacctttgctctgggacttggcagactgtgtggggtagtgcattaggaacttggtctaacttccaccacttactggtgaggttatctttactttattgagttgtctgtatacctgtagagagaaaacggaactccctttggcagtctccttccttccttcttcctctttctctgcctgttatcttcatagagtctggcttggtaattggaagacccattccctacttgtctgtcaggaacaacttccctgacctgaagtctctggagactttgccactgacaacccattagccaaagtgctttcatcaccagcatggcggtgtcttcctgaatagtattagctatcagccaactaccatttcctttttgtggccttaaaatgttttattttgatccagttctaaggattctcagcctcccggaataacaatgatcccaagtaactttgcctccaggcaggaccaatgtgtggggttacagttaggtttgtttggtttcctatttttgtgtatgagagtaattcacgtgtatattaattttaaaatgtggtttatttaatgtatttattttgagacagggtctcagtttgtgagtcaggttggtcttgaactcactgttacccgagctgacctcagacttaacagttctcctacttaatttcctgagtgttggattaaagcatgatcccctgtgcctgcctgccatgttgtttttgttgttgttgttttttaaaaaaaaaagatttcattttcttttctatatggtacattgattcacatgcatgtgttttgtgtcattattcacacatacatgatgaaaggctcatgttttatttagttgagacaatctttgacgaaatgggatgaagcctttttgtcagtggattcatggctctgtgcaggatttttgatcacacacctctgtgtgctccttgcttatctcattcagctgctcttgattatattgtaattaaaaggaagagacaaacatcttgctgcccttttctgccagagttctaatcattatgggttaaaaactgtactgttcccctggatctgtttctatagtaagctagcagttaatctgaatcaaggggggatacgccattaaggtacaggattgggaatccgaggatgaacccttaggtggtcctggtgcacagcctttcctagctccaggcataggcttgctctgcctgttgtccaatcacaggtttatgtctgcatcaggataaccaaggtgaagctggcagggaggcaagaaaatctatttctcaatggacagacaacaaagggagtaatggactgtttattatgagggttagtaatgaccaatggacagatagtaagggttataatggtcttatctctttaaattattataagcagctcattatgtgaaggtttaattatgcactttatatgttctaattttctcctagaccggaagaaagactgatgaagaaaagtaacagcatgattgaggtaaatggacgtttaattcttttatgctctagtgtttattttctgtcttcagagaaatctaaagtaatgatcatggtcaacttgcatatataaaggttgcagagattcagcagtaaacacatcccacttaattaatttagctgtgggtgtatattgaacatgcacttacttattcaaaatataaatattacttttgtctagcccagagtaattttcttccaagtatttagtggcatgaattacatcatacttttcattgtaagagttgtgtttcagagtgttggctgcacttctcacagcatggtatagtaggttagctgtttgccacccagactttttggactttttgtatggtgctggcacctgaaacttgagtccagactgctaatgtccgtttgtgtactgtcaggacagttgttggcgttattcttcaagataagcattgaggactgccattgggaacagtttctattactgcttttgggagctcaatattttttctcttgtttccgtgctcattttatttttcaagcagtggcatatacattggtgtcttagggtcactgtgctctgccggaactccatcactaaagtgacttggtgaggagtgggtttatatcagcgtatacttacatatcactgttcatagtctagggaagtcaggacaggacctcaaataggacaggactctggaggcaagatctgatgcttaggccgtggagaggtgatgctttcttgcttgcactccatggcttgttcagcctgctttcttatagaacccaggatcaccagcctagagctggccccacccacagtgagctgacccctctctcatccctcaggaattaagagcatattttacaggcttacctagagtctgatcttaggaaggcattttcttatttaaggttccttcctctgaggtcacgttaccttctgttaagttgatataaaactatccaggacaattggttagtagcttcccatggcccctttgactcagggtagacactttcagctcttttggttgtatttcctggaatttgtgtatctctctgtttcaaaacatagaaaatgctttaagtgtcactttagtgctttctttaaagacattagatttctgtcctgcttcctgttgagtgaagatttaaagatgacccatgactcttagggttcacttttccttcctgctgttcccaccccttctcttttccttctcttcttccaccaccttcttctacccttttcttttattaggggtggggagggactgtaggctgacgctggcctcaaactcaagagtccttcaacctcagcctctaggattattagatatataccattatgcccagatctccgtttgtcttaatgcaattatgttatagtgtgtgtatatgtatgcaaatatatatataatttaaagtctaatatgaccacacatagttttgactgagctcctgtgatgtttggtggtgtgttccagccatgctgaagttctgaagttcccggctgagccctgctctccactttccctctctcctttccctctgttttttttccctctctctcccccctccattccttcctccctccatctatccctcttcttctttggctttggagtttttcacttagccactaagtctggcaagtcttctgtggactcccatttccctcatgcatggttgtgagcaccatgcccctctgtctgccctttttgacttctcagagcctggtgattacatttagataatccagggtaacctcgctattccccttttgttgtgatttgaaaaaaatcaaccacatcatttacctgctattgatcatatttagtatgaggtaggtaatggcaatctacatcatgtttcataaaaggtctggagacttttttcatactttgtaaattgtaacttactgtagagtaacaggtctttctcttcccagcccctttctctttaagccttattaatggaatctgctgtttctttgagactgcttactttctaacaacctgaccgtgcatgcatgaagcagcacataatagattcttctttttaagggttgaatagtattccattgattatacaaccatgttttccttatccatttatttaggtagtggacatagagtatggtgacttctatttttggcaattattaaaatagccacagtgaatataggtatgcaaatatctcttcaaaatcctgttttcagtcctttcagatatgtcccataaatggaattactagaccatatgggagttttctgtttaatttttttaaaggagttgtctgtgtgttcttcatgccagttgtagcattttatatttctaagagtgtacaaggggtccagtttttccacaatcttgtctgaagtgagaatttnnnnnnnnnnnnnnnnnnnngtgtgggatatggagctgcttctgactgcccacagcagctatgatttgcctcatgttctagctggggtgtgcttttgacatttttttgtgagcgtgtgacatatgaattctgggaacttttcagggcatatatcaatgctagagacccgataaagggggctagctgctgattggatattgctggttgtggtttgttgcagtttgtcaagtaggcagatgcaaatagatgaaaagaaattagcctcatgttgaagagcaaacttgctccaaggaactcagggcccctaatgagcaggaagtactctaacaacattgtgtccccttcctctctagccttccttctctcctacctggtgttagggggttgaaagggaggagggagaagaagggtggagaaaggtggaagaaaaaggaacccacgaaacagcaaaaaggtcaggtgacacttgtcaccacttgttattgtctgggtttgttaatggctgttcttatgtgtgggaggccgcttctgcctgtgcttttgtctcgcttcacctgatgcttagtgatgttgaacatacattcatgtacagttgaccatttgcttatcagacgtctgtgcaagtgcactgtgctctgtctatttttggttatttggatttttcagtgttatatgctaagagatcttcacatttggctgtccatttctttcagatgtgtggtttgcaaatgcagtccatctttcactctgtttattgattccttgccatttaaccctggtatgctttgctttgttggctgggctcttggcatcatatccaagagctccattggcaaattgcttgccgtgaagtcttgtgcttgtattattctcttctaggaattttagtttcaattcttactttttacaactcaaatccattttgacttaatttttgtaaatggtagaaggtaagaatccagacattctgtagatttttaggctggctgctattttggaatcctgtcccttagtcctgatggaacccttgctggctgtacctcagctcctcaatctctattgtcactctgtcctaccagcacacacagcacaatgcccctggtgtcccttgtcttctgtgggaaggcttctggggttcctgactgtatggattgtcattatcatgatgcactattattttaaaggagacctggagaagaggggtcagctgtaatggccacctacaatctcaaagtatggctttgaaaagtcacatttgaaagtcttaaaagagctactccagaaataattttcaaatccatttttctctgttgattttatttacttattttgtaattcatcttgtggtgctgggaactgagccccaggaacttagccgtgcccagcaagtcctccgccctgcagctccatctcccagcctgtccgcttctttttggcacccctgacaggtgactggtgcactagtacccagagtaaacactagcagttttactctccaaatagtatttcattttcaaggtaagctgagacttttgtcatatgaagcaaggtgaggcttggtggaaatttgaatgtattatttccgtcttgttgagataaatccatggggctttggatttataggtcgtctgttgtttttattaagaggtggtatggtttatattacgtaaatgtagatctctgcattaacctgaagctttaaccgaatacttttacagtggcaagaggggtctagggtttaacatttttgtctcagtatagttagttgggacagctgcttttttgcacctctggttttagttattgcaggtggaacatgatttcttttctctttttctttctttcctttttcctttctttctttgtattgcctttgctgccctggaacttgttatgctcagcaagctggtcgtgaacttatagaaatctgcctgtctctttcccacaagtactgggagtaaaggtttgctccaccatgatgggccaaacgtgatctcttaaaagatgttacaactatccaaagtggagcatctttgtcctttgagctgtctcttctcagtacgcgtgggtgtgattgggcagttgagcgcacgcatgcctggcatctgtgatgctctagattccgtccctggcacccagaggggagggggagttaagcctgttgtcatgttcagtagactggttatttcagtgcaaggttcaggaatggcgtcttgataatttgtgattgaggcttagaatggccttgcgtttcaccatcggctttagatgaacctcaaaaagatttagagccttatggattataaaatgggagggaaagaggaagagagaagctgagtgtttagttacttttctgtagctctggctgtgcagaccgggactaaggcaacttataaaagaaagcatttgattgggggcttgcttacagtttgtggaaacatgtgtaggtaggcagccctgcctgctgaaacagtagctgagagcttacttttttcttctccttcttcaagttggagacagagatgggcctggcctgggcttttgaaacctcaaagttcacccctgtgacatagctccagcaaggccacacctcctaatccttcctaaagcagttctgccaactagggacctgacattgagtttgtgggagccattctcatttaaacttaccacaagggttaaggatttagtttttaatgaaggaaaatgaattatatgtgctttatgctaataaaaatgaaggaagtacaaaatcaaaaagctgagacacaagatgtgaggtgtgggggaggggctactgcagctctttttcaagttgtttaccctcataatgctgctactgttactgagccagcctcctgcacgtgtaaggttagggttagctttgggattttatgatgcagtttcaaagttagccttaaactgtctgtccctttggtctgagatcacctttgagttcataggagtgtaccatattgtctggcttggaaacttagtacctgacatgaccctggctgagaaaccagcacacatgtaaaagagccagttgctggatgtgaaaccgtagctgtcagaggtaacgagggagagcatggcctgagcctgccatgcctatctggatgaccctgagtcagagacaggtgctcagtgggcgtggagccagtcctttccacaggccagacagttgtttttcctggaatgtcactccttagctctgactcagcctctttgatggtccttccggttgcctgaggggacaaaaaggaaagcagcagtgataagcttgactctggccaggtgctcttgacagggaacttctgactggacacctcacaggcaacttctcttgggacagagcagatggtgttgaaccttggccagtgggtgccctccaaataggcttccattggcttttgtacttaacatgctcgtccctgaggctgcctcggacctggtggtaggtgtgttacctggactgtactccattgtctggaaatggtacggtgtgctgcctccttcttttgagattggattttaagacatctgtttaattcttgtggaactatacttttaaaatatgtgctactcctatttcaaacggtcttactttgtatcatattaggattaaatattaatactttcaccttttactattttcatcgctctgctgagattattgtcatgagaacttatttgaaatatactctgtttctgatgcaggctctgctgtggtggctgctgtcattctgaccttgtccagcgtaaagctagggaagcagatgctagagaggaaaggacgcggtattttctggaggtcttatgtagttcacaaaagtatctcagcagatgaagcctttttaatagaggtcacatgggactgcagctttcgcaaggccccagggtgacaccccagtactgtagaggtgaccaaatgggaacaaaccccaagccatccacccggacgccatgtgtggactcagtggctgtcggatctcgccggaggagttgtcctgaggcactcagacttgaatcttaggagcatgacatccgtactttgttgtctttgtttaaaatgaggggactcgtgattttaaaagtctttgtgcttaggcttcaggcatgttaaggagttagtagtggctatccatcctgacaaatactttaaccattttttccccttctacctccggtattgggaattgaacccaggcccctcttttatgccagtcgagtacctggtcacgaagccacatcttcggtcccactgataaatatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatatatctaataagagtgcggggggggggggggggagaagccaggcgtggtatgtactgtgtgcgcatgcgtttgtctacatatacgttctcgtgtgaagtagggagtccctgaagtggtgagtgagaagggaccatccagctatgggtgtggccgaggagctgagcctgcttacatttggggtaagggcattctagtcaaaaggtttaggaagtaccaagttcctgagacttcaaaggatgcatgcaagccaagctggcccaagcgtaaccatgccagaatctgcatgcttttcaagtcgttttaaaaggaattgttcttcattccagaaaggtttccagtacctgggaagtcttatacattataagtgatgaaaacttggctgtgttggctctcagaccaaagtaatggatagcagataggttagagtaagtgctgcccacatgtagataacaaaactgtaacattacaactgctatcactaggcttacgaggctaacagtatctcaggagccacttctgccttttcttttttaataagacctgttttccttcaaaagttctagtactcttgttttaaacatgaaactgtgatagttttatggaagttgacacaggctgcggcttgggaggatgtgtgcatgacagataaaacataggctgtttccctccatttggctcagcggccttctttggggttttgtgagctgagcctgcaagaaggcaattgacagaggtcttccggacccaaggctcccttggtgaggtcagtatgagttcctttgcccactcctatccttctgtcaggctggggagtaagtagctggtggctgattctccaaatacttgatattgtggtggtaatagtggtggtccagggatctctcccacccctgctggtgttggggagtgggggagggtagcctaaggggggtgatgtgcagggggtttcctccttcttggactgatgtgtgtgtgttgggcagggggtgaggggagattcagtctataaatgctgttttgctttcttggccaagatgaagaaaggatgtttagaaattaatcttggataaattggttgccagtgggtgccgttcatggtggtgtaagtgtggctctcatatttatccttagactcttgattgaagcactttgctgttaggggcctcccagcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcctgagaatgggcccagccatcttctttgcctttgaggcatgtggggcagttgggttccttgtgcacagcacccatgacactgctggggctatggtttggggtgtgacaggcttgagaaagtgtgcagtacacagttgcttaattctctgtgctatggacatggatatcactaaaaagtagctgagcaaaagtgttatctatcacacagcatagagactctagttgacgaaatactgctgataatttctggaaatggatttgaagtatttttaccacaacaaaagaaatatgaaggttaatgcttatgctgattagtttgatggtgtcagggtaggtacaggcttatcaaagtaccgtattacacaggataattatatgcgaattctacaactcatttaaaaaacaaaaacaaaaaagaaagggaacatgacttattttgactggagctaagaaacaggctgggtagagatagttactaaaacaagtttttcttaaaattattcagttcttcagaagttttaactgaatttgtacttttctagtattaatattacatgtgtgattatgagaggggaaaagaatcatgcattttctctaaatgtatttagcactttttgtttcccttgttgggggctgatcagaatgcctgaacactttgtcactgtgctattatccccagagccccccttttatatacctcaattaatcctttcttgtcttttactagactgagaatttcaattataatgtataattttttgttcatttctctagtgactatttttcttacctggaatacagcagaagtgtaaaaataccattgaatgaaagtacaagaacatctgggtctgtcttattctttcctttcatacgcctttcctcacacagtgttaaaattgtttaagttgttagtgataggacaggggggttgatggctcagtggatgataaactctgggtatgcatggagacctagctgcaattctagcgtttggaaggaggggcagaggatcgccaaagtaaactcaggtaagagtcttcatgtcagacacacacgcacacacgttggcaggttaaataaaattaaagacatgttgtttttaattcagattctatgaagattttaatgcaaacatccacagaccatgttcataggaagctcatgattcctcttcctttttgaagtaaactaatgaattactatcgctctagagatggaggatgttcctgatgggcatggtggctaacactgataattttggctcgggggaggctcgggaagtagtactataagtttgaggccagcctggactatgtagcaaggtattatgtcaataaaccaaaccaaaagccaacaagaaaaaccatccctttcaccctggagtttccatatgcccatagagagcatcagtgcccattcccttcataagccctttctgtcatggcccatgctaatgcaaatgggcacatatttggggcactggctcttccagaacttcatatatatatatgtgtgtgtgtgtgtgtgtgtgtgtgtgtgtgtgtgtgtgtgtgtgtgtagttgtgctgtcttctttaactgtacataacgcataacgatgcttttgaggttcacagttgtttgtgtttgccagtgtggttctttctggtattgagtaatatttcatttaatgagcttatctgtttgctattggtatacattaattagggtgggcttcactttgggactattatgaataccatgaacataattgcacacatctcattataaacatacgttttcctttctctgggctatatacttaaaaatgcttccttaaggcaaggtgtgactaggtaaggagttggcacacagtgtttggtaaggggttctatattgtcctcacagtaatgatacattgtagacttctgacaggaatgagggctgctctagctctagctcacctccacatcactggccctcttgctctcttatatgcgttggctgttgttcatgcatgttcatgcatgtatgccagacttcacagcacagtgacatgcttttgatatacagtaaaatggtcagatatttcctctccagtaagagtagtgagactggtcttccattttcacgtgcacatttcttacctccagactcctcatttttacagccgctctgttataacacttcatggagtgtttatctgctgaccacaagttgtctgttttcatttatttaaaagtgttgcttcttatttagtttcaagtgatgccttttttggttcatacataactctaactgactgtcctccaacacctttcattttctaaagctattttgaaattttgttgctactttggggcttcatttctaggcaaggtttttcttgtggttaattgagtttcctgctttaggttattgctgtttgggcttaactcgaaaaatttatggccatttttaacactgtttttcagccttatcatccgtatcttaccttaaaaagtgttttatcattaacaaaaatcaaatattttttcaaatgacaaagcatgggaaatggccaggtaatttttactggaaccaaccagagagcaggtggcctgcttttactgtgtgaatctgggaccaatttctgtcttcccctggccagatcacgctacaggcatcaaagcctcaaatgctatgcaagatctaactgctggttttaattacccacgttctggctaagcagagccagtgtgagcagcagagctttctagtgaatctgtgtctgcttgtctgtttgagacctgggcattcaacaaagatacctttctgtagatctgtcctcacaaccaggaatctgcttcattgcacagagaatgacatgggcacgaagagtaactaagttcatgccacagagatatatgacatgtgccttcaccttacctgggatgtttgagatccatttcttggaaaaagtgattggcagctagagaaggagttagggcatgggagaggaaaagctagggagagtcttgaaggcacaggagcagtggaagacaaatcagaactcatttgtttgactctgctcatgacaatctcctttccttatttactttgaagtattgggatgatttttgaccataaccatgcaggttaaatatataataagacagggtaacagcgtcatgggccacaaacagcatgtgttacagaaaatgtgatgatggcttttcatcaactaacactgaatgagtacatccttattacccccatcccaccccattcacccttctcctctcctctaccctgtcccacagccatgccgaactccctggaatctagcttaggggaatatgggtcctcgggcacttgttgccaactgaatgactatgttgtggatgtgccaggcttgccagggcagcctgtgtagcagcatcctgtctgtctgtcctgtctgttagccacaggtgtccttagagaggttgggagtcagcaaaccacagcctgtcgactgaatctggccaatacttgcttttgctaatttcattttagtgcagcataactgtgtccattgattttggatatactctgtagctattctcacactgtaatgtgtgaaagtcgggcattcgcagaaaatatcatatgctagaaaactcaaaacgcttgccatctggttctcatggatgatgatgctgttctgcccctggccttagcagaggccataccctcaaccttggatcactcctgttttgatcttgttccagctcttctgtctcatcagtttgtcctcctcatatccacaaatgagcatctttctgtcaccctgtcgtctagccctttctttcttctctcctttcctcatagttactgcaggtgacagcagtcagtattgggacggactcccttttttttttttaatttttatttatttattacgtattttcctcaattacatttccaatgctatcccaaaagtccctcataccctccccaccacttccctccccacccattcccattgttttggccctggcgttcccctgtactggggcatataaagtttgcgtgtccaatgggcctctctttccagtgatggccgactaggccatcttttgatacagggaccgactctcttaatgaggtcacatcacagtgcctttctgtcagcctgcctgccttccttccttccttccttccttccttccttccttccttccttcctctctctctctctctctctctctctctctctctctctctctctctctcaaatcccttttcacttaaattgtgaaaacttgaaagttttttgtttcttggttcagagaagccaagaggagaaaagcgcacactttggttgcagtagaagaagtacttaaagttgtgcctcaccactggggagggtgttctcactctacgcccctcagaacaccaggctccactgaagatgggcatcagtcctcatcagcccgagggctttggggaggatcgaggcagctgggtgttaatgtgtgtgtcatttgctgagttctgtacagccaagaacactggctgatgggttctttcacttatgtgtgtctgtgaaaaagtaaactttccttctgaattgattgtgcaaaaatggtgagttgtgagaattttttattgttctgaaaaaatgcttcaataacagaaagacactcttgcttaattttgtataaagaaagcataaagttcaaattgcatgaattcaagtatctttatagaaaacaataatactgaatgaatgattgccttttagaatgtatttttaaaactagaaatactgcattttgaggacaacagtagagaccaataatagatctagacgttgtaggcatttttattacccaggtggccaagctaggggtaggtttttgttactatttctttctatgacagagctgtcacatagaacattacaatacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgcctgcagctgcccttgttcctgttgcgtggggaacttcctggcagcctgggtcctgagcatgtgccatgacacttcacactgtgcatgccaccttacacaaatcatgaacccactgctaggtaacgtcccagggagttcagtgaaggtggtggaataggagatgtagcccacctgcatgttccttccctaggaaggagaccatgtgatcagttcataaaggtggaggaagcgagggcccccgcatcttgtcttaccacctgacaggtagtctgagcagggattgttacattttcttatgagctgtgtgagtgtgtgcatgcctgcgtgcatgcatgtgtgtgtgtgcctgtgtgtataatatatacatatatgttatacgcacacacacatatatatataaacttagacctctcctggtagtatagagagatttattttagatcagacctttgctatacatagagctttaccatttattaaagatgaaagcattatttgcatactaactgaaatgagtgtgcttgtttattttcacataaagaattaaatcttggctgaatattggatactacaagatgaaaacatcttcaatatttttcacagttgattgatattttgactttataatcatcagtgccgagaatgctactttgcataactgtgtagtacaaaatggcagtagtatgttttgggccattgcagaaattggaaattccactttaatcacaaggcaaaataggtggcttgttttagaatggtttacaggtaacagcttaagcagcagtttttaaaattaaacattctaactacactttaaagatgtgctaattctgaattatatgccaaggaaggatgttggctaaacattagcagtctttgctctccatcgttacaggattatgtttctgtaaggtctgagaactgcagtaaaagtactgcaatagatcgtggtcttctcacctctgagctaagacctttttggtggcgcttgttggcgtttgtgtggtgtggtggcatgcacaatgtgaagtgtcatggcgcatgctcaggacccaggctgccagcaagttccccacgcaacaggaacaagggcagctgcaggcacagaggcttccaggcgtcttcacacatttcatttttgaattacaatgagaaattcaagcggtggtaaagctgtggctacagaagaaggccactgcctccaccgggaggagaaacccttgcggagttttggtttatttcttcacaacgctagggaaaaggagaaagttgaaaggcttcatcaattgtcctgttgggaaggttccataacagcattgtaaactggtatgacccccatgtgtttggattgcagccttaccagccatatcattgcacagaaaggcaagctgctctttacttttaaatacagaagtatctaggactgaagacagtcctagtctgcattcctattagccttctgacacacatactggaaatatttttgctacctctgttggttgttggttgtcaaaagtttcagcgagctccgtttcctgatagcctgccaggctcctcgtgttccacgccaccatgttgctctggatccagacagcctccagatgtttgttgactgaatcagactttaggaatcagcatacattaaagatctaagcagtcttttgctggcgtgtttcctctggcagccctctttgggtttttttcccccctcacttaacatagggtaaagaaagagaatcaggtcattcaaaagaaaagcagcctattttaggcactgggtgttttatgtggtggtattttttttcccctcttaccacaaagcttggctttttagagacctggaggggcttcctactgtcctgaaaaggtaacgagaatttaatatcactgctgtcatgttctcatgtctaagctagcatttggtaggactcaatatgaagaggcctgggaaacaggaggtcagaactggactgcaaaatatccttggacagatcagttagtctttgggcgtgtgcactatgtccgtcaaatgcaaggctgggcctgcgtgagcatcttaggttttctacctttgtagagggtgtgactatgggatgacctttctgccttttgtttgtagccagttgacctgaagatgagagggggctgcttagtgacgtattttcagctgagcacatgctgctcgtgagtcaaaatttcctgagctcctttgtgagggtggtaggtacttgagattgtggagattaaggatggctatatctatatcatatttatatctatatttatatcaactatatatctgtataactccgtgtctctgtgtatgaatgtttggttttgagagtccatattaggaaaattgacatgaaactcttggtatctttattttaattgcgttcttaaagccactaagagaaagtctcagtttgccccatctctccagacacctgctttaaacagtgcttaggtacagtgagtgcattgtgtatagcatgttcttggctattctgttacggctaggtttgtcgaatagcttgtaaattggtaagaattctcgtgctgacctcgatggcccaagctttgtcatgctgaatagcttttgaaggccagccaagaagcctggtcaccagttagaaggtgattttatatccttgatatggccagcctaggaggaaaggctccctgagccttcctctctctcctcctcctctgccagaggccatgagaaggcatcatggacctgcttctcttcccttctgcattgatcatctagagccctgcggtcatcagtccagcactgtcattgcagatcaacatacctgccagtgatctcccggctgctgtagagcaggaatctgggcttgaattagctaagtgttaattaatcaggctgaagtcagggtgttagtgtggctgaggtgcagctcggggaaggatttgggttttgtgtgctcttgggccaagcaccttggtttcttcttgtcagcagaagttgccctcttgggctctcatttggtggcttacatcatggcagcctgactgttcttcataaccagcatccgagagaatcctgtggtagaatggatatagtcctctatagtataacatgcacattctgtaatttctgatatcctaccaattataagtcgactataggacttgcacatattcaagagaataagatacagagatcacagggctgctgtggagtctgccccacctgagcctgaccaggacctcattgctctttctgtcctctctgtgggctcttctacttcaccttccttcctgatgcagtgcctcccctcctcccctctttctcaccctcagagacttcaagttgcaggagaaggagagtgacgttctccttctcctgctccctgctttaagaatggtagctgcaaattgtatcttatatcttgggtatactaagttttgggctagtatccacttatcagtgagtacatattgtgtgagttcctttgtgattgggttacctcgctcaggatgatgccctccgggtccatccatttggctaggaatttcataaattcattctttttaatagctgagtagtactccattgtgtaaatgtaccacattttctgtatccattcctctgttgaggggcatctgggttctttccagcttctggctattataaataaggctgctatgaacatagtggagcatgtgtccttcataccggttgggacatcttctggatatatgcccaggagaggtattgctggatcctccggtagtactatgtccaattttctaaggaaccgccagactgatttccagagtggttgtacaagcctgcaatcccaccaacagtggaggagtgttcctctttctccacatcctcgccagcatctgctgtcatctgaatttttgatcttagccattctgactggtgtaagatacaatttgccaaatgcatgaaactctagaagaatgaagaccaaagtgtggacactgtgccccttcttagaattgggaacaaaacacccatggacggagttacagagacaaagtttggagctgcgacaaaaggatggaccatctagagactgccttatctagagatccaccccataatcagctttcaaacgctgacaccactgcatacactagcaagattttgctgaaaggacccagatatagctgtctcttgtgagactaggcaggggcctagcaaacacataagtggatgctcacagtcagctattggatggatcacagggcccccaatggaggaggtagagaaagtatcgaaggagctaaagagatctgcaaccctataggtggaacaacattatgaactaaccagtaccccggagctcttgactctagctgcatatgtatcaaaagatggcctagtcggccatcactggaaagagaggcccatcggacacacaaactttatatgccccagtacaggggaacgccagggccaaaaaaatgagaatgggtgggtagggaagtgggggggagggtatgggggacttttgggataacattgaaaatgtcattgaggaaaatacgtaataaataaaaaaaaagttggtaaaaaaaaaaaaaaaaaaaaagaatggtagctgcagtgaaaggaaaccggaggtcatcgaggagctgtgtgctgtagagtcctcctccctccctctaagggtgcccttctgaggctgggacatgatcatagtatgttttgtcttaaaaaggccttagtgggccctgtgctcttcatgccaacagcaggttctaaaactagatgacatttacggtgccatcatttcaggatttcttggggatgtatgctaacgagtttgtagcattagcacatttggtccttgaactctttggccctctgatctctgagtgttgctcttctcttgtcttcagtaagctgagggtgctcttgtttgcttttctagggccttcctttggcatgtgtcttgtcttcagctacttctcttagcattgaaatagcagtgtagtattgtgggtgagaacatggattgaagctgcctggctttgagccccaggcttgaccaggaactgagttatcttgagcaaatcattcagttttccttctgagtggatactggtaatattttctaacctccctccccacctcctcctcccatcatcttctaattgctgctgcttctgagacatatgtacagatgtcagacaggcagtttcccctttatcgctacgagcagctgtataccccaagccatttctgggtgacctggtaaagtggcctgcatcatttctgagctcctgcagatactaatttttgttgttatatggaccttatcctattacttgctctgtttgctaacactgaggataatttaacacttagggaacacttgttttccataggccttacttgagagcattaattatgtctttgtatctatagtatggcatctagctacagtactatcacccccattctattgatgaagaagtaaggtacgcagaaagtatacactgaactcaaggtctttcagggagtcgttggaaatctaattcttgtgcccacaaagcacaagctgtcagtgactcagaaaactgtttcccaggagaggccccagcttctcaaaggaagccagctccccaagaggaagaaatagggacctggagcaatcttaaccttaacctgttgctgtaagtttccccacctatctagctttaggttaaagtgtacattccacatggaatctactgggctataattataactcagtgctatgatgcttgtcgagtaactgcagtgcctgggtccagtgttcagcaccccccccccccacacacacacacacgaaatgtatttgttttaaccaggctttgcatatctgttgttgtttcagcattgtgtttgaagcatagttagggtatactaggcttgtactagcctcacaaggactcacacatttggatagtccttgttaagtgggtcagtggatcatctgacttccttgcttagttctgccggtccccgtattgtgctgtaatcagatgtgaacttcatccttgtcttagtagggtctttctctctctctctccctctctctctctctctctctctctctctctctctctctctctccttccctccttcctttctctctcctctctttgcagctgcctcttatcccacccagcacatgagctctgtgggagctagaattttaactatgcagttttcctttacatactcagcaccatgcttgccaagtagagggtactcagaaatatttagcatgaatcaaggtttctcttgatggaccactttctgtcttagagtctagcatgagttggttatctacactacttctgtcttcgttagggtttctattgctgtgaagagacaccttgaccacagcaattctttttttttttttctttttaacaataaagtcaatttattcaaacagttgacttaggcatctgcaatggtgatgtcaacctccactcctgggcaattcttataaaggaaaacatttaactggggctggcttacagttcagctcttgaatccattttcatcatagatggaaacatggctgcatgcaggcagtcatggtgttgcaggagagagttactgagagttctacatctgaatgcataggcagcaggaagagacattgagccactgggcctggcttgagcatgtgacacctcaaagcctactcccaatgacacacttcctccaacaaggccacaccacctaaaggtgccatacctgtgagtctgtggggtcattttcatgcaaaccaccacaatccttaaaagctcttccctgctcccagtgctggcagaatgaatcggtggtccattagttgctgacatcacttgtaatcatttggaacagctggcatattgccattcttgatcataattttaattctctcacctaatttattaaaatatctcttgcaatagtaaataaggtactttgcctcttgcatcaagggggactaagttcaaaggagacagatgtcctctgcacatggttcatggctgtaaaagcattgtaaaagcagagtgcatcatcgaaagagtggtaatttagaggcatcccagataccttctgtagataacaagttctgatacttctgctttaaagcaggcgtgggcttatccacactgccctcaccgaggctgtaacgtggtgctgagggaggccttggagatgagttaccaatcattttcagcatggccccacattctgcatgtggaacacactgcctctgttggaaatgagtcattttctccagtacacagaaggactcagtactgacccggcaccaacagccccttctgctggccgatgtcaggaaaggctgccaaagaaggcgggtaatctccgactccattatgataataatgtgtctcctagaaaatacgatgacagggaaggttcactcatgatacctcaaccggatgactgcctaaataagacctgaataggggtaacagcaatagacatgctaatgtgaaaaggggggtggatctcatgggcccctactgccagaaagagctacaaaggaataatgactgcctggagagggacaattcacctttcccctaatggttaaacaccaagtgctgtgccctgaaatcctgtgcatacaaactatagtaaacagactcaccaggttgtatttataactgatgactaaaggaaagaggccatgagtttgagaggaagtaggagtgtctgtatgggaggggttggaagggctgagggaagagggaaatattataattatagtttaatttttaaaaattgcaaacataatatatatttgaaaaataagtgataggaaagtttgtgttcctatgacctttttccaaagtgtttgcataaagaatctattaatttaatgtgttgcacactagttttgcctttataacaaggaagttaatagtttctgtcgtaatcatgctagtaacatgctagttgggattttcttttgaggacatactgtacaatgggtctgtacactcatctctaacgtctgtgactgctctgagctgtggccagccatataaagccatgagtagccaatgagtatgcttttccctgtgctgggacttcaatcttcccctgagcagaggtcctcccccaggtctattgctgttggccagttctttctgactaggggagcacctggattcatgtgtttcttcctcctcctccctaagtccacactgctcctcctcctggcttgcagagcttggagcttctgtcattccttcagtgactgtggcagcgccatatggatggaagcatgttagctttcttgtccttctctctgctctgagctaggaaagttaactgagggacctgtctgtcagtgtcatctaaccagagccacatgtgctccatataaagtggagaatgcttgcattctattgggggacaaatgggatgtttccatgatgtgatgttttcatgtgagaagaaaaaaacaaaagtcctattcctagtttgtgaccctacctgttacacaatttaaaaacggatatgaaatactgttctgagtgacttcctcttagaacaaacaaatgaacactgagcactttgctgagcacaatccattcttgggcgatcatgagcacatctccaggatttgatgatgaactcaatcttgggcaataaaggatttgtgattgctaagtgttgaatgtccctgttgccagggcaacacctttgttggatcaaaggatgctgaccatgccctttcgcttacttaactgtcactcccacacagaccacacagacagtaagggatatttaatgctcatttagaaatggagaaatggcggctgggggaggggaatccctgtggctagtaaaggggagacttttggaccattgcggttgtgttgtttttattgttacttgtgtggtacattcgatagagtttatttgtaaagaccatacaactaatgagattcttctacccggtaacaggtaatggagacctactggaacacgcggagaagctagtatcttgcaggaagccaagatgaggagagtctttttaaaataatccgtaagtaaaattttgctagttctttggcattcgtttaatgactgcatgaatcatgcttaagacgtcattttaaaaggacagtgcaatcacatgacttaagtgtgtgaacatgtctttaaaagtaggtattagggtgaaatgttggctcagtggtcgagagcactggctactcttccagaggactcagattcaattcccagcacccacagggcagttgtcacttgctgtaactccagctcccggggacctaagagtcttttctggtctctgcagtcactgcatgcacatagtgcatacatagatgtacaagcagctacaacacataaaatttaaaaaaagattaagacacatttaaagtaagtatctagaaacctcagagcaggattggaacagctgagaaggttggttaatgtgtgaaactttctttgtagaatatgtcatttttagttgagagcatcaggtctggtggacagaacaaaagtggaaagtggctggaggattccttgtgctaggtcagcagttaaagtagaaatggcccctggaaaacacagatggccttgctttcaggggtccctagagcccacttccttaggtagcttttgtgggcacagtagatgtaactaggagcagaattgctgaatgagtaaaatttgatccgtagcctgagactcttccctctccattgtgtgttactatccctggagagacgtgacacaagcttctacatccttagtaggaaaccaatgacagatcctacagaccaaagtaagaacgccacggaagtcacactttgtgaaccaaagcatttattggggttacttacagaagggtggctgagggcttacatatgggagcagggatgagtcaacggcagctacagctacatccctgaaagccaccgcagtgtggtccatggttctcaaaagatgggaccccagagttctctgcttgactctcaggcaacttaacaatagcctgggcctcctcaacagcccttgctgcctatataatcttgggagagggatggacctagggcatctggtccatttgcagaactcctagggacttctgagtggtttatttcccgagtctaaatgagcttctctctagaactttgagtcttaaagggcttcctttaccacctcagtcccagtgccttgggagcatgggcgtcacaccgtgctatcactgggaaccatggttagttatctgacggttacacttggcaggttttcagttcactgtgacaatggcactggagggcacgtggcagtggagacctcggatgatctagtcaggcatttctccacccacgtgctcttgtgctacgtcggctcattcatctgtgtggtggagctgaggatcgccacgggtacacagtaatacatgtgctctctgtgagtttacttggaattgtgatttacaatttataagcctttcaaaaacatggcccctctgtgaaaggatgctgctgataagttacgtaagtgtcagcgctgtggctctgccaggacggctgccagtgtctgtgggcttcttgcgtttagaaacacttctactgtggttgattttagccagtcccatagaagccaccaaaagtgggtttgaaagtgacatgcaccccattatatgcttttctgtgaatcagacacagtcccaaccagcaccaggagcccagctaatggtaaaatagtcaaggcataattaatttcaagtatttattatttttattttttacttattattatttgtttgtttgtttgtttttgtttttcgagacaggattcctctgtatagccctggctgtcctggaactaactttgtagaccaggctggcctcaaactaagaaatcctcctgcctctgcctcccgagtgctgggtgggattaaaggcgtgcgccaccacgcccgggtggtataattttttaaatgccaagtttacgtaatttttaaagaatttgttttactcttgcttatctgtctggatgtgtctgtgtttgtgcccatggaggccagaggagggcattggagtccctgaagctggaatgataggcaggtgtgagctgcccgcaggggatactaggaaccaagctcaggtttccggcaagagcactaagtgttgttctcctttgagccatctttccagcccaagctcctttactttcattattattgtggccaacttgccagtggtcttgagaaattaacagtctgctatgaggtgcaagctggctccaacacacccacatgggctgctgctgggaaggcatggcagagcccagttctgcagccctgtcttggctgtgctggtagcactttgctttggctggtgacagcaaggtttggtaaaatccattctcgtgaccacagggcttctggagtaggtcaaggctaagcctcattttgggctcaagcctctgttatcaggggtcccacgggcagttttgaatggtgaggtcagtttttggctgacccctggcatcccttgtgtcttctggctgctctgtgacaattcttggagacaggtcccagcagcttgctagctttctatttccttatccctcccccttctgtgacagctccaggctcaggtgggctgagcacctctggatactgcataaggttttgctcttgattcagaaattcagtgttaatggaacgtaaattgcttccagagagacaccacgttcaccttggctggattatgaaatctcatagggtgtcagatagaaacaggagcaggccaggatgggactgggcagcgtctcttctggaagcactttctttttcagtttctctcacttgccctttagaaaggaataattggagcctagaattgctaagtaaccgtggagattgtgctggttgtttttattctaagtctctgccacctagctttcaaaacacttgttattaagctgttaaaaaaaaaaaagaaagaaaaagaaaaaaagaaaaaacctggggtaacctgaatcagacttacataatcttaaaacattcatttctcttatttcctcttagaaggcatttacagtccacagtgaaccggggattagtgaattattccaaaatttattcttgtccatctcacgtggaagcttatggttaaaaccagagagagatcctggagtgtgaattaccacccagggcttcctcaggactgggggtctttgtaacagaaagaaatcacaggagttaacaataaagtgtttcacagatagaatagtcgatttgtttcattatctctcaggatagcccttctgtggtttctgagtagcccaagtatcagtgtaaagtggtgagatccgctatgctaggcgtgtgtactcttccgctgagttcctgttgcagctctctgagagtcagtagttttctgggtacccggtgacatgggttttgagggtaaattccaagacaaacaagacatgctaattccacttcaagaatcagccatgaggggctggtgagatggctcagtgggtaagagcacctgactgctcttctgaaggtctgaagttcaaatcccagcaaccacctggtggctcacaaccacccgtaatgagcctcttctggtgcgtctgaagacagctacagtgtacttacatataataaataaatctttttaaaaaaaaataaaaagaatcagcaatgagccgggcatggtgaagcacacctttaatcccagcactcgggaggcagtggcaggcggatttctgagttcgaggccagcctggtctacaaagtgagttttaggacagccagggctacatagagaaaccctgtctcataacccccccacccccaaaaaaaaatcagcaatgaagccttacccaagaaaacaaacatttcaatcggtagttgtaggtcttaatgtgcaaaccataaaggagagaagatcagtgagggttttcagcagcagcaaacatttggattgggcgtttgctactaattaatgtctctatctaaactatgggagttagcattactgatgggaaagaagtgtaaaactgtggaagttattaaatcaaaaactcatcagcttcgaagtactagttgaggcagccctgggaccttggtcagtcttggcatcacacgccaacgatggtgaggatggagggaggcaggatctggaagtttatatgatcagtacaaattctcacagaaatgtaggactactaattaaaataaggtgctctagtttgcttcttgagagagtgttccccccccccccagtagttgttaaccttctttggctatcaccagttcaaatgaggcatttagataaaatatggaggatcgatcaagaagagttttccttccttttcttctttaagcatatatataatatatataacattgccagtgtcaaggtattcctacctgtggggccaacctctgggaactcagaccgtaatgcatatgctacccacccatcaagaagtagacagtgtcctgcagtccacgacaactccagatcggtacgttgggaactgtcttgggatggctgccctttcctgtgcactggcctctgatttcaggtgccattgctttccgttaacctggtgaacggcctcttcctccgtgtgcactgcgatctcattcagtgtgtacaaggtgtaagtgtgtagtttttcacttagacaatttgtactgacttgctcgctcgcttgtgtacatgccttgtcttttaatttcactgatgacatgttaatttatatctgctgtcatataaattgttcaacgtacagttgcaaacaaagttaagcctttcattagtggattgtttcctttgatttctgtttttccctccggttattttctcacttttccatgatgggtgatgtattaattaaagttcattattggtctttgagatgcctctttcctttgtcattttatggcctgcgagaaccagttggtcttggcttattaatatcttaatttgggtaatttggagttgacctctccagacacccatctcttgccctgacaccatgtcagggatatttggtgtactttaataattccagtaactagtcctggcctgatgcatgaactcaagagctataaatgcaggagctagaattgttggtatcaacagaccagtttggcagatagattccaaactcaagaatgtcacacataggtgacacctgttgccatgacagccacataccttcccagagtccacttcccacatatacctgtgaacaggttatatcacagcctaaataaaagacagacccttcccaccttcaaccctttttcccttgtctttctttcttcactttgtctctaataaacctcttccacatggaactgctttggcctggtgtggcatgtccagacgtgagctgccattctaacatttcagtaacagcttgtcttactaccagtctctgggtttgacatggtaccatttaggttctggtttcttcaggactgaattccacggttttcttagttagggtttctgttactgtagtgaaacatcatgctaagccaggcagtggtggtgcacgcctttaatcccagcacttgggaggcagagttaggcagatttctgagttcgaggccagcctggtctacaaagtgagttccaggacagccaaagctatacagagaaaccctgtctcgaaaaaccaaacaaaaaataataaaaaagagacatcagggccaaaagccagtcagggaggaaagggtttatttgacttacacttctagtccatcattggaggaagccaggacaggaactcaagaagggtgggaacctagaggtaggagctgatgcagaggccatggacagggtgctgcttactggcttactgcttccagtagcttgcgcaaccagctttcttatagaacccaggaccaccagcctaggaatggcaccacccacagtgggctgggtcctcccccataaagcactaattaagaaatgacctacagtggaatctcatggaagcattttctcaatagaggctcccttcattcaaataactctagctgtgtaaagttggtataaaagtagcctgcacactgccttacagtccattacttctgactgcctctgtactgtgctttcagaagatccagactatggatttatctgtttgcttactttggctattttgaagatttgatttttattcctagttgtatgtgaatgtgtgtgtgtgtgtgcctgtgcgagtttgtgcatgtgagtgtatgcttgtggaagccagaaagggcattggatcctatggagtttagaagcagttgtaagccgcccaatggggatgctaggagcagaactgaggtcctctgcaagagcagtagtgcttataacagctgagccatctctctagccccctgattttagtttttttttaaaccatgttttactacgtagcctaagctggctttcaaattgcagtagtccactgctctcagcctccccagtactaagaatacaggcatgcaccaccatacccctctttattattaaaggcatttcttagactcatgtcttctaaagttttaacacataatcatgagaagaaaccatgtcaacctcagacaggaagaggagcacactgagagctgtcaggttgctttttaaatggctggcttcttacatgtggtggctgtgtgggtgttgattttaatataattttccataacagataccataaatacatccttttgaatgtattaaatacttgatgaccagttaaaaaattcaaaattttacagtttatactactgactctagccattgtgtttatgacggcagacccgagagtctccccaaaatcagtatcagttttaaaacctcaatttttctattaaaatactttagactggggaattcagcataggtggagtttctttcttataagggtactgtttgcatgttctcaatgttttaaatgttataaactatcttgcagtgtagtagataagagtaagtctaaatcatgtgtacaagatagaggaccataccataacaaggtgtgccataagtgaattaaatcgagcttgggtttttgttctggatagaattccagattgcattttccatttttcgaatgaggtctgagtgctgtattaaaaatattattggtgttgaatttctgatcagtcctgagtcaaatgagctattaagaacagctcagaaatgccagcatctattagattctggacatgatgtcaacagctaggcaaaagttcactaacattagacctttactgaaggtttaaaatataatttataaccaggtggagaaatgcctagacccagccttcacactaggcgtagagtggaatattctcctagatgcccatatgtattcctgagtcccaattctaggaagtaaactcgctttcttgtggaattcattcctcccagtaatctaactaggtaatatgcttgtagaccaggatgccatagatacatggctctaactagaagttgtaaaaaatctttgttgagaatttttaaaaaagatttattcatttcatatgtgtgagtagtatactgttgctatcttcagacacaccagaaaaggtcatcgaatcctcattacagatggctgtgaggcaccatgtggttgctgggaattgaactcaggacctctggaggagtagtcagcgctcttaaccactgagccacctctccagcccctttgttgagaactttaaaacaacaactctaaaaagtggaacagttcctcatagtggccgtgctagtgattgagtggaaggtaggttccaagggatctcttgaccaggcagagttcattgcacgttggtcctaaggcccagtgacactgcgtcaggcattcctgttgcctgtgattctcgttctgtacatccatccatcccaccttgatgcttggcctatgctgctgcagctgctattgtctgttacacacaggctaaagaatgctgactgcctcccttggttgtttatatttagaatatttaccagtgccctttgttagagattacagtcatgaaacatttaattggctaatagggcatctggtttctgacatacctttccgggaagagtggcagtgtttatttccacctgtcacaaaagcagacgtgtactgacactaattaaacttctgcctgcatgtgtggcaatgaccctaggtgcttgctgtaatacaaatatcacatgacttttgattagagtactcaaacatcatcttacggtgtgtgtaactaggtaaacagagaagtatttgtagctataacaaacacaatgagagatttatatgaaagacaatgtcagtgctttggcaaatgatcacacgtgtacatgtgtcttcctggaaggaagctggactgactgactgactgactgactgactgactgactgactgccactctctcttcagtaggccagtgttaggggaactgagagttgatgccacacaatgttgtgtaaacttcccttcctttcaggaagtactggatttgtttcccgagaagccgtctatattgttggaatgtgtcataaagagcgaagacatacatctgacacttgggtcctgtttgccggctggtttaaggaactgtaatagttgtttgttcttgatacattagcaaagttttctttttccctgttgtatttgttatataacttaagcagcgttggatcaacaacagtgactatttaggatctgctaaggccttagggaataaaaaactctgagcctcggatgcagtcttacctggtaggagagatggaagggagctcactgggaaggaaggcgtgacttttgaatgaggtctgttccccttggagcaaaagagaggacaagagagatcttcagggcttgggcaagtgaaggagttctgggagaaaaaggcctagagggtctgcattgggagtttgagaaggtcggacagcccaatgtgggacagacatggcactgactgtgtgcccagtgcctgggaaagtactgggttctttggcagtctaatgtagagactgagttccatggggtagaagcctgattctgaggggtttccccccataaacatatatatatatgtatatatatacatatatacatatatatatgtgtatatatatgtgtgtgtgtgtgtgtatatatatatatatatatatatatatatatatatatatatatatatatatatatatgtatgtatgtatgtatgttgggaagctttgcactttgtgttgtcactgtaggtaacaaaggcctagaaatatttatccttttcttcttgaaagtctacccttaactatatcaatagtagtggccttgtttctagtgcacgaaggccgtggagaatgtctttacgctctttgagctctgattgtagctgatggcatttaggcaggttttcttcttcctgggtggaacatctgctctaaccggcaagctcgctatagcaaccaacgtactctctggtatatactatgctagtatataatgcacaacccacatagctcacatagtacaatcaatagcagtagttttctaaataaaaaagaaatcaattcttttagaaacacacttaaactggctggacatctcctggaaggagattttcttttttatcacctctgaagtaatagctcagtgatcgagagaggcaaggcttcaggcttgatgacatgctgaactttggcatctccctgtaatgatggtgatgtgtcagaaggctctgcgggaggggccttctacccagaatagcagttggacagcatccaaccccagggactctggcccaagggacccatgtttgaaccacgaatggcagaattggtccaggtacaatgggaaagcttcctgtcatgcctgctgataagacagttgctaggatgtggaggtggtatgcagaggcttccagaagttagtttcaagagtttgggagttagctctatgggaagtgtaggggaactttcacatcaggctatccttcctgttgctagatataagaaggcctttcctgcttctgccccctttgcccgattttgttttctcattccagattgtgattcccagttgaattggcagagaaccccagagagatgaagctgttctggccatttagtagagcccaggctaggcagggggtttctccattcgtggcccaggctaggcaggctgcttctccatttagtagagcccaggctaggcagggtgcttctccattcgtggtccaggctaggcagggtgcttctccatttagtagagcccaggctaggcaggcggcttctccatttgtggtccagggttcttagaaaagagcaacagtttcggaaggcccactctcatttagattttgttgttagcttggtgtcattttgaagaaatcttgggactatggaatgaatggctctaatgagtcacaaggagatctgggaaaacggctcaacctgtaaagagcttgctgtgtttgctgtctgtccagtaggtcttgagttaaaatcctagaacacacctaaaaaaggccaaacgctagagcctaggttgtcatgagtgcttaagtaagggctcttggaggccaaacctgataaacctgagtttgatccctaggaaaccgtatggtgaaaaaagagaactgactcctgtatgttgtctctgacttcatacatacatgttggtacttctgcccccaaacaaacaaaggaacaaatgttcaggggagctgggcaaggtggtgcacacttaaatcacagccctggggaactaaagacactggggaattcaggccaatgaaagaccttgtctcaaaaagcagaccaactcaaaagggatgttcctgagaaagaaacccaagatttccctctggcctccatgcataaacatacccatagccatgcatgggcttgtgtctatgtacataccgtaccgtaccataccgtaccgtaccgtaccgtaccataccataccgtaccataccataccataataccataccataccataccataccataataccataataccataccataccataccataccataccataccataccataccataccatacccacagagagagagagacagacagacagagacagagagacagagagacagacagacagagagacagagagacagaggggagagagagtgtgtgttaaacccaagagatattctctaaccctaagaagtaacaatctgcaccttgaaaacaaatctcttgagcggaaccatgccttctccatgcaagcctgatgacccaggtccaatccttggagccacataaaggtgagaagagagaacagactgcagtgggaagagagaacggactgcaggaagctagtctctgacctacacacctgtgctcaatcacacacagtaataaccaataaaacacctttcttcccgtcagaaactccgccggtattagtgattaatttgcatttaatagatcaggacccagggaattgagagttctgcagtctcctacaatttgtcaaatttcaactgtttaaagtttcttttaaacgtttttattaaagtatgatgtttaagccacaatatctagaatgtttaatttattcatgtttaagtgtatttaattttgtcctaaataaaatcactcctttaagattcttttttttcctagtagtccttttgttttaattatataatatcaagtgcaagaaacttaaactatacgcctaagtttctcctgatttaagaggctcagaacatacaacaccaacaactgtttcagctctaaaagtccatgtacttttagtataaaaaatgtttaattaaaagccagtttattcacttaagatttccttccttttcagttcagggggtgggacccctggtgtatgtatgttaagccaggattcctcacatagccacatttagccctgccttccccttaaaaaacaaaacaaaaactaaccaaacaaaaacctctttaaacatttgagtcagagtcttcctagattgcccaggcaggcctcctgctcctacctctggactaactgggattacaggtctctgtcaccaagctctgcccagtctatggctgtctacaactgaggacttccagattcaagactcagcttgtctgagtatctgctctgaggagcacagtaccaagtgccttgcatggagggtcacctataatctggccacctctgttccagggctcattgcagttcattaagttgctggtcagctctcaaggctgctttgaaggaggtctcagagcgctttgcatccagtacagcctcacctcgggaatttgtaccagcagaaacccactaatcctggcttcaggaaagtttctcaaactttagaactgctcgagttcttaaaagcttagactggggtgggggctgtggaaggctgctaaactcgtcctaaatcaagaatggaaggttccgccttaaccaacagtgaaggcgcttattggttaggcttgcgcggggcctgactcacttcattagctgtagcagagggccacgccctacattccaaaaaccctgtgcagcctgaggcgcgcgggccgtgctcctgtagtcccttgagctccgtgtcctctgcgtctggctgtgcttcccagaggcggcctgtggggaccgctggccactcccaaccgctggccagctgcacgcagagacccgcgtaaacttgtcaggaactttccaggaggctgcctttgggaggagaggtacgtgtggctctttgtgggaaggcagttcgttaagattttctccagggtgatgcgttgtagcagcgccagatggtgggactccaggaaaagtaggcaaggagcaagccgtgcttggcttccacagagcgctctgtgatcaccagtgggatttcctccgccaagcgatgtcaagggaatgactcactagatgggcttcagtgctaaactagatactgcctagtggcaatgcggttgctgggactgtgtggttctgaatcggtagggcaggcaaggcaggcaaatcaacaaatgcgccaaattcggtgtgatgctactagccctgaagttccaagtgtataatctacaacccgcatacaagtggtttcagtttgaggttgtcggacttccctagagttggtttttgaaaggtgaaactgtatttacggcttgggtactgagatttttaggagtacatgccttctccaaactcacctctccataaggtcttccagccaaaacatctcggagaagctggtgactgagctccgtacagggtgccaggaggaagcacgtgctgccagtgttttctagacagtgtttattctgcaggctgctgcttctcttagtgctacaaggtgattgccctagtgaaaataatcaagaatgcatgagggttgcttttgtcttttttttttttttcctttcttttgctgtgtgttattacttgagttgtccccaacagaaatctgagcggttttcatgaatggggcaaattttcattctacttgtagcctctttgagtcactttgtgtgttcctggggatacatcccaaggtctccactgtgatgcatcccgccagttaagctaaatctcaaattcttggtcatgtcggttttaaatttatgtaaaaacaaagttggtaagcgtctttaaaaactctgggcagcaaatttatttgtattgtacacattgatttttattttatttcttggtggtggctgttggatctagggcctctcatggagctagatctctcagcctccaggttacaaggaaatttcttgccttgccgaggcttgggaaggtggtgggctggaaaatatcttttgatttttttttttaaggaaatatacaaaccgacagagatgctatcggaagtggagttagtgtgtaccagataggcaggcactcggcattctggtggcataggcaataacagggtcattttaaaactgacccatggttgagagtgtgaattaagccagggacattatctatgcactcctgcatcttttacaaggtatagacagatgctttcagtcagtggagggagagtaaagtatcattctatgcaactgaccttgtttaggtctctaaaggagacttctctagaaagaaatcacttctaagtggaatatttaagactacttgttgatgattggagacattagttagcctctgagcacccagcgccttctgcaggctcctgggctaattgttaagccagctgtgctgctttacactgatccagtgtctgggtcaaaggtaacacttggacggcttgaggaacaacggcctctgaggtagcccaaaggacaccgctggcggttggaaggcccccttaggtggtgaatgggaaatgggaaaataacttgttgagttttaaacatctaaaatctaaaggcataattaaatcaagatggtccatctcatctattggtgttacaaagcctggacaccaaggggtgatccttcatctcagctgttgagatgtttctcagtggctcagagggaggtgaattgccccgccttgtatttaaagatttggatggtccactctctttgttagaagtcaccatcaagcattgtcatttccccctgtggttcttatagctgtcaaacagtgccagatttccttatgtgaaatgatccccaggataattttggtttgaaacagattttccaagcgatctaaaaggtccttggtgcctccatgcctgagtctcaaagttcacagaacaatatatttactcaggaagcttgaggttttcaaatattaactgagcaagcaggagactcttgatgggtattttgatacacgtggctgcctcggggccattgatctttgttgactttttttccggaagctctttagctctgaatttgtgcttcccgctcctcaggaagtacacactgggtctttccaagtgtgaagccaaacactggatcctgggctttccaggaaatgccctttcataagagcacacctgcaacgtttgacatgcctggtgggaatagttttcaagttaggttggtccttcatttagtgttaaacttgctttttcaaatgatgaggtaggggccagaatgatggctccatgcatactcattggctgagagtacacactgtgtttgtagagttcctgagttcgtttccagcacccatgccaggcagcttacaaccatctgtaactccatcacctgggaaatacggtgcccctagcttccaagggcatctgcatttatgcccctgtatacataattaagaacaatacagataactttaaagggggaataatgagggaaaggacatgggagtggataagatttaaagttagaagatgggcaaggtgcagcatctctcagcagaggtggccttctgcaagcacaccgtgatgcaggaaagcaaagccacctgcctggaagacccactggggcacctagtccaactcaaccccacctcttcgccttttccatctgtcttacttggaactccccacctctccagccaagaatgccttggccaccccctcagatctctgcatcctagctatctgaagtgacaattatgctccaggatgttgaaagggaataccagggcttgagggtgtagctcagtgatagagcattttcagagcgcccatgaggatctcagtcacctccttgcaccaaaacaagcaacagcaaaaaagaaaaccaaaaccaaaaatacacacaagaaaagaactcacaaacagaacatgctagtgtgatggtctaattgcatgggaataatcttagaacaatcacaggaaagaaggatgtcagaaagtaggttttcaaaagcaggtagatggtcagttctaaaggcattggaccagagtgtgtggcgttgtctagcagaattgtaaaatatgtttgtgaaaagatgggtgaggatagaaagaaaagatagaaagccagcgatgagagctggggtgttagcccatgcctgtaatcttactccttacaaagcagaagcaagcacatctggagctcagggccagccggggcttcatggtgtgaccctcaacatctcagtattgcacatgtgcttgctaaggaacttgtgttcattacctcacttctttcttaatggaggcgtcaggcaagtatttcaggacagtgacataggtgtggcgtgtcagccttagtacgccatttaaagtgctgggtgttctctatccaagagggaaaatgtgggttggatagcgctatggatatgtgagctggccgagaggacagtagtgttagactgaaacagcaatcctgatggacatgatttgataaatctggggagctcggattgctagaggtggagtatctagaagatgctgtttccgtagttcttggattcactgcagctaacagcaaagaactgggactctggaccagggaaccaggtcttggatgacttattattgaacaccttgggcctccatttccttagtcacaaaacagaaatagaagaatacttatcacattagaggtggacgacatgaaggatttaacgttgaaaattctctggagaagtgctccagagcagtagcagacgtcattccctacccttggtgattcgctgttgctgtggcctcttttgctttcacaggactccttgagcaaaaggtagcttgtcctgggtttgccttgaaatctacatccagtgtgcacagtgcagtaatcatttgagctgcgagtcaaagatactgagtttgctcactgtcaagaagctagataagatgttgcttgtttagtagaatgatgcagatagcctacaccaaattctgcatgtgccctctggtgtttgccagtgaagagctgtggcttggctttaagaggaatatgtgctgaattagggggtagcagactagttcctgaatttagtacagattttctttgtgcaatttggtcaactgactgtagttctccttagagaccagtgttaccttctagaggacatataacatctggacataagtggagccaagcatgctgctatccatcttacaggcacaggatggtcccatgacaaggacttgccctgtccaaactgtcagtaatacagggttgagaaatcccggcttcacagttgaatgcttgctgtgtttgtgaaattggaatagctgtttttgcttgggcagtatcaccagctagctgaaagaatgtaaaaataagcctgcaatgaataggtcacagagaagctgtggagttaagtggaaatccaatggcacgtggctctgaagggaactagctgctaatagaaatgaaaagaatcaggatgtggagcctgaggtagaagaccaatttaacaattttttattttattatcttatgtgtatgaatgttttgtctgcatatatgcatcacatgtgtacaatgcccaaggaaccagaagaggggtcatataccctggaactggagttaggaatggttgtaagctgcagtgtgggtgctgataactaaaccaggccctctggaagagcatataatactgttagctgtcagactatttcttcaaccccaggaatataattttcagaggccagtctggccagtccagagagaaatgaccttgtcctaggatgcactatcaggcctttatcagcctgactgagggtgggcttgtccgtatgctttggagttcagatcgcctacgtacaaagcctgacttggagtgtgggcttgctgctgtccctgaacaccacagggtgtatcttaacctcacatggtgccatgtctggccattcaggtagacgccatcatggatggctgctccatgccaagtgtgtggagcttgtcgccctctccagtcagcaggtaccatcatgacctgcattatagtttactgttctcacattattcagttgccatttttacctcagtgctacttgggctgtgttttagcacagatgattagggccccaccttgggctgtggtgaatccaagaagactcccctccaagctgggctggcttcacctgccttgcttgtctaccccaggagtgcccttcctatccagtcctaaacacaggaatatgatggccatccctatactgttaccttttgttataatgtagaaatactgagaagaaaaaaaaaaaaaaagggagctggagagatggctcagcggttaagagcaccgactgttcttccaaaggtcctgagttcaaatcccagcaaccacatgaaggctcacaaccatccgtaacgagatctggcgccctcttctggagtgtctgaagacaggtatagtgtacttacatataatcaataaatctttaaaaataaaaaagaaatattgagaagaccatcatcaggagcctagtcacaaaggacatgtcgggctctgttctgtgagtgactcacacatgagcaagcaggccctgtcacttctcatctaaactgtacaaactaccaatagctacagaaatccctgatcaaagcaattcatgactaatgagttgcagaatttttagtgtggtttttttattgctaaacattcttggaagtgtatgaaatatactttggtttggttcttcggatcatagcatggatccaatatcttgaacattttagttgctgtggtagttttaaagtttctataaattctaaattaccactgctatactgaaatgatctcttatagttaacttccattaattgtgatttttgtatgttgtatattgtcttttttttctttctttctttctttctttctttctttctttctttctttctttctttctttctttctttttttgagacagggtctttctgactactatatcctagttgtcctggaaagtgcagtatagtcgagactggccttgaactcatgacaatcctcctgcctctcaaatgctgggattacatgtgtgagctaaggctcatgtgtgagaactcagtgtggattctaaagtgctgagctgctggataatcagtccagggacctgagagagatacttcttaaagccttagcttgtgctctaaggagcagatatctcagcagaaagagcaatcagatacatttgcgttatgtccatgggaaagtcagagataggaagttcttagccgagagccaacaaagagaatgctgtttataacttgaacagggctggacctcaaagagatgtaccctgagaatttcataggcctgtgagactccaaaggaatcctcttaggaaaagagctgagggatggactggggtatctgctcagggaagcctcacggaatgattttcccctggattgaagaaacaaacaaaatccagaaacacaaagcaagccttctaatgtcaccctttccttagagtgtctacccactaggtttggattctcatgattccatgccatgtcggtcctgggctgtcactcttcccagactccttctcttgagaacttaacaaggtcgtctgactaagtcgtgtgcccgtgtagggtagtaacatgttcttagccagcagtgtgccaaaccctgactaaataagggagtctcttttctcagtgaagtcttctttgtatagctaagcagtggggaagatgattcaactgagaattcagcctttaaagaatgtagatgttaccatggttaagtatgaaacgtaccttgtgcgtttatgtaaacagaacccaaatatagctaatatcgtgagcagccaccactccagggactggaaaggagtgcctctcaccgctgagctctctagatcttgattcatacctcactgcagaggatgtggtcttggcacattgcatacacaagaaagtaatatggtgccttgctagtttaacttgctacaaacctaccttcagaacttaactcaaaatatttctttagaagggccaaggatggcaattcagagggaaaggtcacccaggaagcatcttgctccaacactgttgaaggcagtctgctctgtggggaccctggagccacaaagtgagccaggaagtgtagctctttgctctaaagtgtctcgagtgtggccagcccacaaatgaaaaaacaagcaaataagcaaacagacaaacgtgtaggccgggtcccagattggagtttggcagtcaagcagtgaagggcaagtttgttcctgagaggcaaataggcgtcgtgttccccagacagagccacctgcaggagcagacacgacagagtcacagcaatcttcacgctaccttgtggtaaaatgtgcttccctggtgttcccaggaaggttcagagatggcagcaccggcatactgactaggacataattgtttcatgtatcaataattaagtattgaaatgaggcggaaaaggagaaaagatgatgttaagtgtgagtgtgtgtttatgagaggcatgatataataaagaaaaaactagcatagatgcagagaaagaaagggcgtttacaaatgcctattcaggcaaataggggacaaatcgtaattgagtaattaaagtaccagagtgtacagtattttaggtattccttagtcctgacatggggagaagaaggttctgtcttcacaggattcccgagtcctgctgttcatcctggcagttgtttcacacttcttaaaacttcgtttgttcctggcctgtccctgtagtgactcaatactgagggctgattgaagattagatttctgtttcttgtttgcctcttaagccttgggaggcatttggagcagcttttatcaagtgtcacatggcccagtgacatttcacatgtcttgcctaatgcctgtgaagggacatgacacagctgaagctggcgctgcctgtgaaaccattagaggattttatctctcggaagagtttgatgatacactccagggctctggttttattcatcccaggtaggtgttctgtttactcatgactgcagttcttgctgacgtgcgctctggctcctttctccacagctttggcctgccaggtttctctgtggtcccttgcattataagacagtgcagtgtgtcagtcagtgttctgtttggtatgttagacatacccagccttatttaaccttgactcccaattgtcctgtctcctctgccttgccttcttttctccacttctgggcccttcttatgttatctgaacctcatagcagccctgaaggacctgatactcattaggtggatctgaggatggttcagatattaaggcttgttataaattctttttaagttttctgcttatagtttaaactagattttgttggataactgcataaagcagaatagacacttgtaatcttacatcctgataaccaagataacataaaaaaaataaaagcaaaacatgtttgtggttagtacacaaactttacagaagctattgatgagatgtataggctgccatcgaatgtgttaatatacttgtgggttttttttttccccccagaaagggagggagtatttgtggcatatcgccatttgctcttagtagaaacgttaaattttatctataattctgcaactaagatttctatacttagagtattttggagatcttgtctaaccacacatggaaatcttggttttttactttggcaatggtttggtatttcattaaatgaataaagagtaattaattccacctttgtctcttcctagccattttaatagttgccggattgttcctttgtgcacgctcagctgttagattccgtgtattctgccctaggtatacattttgcggctagatttgttcatttaattcctgtaagtaggatttctggaccagaggttaaattaaccttgctagataaacaatgccaaactggattctacaaaggacaccaaattttattttaaaccaactttgcatttttaatttttgttcttgatacactggtaataattatactaacttatgagtcacagtaaagtcaaaggtgtctgtctgtctgtttgagacagagtctttgggtgtattcatggctggcctggaacttactgtatagaccagggtggctgcaaactcagatctgcctgacatccacagtgaagggataaagtgtactctttaacatactcacctccttagatgtttatcattcctttcctgtaagaacactgggaatcctcgaggtcaaagctattttgagattcaatgcagtattgttaaccaaagttgcatctttccacacccccagccctgtaaatcacacagcattaactgtactagcatgctaagttagagggattgtctgtgtccttttgtttctttttagtttgggtcagggcttgtgttctgtccctcttctttgtccctttggttttatttccataatctggctctgcacttgattttctcctccttccctttcctcatctctctctctgtcccttccctgaagggtattgtctgttacactgacctacatgagcacatttagagcgtgaaaaattactcttacttaatgtacattacatttattctgcctttgcccaggtcttttgttttcattaaaaccattgcatttattttagtgttaggaatattagacatctttcttataactgaaattaaaaaataaaagagtgttgctggctgagaaaaaatgagcaaccatactttgtgctatttgagaggcagagtaattatagtttagcgttacagggcatgtacactggtccttgtcagtcctagattcacgaagacctatatagaatcccaagtctatttctaaggagcgctcatcattggtgtccttcccttgcattgcgttggccttcatcagcttattggcattgatgagctctgcaagtctttgcctgttaacatcaggatgtagtgaccctgtgagatcatctgtgggatcaaaagttacaggaaattctcacttcagtatcctgagccctttgacctggttcatgaggcatccttggtagactgaatggattcccgtgaccaggaagaacaagaggtgcagggcaaaggtgagcaagaatagaaagcttgactccagattcacttgggacactttaagtccactaatggatctcacagatacaaaccctagaatgtacaacatctctctttgctgctgtcttacctcctagtcagttagtgtctagacatctggggtggcctcccgagtcatgatagcctctttacctcacacaggtggaaacggaatgtacaaacagctcacttatgtctactgttgatggaacctttactgtgttcacacaataacgctccagatggctagtgacggctagtctcttgtgagtagtattagaaagatatttcatattaagagaaaaaaacctgccgctaatggatttctctccagatttcctcagtgaacaaatttaaaaggattctaatgaataaaaattaaacttaaaatgttttgttgcattttatataaactaagcttcagtctaaatcccaagaaaataataacttaattcttgattattcacacaactgagcagatttttaatatttttgaccgttcaaaacttatattgataggcataccatgatacagtacttacttgatttggcatataatattttctcaaatattgataacctaatttctagtagaattatggtctcctttttctcctctggacctgtgagctctgtttactattacagttttcagaaggcaactggctcaattaataatatttagcaaaataaaagcccacaattggaaaaatatgttgaattttctggaagttgatgctccaagactttgacttccgttactggccagtgactttagcacagcaaaaacagctggatgctgggacactagagaacaggcttggtgctcagaaggaccacggtgttggtcaagctcagaaggaccacggtgttggtcaagctcagaaggaccacggtgttggtcaagctcagaaggaccacggtgttcgtcaagctcagaaggaccacggtgttggtcaagctcagaaggaccacggtgttggtcaagctcagaaggaccacggtgttggtcaagctcagaaggaccacggtgttcgtcaagctcagaaggaccacggtgttcgtcaagctcagaaggaccactgtgtttgtcaagctcagaaggaccacggtgttcgtcaagctcagaaggaccacggtgttcgtcaagcgcacatctcaggacacacttgggagaccatgtttgaaagatgctgctaattaagctttgaccagacaattctgctacattttggtgatgctagtcttcttttctaaacagtatattgtcgtgaaagataaaatggagatatttagactatgtctctgacaagggaaggctcacaaatggcttctcctgtccaacgattttgtaccagtttgatccatgtcacatcttcagcttctaacttgttaaccaagttgactaaataaggctggcagaaatttacttggttattttactttgacattttgcacaggaggataaatgagtatggtagcgggatccacttagggaaaaaaaaagagtttctggaaatggtttccaggatttattatactaagacagacctgagggtaagcaacctttgtggcaaaccaggtgtccctggagaaatgcagcaaatgaaacagaattgtgttatcagttgtggcaagtgtaaaatgtataaactgacagctacttttgtgaggcatgtctctggttatcactcagaaagaaaacccaatgcagcaaaatgtgtcagtcatctccgttcaggtttgtaggtctggggaggtagctcggtgggtaaaatacttgcaaaagaagcgtgcagacctgagtttggctcctgaatactacataaaagccaggtccctgcaatctagcattccgagatgggaacagaaggaccctgggggctcactggccaggcagctgagccaaaatggtgggctccagcttcagtaacaggatattgtttgaaaaataaggcaaagaaatgacctcgggctgcacatacatacactgacccatgatgtacatgtacaaacactagtaagataaaatcgtttctcgaattgtgcaaattaagaggaaatattttccagcttgtcaaagttgaaagtgcctcttacgttatcagtaagagaaggggcccagtttaaagcatgaagccttttagtgaggtagaagacaattttccccccatcgctgtcccaaatgtcagataattgaccctggtttttgttgtgtgtttctaggtgaagctagaaatcccactgaggtcaattattagctataagtgtttctgacacagcatttgtgtttcaggagtctcgccattggtcagataaaacgtgttaattgttggcatcatgaggcagcatagttgctgggcagcagcattaggacttggtcacaacacattgagctgtgcctcccgggagcttcctgcccaggcaccctctggccttggtgtggcccatagggagtttgattacatcaaccttggccataaggtagaatctgaggacatttgttacttctcagtatattctgcttaacactgaccctgagtgcacctggggtagggtaacttaatgtctgtagttttaatgtaactaattttgccttcataaaattatgattttcatgtcggatttttactgatacgatgctgggctacattctatgctaggtgtcttttgtatgcggcatgcttgctcattgtggcttcggtgccatgaccctccgttagcaaaggctactgtagttcagagtagttgagcaatttgtcccagatcttaaggcaagttagttgaagagctaaaactgaagtctgggtaacctggtcccagaatctcatggcctctgtatttaccaccctttcccataggaaagaatggacagctacagtaaacatgaaaaccacgcaaagaactctagaagaaccacccagccatagcaactatcttagcaatgtgatgtccacattccttctttgaactttgattgagactcctctgtctttgaaacctgtctttccaaatatatatgcaattctctgtacgcttctcatgtatcttactgtataatcattgtttggctccgcattcgtatttgttagtatctcctgagtatatgtgtcacaggtgtaatataacacagtgttttattgattacttcatgtggacctttctttgaatggcaagacttatttcatatgtcatttaccttgatttatgttgtgaaaagtactaattaatcctctcctgaaatgtagggtattaggaagaacaaagagaagagatttattttccccttgtctctacattctcctggcttctccacccctcctttgatggagaactcattagaagcaatgaggggaatcatctaggtaccacatcccatttctttctttattgtatagaggggatacatgcggaacagcttacaggagttggttctctcctagctccatatgggccctgggaagtgacctaagattattagggttttgtgcatagtaagtttatagtaagtacctttacccacggagccatctcattggccaaagtatgcaaaaataatactttgggttttttctcagcttcatgcatagtgtcatgggactttatctgaactgggctctgatttgtgtgactatggctactctcaccctggaaccacacccgtgtttcactgacagcatcctatccttcattctttaaagtggtgccagaacgtagaaaccttccgaagcagcccactgccaggttcttggaggttttaaagccacgtttccttttaaaataatgaagtcgtctcaaatactggtttggtagcattcttctctcacctgattgtccttatcaagccccactaaaacattcaatttaattttatagaattaacagctcattttccccctcatacttgcattttattagttaataacttaattaaattcccgtaatagcagaaaccagtacaacctgagtgaacaggtttggaagcaaacacaactgcggcctggtaaatgttgctcaacaatacgggataggcattgccagacttcagtcatctcacactaccgacagtgagtgatggatggcttactcatctgcctgaattcccgtatggtacagagggaggaattaatccaagctgaagattaagtagaagatgaatagtaagacaagcgtgaactgtagtggtttaatacctgtttggaggagttatataagtcaatgacatatctcagagaccccaacaacttaacttgattttactctgaattgtgtataagtgtgaagggtacgatccctgactgagaaaatgccttcattaggtccagctgtaaggcatcttcttaattagtaattgatgagggaggatccagcccgttatggatcttgctatccctggactgggactgctgagttctataagaaagttggctgaggaagccatgtggagcaagccagtaagcagcagcaccattctgtgacctcttcatcagccctagcctcctgtctcctgctttgtgttcttaccctggcttccttcaaggtaagccaaacactttcctccctagcttgcttttggtcatcgtgtttcatggtaaaaaaagaaacccaaagtaaggcagaacttggtaccagcatcgtgaggtattggtgtgaaagacctgaccatgtttttggggaaggattgtaagaaggtctttggaactttggtctagaaaagccgttgagcgttgagagctcagtgggaggttctgtaggagcctgaaagttaagaatgttgagaacagtgcaggcctggcttatgaggtttcagagacaccggagacacctctgggccttttgtgtgaagaatctgtggtatttggtcagctggagtggcagagtctgctgtgattaaccagcgatcggaaccactgaagtgaaacctttcctttgccaggaaaggtactaaaggcaacagtaagccattgattgaccagtctgtttcctggtactgtaatgaaatactagggcacgctgcttaggaacaagaggagcatttactccccagctttgaagggtggaaacaagatcagcagccccaggagttgggtgcccgctgagggcctgttggagagggccttctggaatgaggaacctgtgcaaactgaagggttcccatgggcagacaatgagctagacaggaattagtgtgggttttcccttagaaaaactcagtctgtgccaggctccctttggatcctgctagaatcacctaactccttttccagcacagtactctgagtaactcaaggatctccatgtatgctataccctttaaaggtccatgtctcttcccgacatcacagtggggaccgaactcccagcacataaacccttgtgtggcagattagtaccatgaaagggttttgttttgtttgggtttgggaggggctgaaatcacaagaatgtaggtttgtggtagagagaagaggcagaaagagtttcttctatcctcagagcttgtaacgtctggacagtggagtaagtgtgttacatgtacactaactcaggtgccacccggcagctccactaagctcttcctggtagatgaaagctataaagtagtctgtgcaaattaattagaagacaggcttcatgataccgggttggtacaggacttacttactttaagacacagtcacagtcattgaacatcagtgttttcttcatcaagtgttcctatcagattggttgctaaaaatgtgatgctgacaaagcagagaattacgtagtgtggttcttaaagattgattcaaacaaaggaaggggtaactggatggcagagtgtgcttgtcttcctaatgcacatttggttaatatagccttagacttacttagtttcctttccgttctataatgtctggtaccagaatttgcacagatctgtttaaagaacacaaagacagcctttgggaagactgaatggttgaattgagtttctggttggtagtaatcctgccttgtcatgtgccgtaaaatatagtacaggatgcatgtgtagttttagcctggagccctcagtgacgcgttctgtgcattgtcattctggaatccaagtctcctaaatgggaatccatggggcttctgatggagggtgttttaggctcaggcccttcagggatcagcactgagtctttagaaacaatctgttaactagatttggcccaccagatggtggaaggatttctggtagcgaaaagcaaaatggaaaacctcacaaggtgaacttacctaggcgatggggatggatcagcttccaagcaaaacaagtttctcttcaaaagtcagaggaaaggtgtcacaagggattggaaattatgttctccttcagcaaagtattgggtcgcatgtggctttccttgtctttttgtagagtctgtggagataggatgtctctccaaacatttgagtaatgaggaccttgctccaggaagaagatgggctgagcagagtgtcccttataagatcaaaggagtcctcatttggggaatagacctttagcatctgaccagaaaagtcttggttacttgtgccaacataacaatactttttaaaaagttctctctctctctctctctctctctctctctctctctctctctctctctgtgtgtgtgtgtgtgtgtgtgtgtgtgtgtgtgtgtgtgtgtgtttatacacagtcttctgagtctaggcaagtgcatgcaaatggttgaatgatcgttctcttcccttttctttgttttggttttttgagatagggtccctctatagcccaggctgtcctggaacttgctgtataaaccaggctggtcttgaactcagatatctgcctgcatctgcctctcaagtgctaagatgaatgaccacaaccacctggccatttttctccttttgtcatgtgggtcatggggatcgaactcaggttgtcaggcttggcagcagatacctttatcctctgagccatctcaccagccctctcatctatagtttactgagacaacctcttgaggttttgagagaaaggtgtcagaaaagggcccaaaggatctcttgataagctctattgtttggtcagtattcagtattcagggcctttatcaagcccgctgatcaactggatgacagatcagtgacctaatgaaatggaatttctaaaaatactgtctccttcctggcccccctccttatctgtcactgcgatgttgctgagatgtttccaggctgcctttggagctggacaggaagtaaggagtgaaaagctgtaggttgggtaagaaaatggcaatttaagacttagtgtgtactcccccaacagctggagtgccgcatctgtgcctcatgcctccgtgttttcagcatgtgtgacacaggcaccttgcccatggcatttgatcttctcacctctcttttctattttcactgttgtctgacctgctttgtttagtttgaggaagtggatgtgggtgaaagttggtctgggccacgctgatgtgtgtgcacttccagtattgcgactcgctgtgatcaaaggttgttgtgagaatggctagagtcaagggagcagtcccgagggttagatgcccaaggtttggtggagggaacattggcttcctgtgacaatggctcatttgcttagtggcactgagaggcgctggcttactttgtgcgttcatctcctcccctctaggtcctgtggcgaattttcttaacattttctagcactttatgtgcatgtgtctatattattttcaatcaaattgagtataagacagatagagttccagtataccagttttaaatcatgcttaagggttttaatgctcttggaacagtaggggactagtagatcatgaaagactagacagaattaatatgatgatagtttgtaaacatcaggtagtaaaataagtttgatatctttattttgcagtattggcgctaatgttctgtgattcctcttctctctcccaattcctgtgatttttcttcttcccccctctgtctgaaggagacagtacttcaaaggaaatcttagatagcatactatttcaccctcgtaatttactgtaattgctgttcaattatttacttttgtcagttgacttttcctgttctttaattctgaaatgatacttggactgtggcctggtcgtggtatggaagtgcatattctgccatccgtatcctgtgactggtcctggatggaatggtcttctcaggaagactgctccaagtgtagactcaaggtatgactgctgcctccacaccttatggaattagagggcaatcaggtacctgttatgtggtgccgctttagaagtgggctcaaatctaagtcataatgacttctatcatttttaagctcataaaaaaaattatagcttaggatactgagactctgaattagcggatcccaatcttcccaacactgcaaccctttaacgaagtttcgcattttatggtgactcccaaccatcaagtaattttattgatacctcataactgtaattttgctactgttatgaatctcgtgttgtctgacagtttcaggtccctgctgggaaagggtcatttgaaacacaccccccacccccaccccagcgttgtgacccacaggttgagaacccctgctttctatggccatcaccagctccattttggttagttgttttgtattgagatggcctcattttgtagaccaggttggtctttaactcaccatgtagcccaggatgatatcaaccttacagcaactctgcctcagtctcaaaactgcttggatttcattttggagcatccccatccaccgggaaattgtttatcttacaaattcatcatttatcaatttactatctcctggtactatgatgagccatgcagtatttcagttttttagaagatttctctatctttctttctttctttctttctttctttctttctttctttctttctttcttccttccttccttccttccttccttccttccttttttttttttttttttttttttttgagacagggtttctctgtagccctggctgtcctggaactcactctggagaccaggctagccttgaactcagaaatccgcctgcctctgcctcccgagggctgggactaaaggcgtgcggcaccaccgcccggcttctatatttcttaatcagagctcacagtagctgtgcaaggatggaaagtattaaaattgcatccttgtaagtcagagagcagtgggagcagcaggacagaagtggggtgcccgtgctttaggtctctccactcctcctcccccacgccccaggggctctgttccctgatggggtttgcgcagtttgggaattgcagtgtgctccttcctctggattttatgcttgttgtatctgatattgaggaaattcaaagcacctgaccagggtctggagatgctcagggaagcccacacttaacgatacccatcccatgtaccacagggtagcaagcacagccccttgagggaccattcgataccatcacagactctcccatgtcactggtttctgccactctctgttaactagcccaaaggcagactatgatcacagttagggcctttgccttggtgtccccgttattgttgtaacagagtggaatttgagcctgaatgtctgaaaaagtagttttggcattctttttactcttgtattattttgttgttcacatccgactttgtgattggtttcaaagtgagtagttgtaaagcagatgaaaaatacagcacctctgaagggtacgtggaagatgctcgcttgctgtgcatctgctgtgtgttgagggctgcaataataacaggcacaccaagcaaaggctctaaacgtgatcataacctgccttcaggtagttgcaggcagtggtaggaaagctgtctgtggcagaaagcagacattcagcttctgcctcatgtgcttaatgtgctagaaacccagcgtgaatgccttcacgttcctaagctcttattatccagctgtttatccaaagaaaacgctggagtaagctgagagctgtgatgttgcttcttgactgccccagccagcttactggggctctacccactggtgtcagtccctggagcaagaatatcatggcgtctgggacttgcgtctgaagaacattattcacaacatgatgtagttagtatcttgctgaggatacccactctagtgacccaacttgttccagttaggccctacttttgaactttctgaacatccccaccccctgccccccaaaaatagctgtacgagctagaggatgcatatgcaaaccacgagcccattcagaaggttccagatcaaaccacagtaccactccatctaacattattttggctcatctgtaaaaataagtcactcaaaaagtaatgtgtgatggcatagagcagtcataagctatagttgctggtgattttctgtatttttatacataagttgtttttatagtatgctaaaacagactttcctgtcccatggttggtggcaggaattgatagaaaggtcattggacctaagactacccaactccaaaactttcatctcgttccttaatttccataattatatatatatatatatatatataacttccagttaaaaagtgggaccatggaatccatatgagcgtcataaaacagtacagtggcagctgaccagcatgcactgcttggtaggataactgagtagggacacgtttcacttctggatactctagtctgagtacgtgactctagtggaatcaggagaagacttgatgggctcgactcacagagattctacagaatactgtgttttaagagttgcccaggtcatgagaaacaagaaaagaaagaggaacctggtggggagggtaaggagatgcaaaactaactgttgacaaggacagggtaagcgagcatagaggaggtaaggagattgaaagaacaagggctatacagccctggttgagacactaatgttcagttcctggttttagtcattgtaccctggttctcttaagttgacacaaagctaacgaagggtatacctcagttttctgcaactttaagaacattattttcagaatgacagggcaatggaaagccctcagcaggataatactgcttactgttgtttttgattcggtaacaaaagtctcagctttgagacagcctaactctgaggtctttcaaaattgtagtcacctgggaagaaagaatgtttagccaagtattgaagaggtgagtcccagtctacccctactactgtaaaaatgccataccgcgcaggagtgtctgcccatcctcaaggtagaaaagttgaaggctagctaagtgaccagtgcagcagcatcttcagaggctattagcaccaggcccttttgggatagaaggggacagggccctcctgggtctcattttttttttttttttgtatggacactggtctcatctgtgagggttctatcatggtgacacaatcacctccacaagccccaccccattgcacggttacctcaggatataaatggaaagggattccagtaggcatgtagcgccatgttgaactctaatgttttaaggccatctatgtgtaaatataaacatgttaaaagcagttcccctgagccaaaccccatggccgttaggtagtttttattttatgttggaaacaaaatatctttgtgcctactgaaaacaaaggaaagcataaatatgacaacatgtgctttgtaaggactcggtatcttgtggacataatagagccatatctagagaacactatgctcaggaagttgagacaggcttgtgacgcactgctctttggagttcaaaccaagcaggtaatcgtgtacccagaaaaggaaagctttgtctttaggggatgttgcgatttcctcagatcctgtttaccttccagcctgagatttcccctctggttggattacactgtttaactcaaagcacaagcgaggaagccatctctgctctcttaacagattgctgccccgaggaagggcgtgtgtgtttaagatgttaggccataaagaagactggaagtttaaaagaaaattccatagaaattgtgaaactatgacaagtggaattatttttagactttgtgaaaggagaagtaggagaaagagaaattttgcctttgcctctctaagcaatagagtgataatcctggcaactctgtgggttggacatggagtaagagacttacgtcactcattcctgggccgccttctcttcagcagtgcagcgtgatgacctaaagtctttgataattccacattacaaaacacatttaataatttcagtgtctactggagaaaatgtttttattacaaatctttgagtctttgttatgcgaggttgttgtgatttccgtggttaataagtgtgtttctggatcttgaccttaagcaggccatgatggcacacacttttaatcctacacctgagaggctgagtcaggcttggagcctcactttgaaacccagcctgaacttcatagtgagtccctggcttaaaacaacacggaaaagaacaaaaagaaaaggggaggaagggaggttgacctttgcctctgatttgtgggcattccgagttttgtagcgacacaaagcgctgtgtgccaggatattgtgcaatagcagacagtggcacttcatttactagcatgtgactctcgggagcattcgatagaactcagtgccctgggaagccctgagtgacaagcttatgcactttagttttgtaagaccagactatttcaggggttgttgttgagaagtgtagctcagatctgtctgctaaatttagcttgtcacttcactgggtcttgcctctcactttctgcctatcacgctggatgagcgcatacgtgcagagagctttctggagtggagtaggtagataacgtgttcgagtgtagttttatttggggaaggcaccacctttaggacatccatttttttatagcctttattgattatgaaagtaatatgcttattacaaaatttgaactgtgaaattatgcagaataaagtcagaagagatattaggacatagactcaaatccttgctttctgtacatatgtatctaagatatattacccccaaagcagggccgtgctgggcatgatggcacatgcctttaatcctagcactcatgagacaaaggtagaaggttctctgtgagtttgagaccaggccagtgttacatggtgagaccctatcttgtaaagccaagccagccaacaaacgagcgaagcataactgtagtgtgtaggacacttgctgaatctaagcttcattaaaacttacaatatggaacaccacaggcactttccatgtccctaatcatttcccaagaaagcaactcgtacacaagagtactaattctgttccaattccagaactagactattttccaagactggctggagccaaccgaaacccacgggtcagaagtcatatataatcccagttcttaattcacaagattcttccatgttaaagttaccaggagaaaatatatgtgattgtacatagacagtctgtctgatttttgtcttgttgtttcaacttcagttgagtcaggaaaggttttggaaaaggaaaagaaaacaaattaccttcctgaacttgagttttctgaccgcggtgcagaggagctgaggtcgtgaagggactagggggaagttggacgtaggaaactggggaggtgaaggaacagggtgcccaaagcactgggtccttctgaccatgcaacaaggaatgctaaaactacccagctgactgggagtttcattatctcccgaaccacctgtctcccttcttcagtgccctctggccccagaaaggggaaatggtaggaacggccaagggtggagcgggcaagctctcctcggtaaggtaaactattcacagagcctgccctggtcagccgtggctggattcttttctctctctctccttggctcatttgctggttatagttcattttacaaagaaaacacttttcttttagtggtgaagttaaactttacctcagccctccaacccagcccctctttggctgcagaccaaagctggggcctttgcttgataggcaagtgtctcccactcagctaaatttcccaaccccagattgcagcaatctaacagtagttactagtatacaatctagtagtagttactagtgtacaatctagcaggagttactagtgtacagtctagtaggagttagttactttctcacttctataacagtatacccgacagagacaacttaaaagggtgggagccagggccaggatataacacataagaattccccctccagtagctacttcccctatagaccttgttccctaaagggatcaagggccaaggcctttaaacacgggagcctgtggaatgcatgacacatgcataccatagcagtggtggtgggaattcacagcggtgatggacgctgtctatttgtagaacattcatcatttcaaactgaaaactgctaactcttcagataatgaggaaaagcaggttcttaatgccaagagcaatttaagctgaaatgagctgaaaatagtaagagaaataacatacagtcgccgtgcactgtctcttctttctgctgtctgcccactgtctcactgaagcacaagagatatgggatatttcactgtggcggagaggagctcccagcagcccctgcagcacttccctgcattgagaacatttccctcctgagtggtcctgcaaacagtgttcttagtcagtgcctcctataccacacaggacttagtcttactggtgtattatttgtgtatgtgctgtgtgtcctcgagtggaagccagaagttagagtggagtgtctctcataacctctcttcacggagtgctaaggcttcaaacatagatccttctgcttgtgtgacgagctctttgccagctgagctatttaccccggcatctaggtcttaaaatctcagttaaatatttgtctcatgtcccttcgtttcgataggaagaccagtacactcaacaccttgaacgaagctcagagtaaatgctagtaagtaaatctcggtgttgacgtttccgggaggcggcatgttaatatttgggcactgagttctgaatggtctctgagccattcatgcctcagtccaatgcagcctctcatagtgtccaggttggggctggggcaagtaggtgacagcaggaaggtttctacactgagtctcatgaccttagaggagccttagtatcacagacaaactaagaacttcaggcatctttctagtctgggtttttagaaaccagctgcagattggtcaggccatgtcagactcttttctagagctcatggttgctgtctttaactgcgtttacaatattaggaaatgttttctgttgttgtttctggtttgatttttcaagataggttttcactgtgtattcctgctgtcctggaactcactgtataccaggctgacctccagctcaaccgatcaccacctgcctctgcctcctgagtgctgggattaaaggcttgtgcctccacagccatcagggtaggtttggttttggttttgttctaaatctgtattctagaaacctgagtctccatgtgtaggaacaaacctgaagagtccatctgtgtgctctgctagatcttggtgacttgccgagtctttctgaagagcactggagtgttggcacttaggaaagtctcagggctccagagggaaggagcttgccccctggactggtagcgaaaatgtctgctgtggtcttaagggaggcagctgttcaccatcttccttgatgccctgccaagactactggtattaacagggtttatccagtgtcccagcaacagagatttccaagaagatgggctatggtaagcccatggcagcctgacactgttccaggtggccactcacatttaaagggacatatcaccctggacttgaatccttaggcaattcttgttctgttttccctctttctgctttccctctgtgttccagctctcacttttttcaaagactagcatggcatctagttgtgacatataaatcctgtgtaaaaagctagaattctgtgttctctcccattgtctacccatcttcctacaagaatctctatgtttctggacatgtacatatataaatgtaagtatatatgtctacttatctgtgctaagaaaacacatcttaaaatgaaccctatgacaggttgctgtgtgtaagtcatgctacattcattcaaatgacatgtattccatggtgaaggggcaccttctattgctagaccacagcagtggattgtaatgaaatggatgaaatacttgaggaaaaactctcttaaaaatagtgcagccatgaacattctgtggttatatgtgtgcacatgcatgtgcctgtgtgtgtgtgtgtgtgtgtgtgtgtgtgtgtgtgtgtgtgtgtgtgtgtgtgtgtttgagacagcgtcttgccatgtaccccaaactggcctgaaattcattttgtaagccaggctagcttccaactttccaataattaagaaataaaacatctgagcctggcagtggtggtgcatgcctttaatccctgcccttgggaggcagaggcaggcagatttctgagttcaagaccagtctggtctacagagtgagttccaggacagccagggctacacagagaaacccctgtctcgaaaaacaaacaaaaaaacaaaaaagcaaaaaaaaaaaaaaaaaacaagaagaagaagaaagaagaaataataaaaaatcggaagcataaacattattaaagatttggatgaatggcactaggcacatgctcaggggtagagcaagtccctgtcatactcaggttccccgaggtctgtcacagcccttaagaccttgccttccttgcatgatgtttggctgttgctttaatttacactggacacagacttaatctgctttttcacacattgattcattccattccatatgccctacttccaagtaggacttgcttattacataagatataattcccctcttccttagttagaacttgctttccttatggatgcatagtgtttagtacactgttgagcacagaaaccttggggatactttgttagcttcgcgtgcagtgtgctattctggcattcttgtgggtacttgtttggtgtctagtagctcttaggtgggagctgaggtagttaaaagatctgttcagactcactcgacactagtaacaactcgccatatgtattcatccagccttcggatagtaagagccttttctgggcaaactgctgtgctgctcagctgaaaattgcgtgttagagtggcgtacttacgaatgagaccgtctgattagtaaatggtgtgtattccctgggctttgttaaacagttcagcccttgctgctgggattggctgtaaagggagagactggcctgggtcagattttctggcattgtcggtgtcaagaccctgcttgcttgccagctccgtgctcatacagagaacatgcagtttactagctagattgtttatagtgtgtgatgacttaaaacgcttagttgtggttcttgctttaaatgaaataagtgaagtaggcttcttattttttttcctgcttatctctttctggtgtgcaccgggtttgaaatggttggtttttggggggtggaggggctatctggctttacagaggaaaaaatgtgagaaaagaattcagaaagacacagaaatgactccactatcacatgagagactcttctggggaagatatgggcgtgtgagcacccgtgtccttatgtggggcaggtgagagatgggcagtgtgaggccatggacagtgtaaaggcagaatgatcagaccacaagctgaatagcatcatgggatgccaaaaggcagcgcatgcttgcgaggcagtgagtagatctttctccatagctgagaggaagaggggcaagaattaggatggcccacagtcacctctaatccccacactgaggataacttcctgtttcaaagccatccagtttgtgttatttgttatagcagccacagaaaaggcagacaccagccagggcccatcaaatctcaacctatttcacgtcaacccagagtcacacaaagaaagggggcttctataacaaaaacacaaacgtggaccaggaaattcttggcatggtggtgtatgcccatagtctctactgcttggaaagctgaggcaggaggaggcaggaggattaacacctgtactatacagtgagtttcaggtaggccagagctactgaatgagaccatttaatcacgtgtactgcaggatggaggggggggggctcagtgagggaagaccttccatcaaccagcaaagcagaaagcgtcagaacctccccaggaaacgctgtagaactaactgctcctcttagcagatgcccatatattagtttcactgctgtaacaaaagtccttgacgaaggcaacttcaggttctcgagaaaggactggtttctacacactggtcaaggcatagtccgccatggtggcaggagcttgaggcagctggtcactttgcagccacagtcaagaggatgagcacccgttatctgctccatttcccctttttcttcaacccgagacccctggccatggaatgatgctcctcacagttatggtggctcttaccaccccagtgagcctcaggaaaacaccctctccaacccccggagagttgtcttttaggtgattctaggttctttggtttttcgagacagggtttctctgtgtagccctggctgtcctggaactcactttgtagaccaggctggcctcgaactcagaaatctgcctgcctctgcctcccaagtattgagattaaaggcgtgcgccaccaccgcccggctgtgattctaggttctttcaaattgacatcagtatgagtcagcacaggctttggaaggcctgcctcttactcagcctgtatcctagttggactctgcattctagtcaaagaaaagcctcaggctacaaagatattaaagaaataaaaataggaaatagtgggagtatgaaaagtgatggtttagaggggtttcgttgatgcaaagggtatttgcaccaaaatattaaagcaagagagtgaactgaattctcaggatatctggggaaggatattctgagaggtgccacaagtgcaaacaccctgagagagggagcgtgagagaggagcacacctggtgcacttgggacctgctcaggtggccagtgcagttagtggggtgagtcagtgaacaccagcatggcaggaagggagctcgagagaggtgggtatgtaggtggcagggacccgagcagggctgctgagtgtaacagtctcaagcctttcctttaacagctacaatccacaggatctgaacatagacatacaaagtggttaaggggggagtgggaggagcccacagtaggagcgttattgatggttgattatgtctcaaggagaaactggacgggctctcatagactaggagaggttgtgaggtgttgggcatatacatgttttgccagagaagaaggcgagtgagacctcctgttactaagatcaaggaaacatgttgaaggggaagatttttaaaggagcagaaattccattacgccattttaatgtagttaggtaaaatatatggcatacttatccccggggctcacagaatgccagcaacagccctttgtacacagtaggtgctttgtaagtggtgaaatcttcggtccttagctttcttgaagctggctctctgagagggaaaagctcattacatttataaatagatagatgcgagctgtgtcttagtgtagtggatgtggcactggccctgccagagcctttgggaatctcctccctggatgctgatcaagtccctttaatgaacaggctctctctgtggtatgcattgagctctctaaacccagaactctctgaggaccctggactctcctcttaagtatatggtctgatttctctgccgtgtgagtgaaacatggtttgtaatagatacccacagggctgtcattctcattttagggtaagaaagtcgttcccaacatactttgaaaagctgttgtttgctatcgtaaggtgctaaaatctgccttcctctacacactctaataccctccctcctctctcccttccgccttctttctccagtcccccctttctttctttttctgttactgaagtttaagctgaggagggccttgcaaatgctaggcaagtgctcagccactgacccacatctctagcccttaaaatctgattaaataacactgccaaagaggatttagatagcattgaaaagagtgggggggggggttcattttctataaaagataagtattcatacggttagataaactgcagtgttcagtttttaattcattgctgttcagataatgtataatttttttgtgtaatgtcagtttttgtgtccccttttaataaagaatgaaaactcagggtccctctgtgagccctttcctttcagaaaagcagtgggacgcttaattccttctgtaaagttaagaaattaagggtgttttttctctggagaaggagcttagctttgttggtagaacatttgcccagcatatacaaagccatggttcaatctgcagtagtcaaaaaaagaaaaacaaaccaaaaatcaaaaattgagtgtggtgccaaaggctgtaatcccctcagaccagaagtagaggcagtggctacgaagttcaaagccatcccaggcaacataggacctgggctacttgagacctctctcacttaaaaagaagagggggagagggagtggtgaggagaaggaaaagaaataggaaatacattttttgtttttttgggggggggttggttttttgttttttgtttttttggtttttttttgtttgtttgtttttcaagacagggtttctctgtgtagccctggctgtcctggaactcactctgtagaccaagctggcctcgaactcagaaatccgcctgcctctgcctcccgagtgctgggatcaaaggcgtgcaccaccaagcccggcaaggaaatacatttttaagcccagaacatagtccagtgggtaaaggcgcttgcccaccaagccggatggacctacattcaattccccagaaaccacagggtggaagaagaaaacctctaagttgtattttgatctccacatagacctatgacgtgcatatgcctacacaaaaccacacaaaataataaagaaatacaatgcatttttaaaggtgtaagcaagccttaaacagaagccctgagtgctcagcgttttacctttcctactgtggggtctggataagaatggccccttaggctcaaattcgaatgcttagtcatcagggagtggtactatttgaaagtgttagaaggtgtggccttgttggaggaagtgtgtctctggggtgggctctgaggtttccttagtccaagccacacccagtgtttcctccagattaggatgtaggtctctgctattgccccagtgccttgcatgcaagctgccatgataataatgaaccaaatctctgaaactgtaagcaagccaccaattgaatgcattctttcataagagctgtctggggcatggtgtctcttcacagcaacagaacagtgactaaggcccctgttcaaacagatttaaaagcaagaaatggtgtaattatggtctgcacacagttctgaagcaataactggaaacagaccagggtagcaccattatagaggtgggactcagccatcataaagcagaaagggcttatgcgacatgtagccatgtagtatgcattttgttctaagaacacgacttcaaagataggagtcacagtcagggcttgagggggcttgaggggcatgggctctgcacaggtacaacacgggggccagtctggtgaagagtagtgtgcccgaaccttcatgattgaaacggaagtgagggatggtttcctggcctgctcagccgtggaatgcacagacctgggactttggtaacactgcctcatgtttagatggttcatctttgccaactcaataaccaaagcattacgtcttccactgtgtaattgtttctagctaatgagattgaacgtgtgtgtgtgtgtgtgtgtccctagcccgatacatggtatgtgttttatatatgtatagaactagaagatttgtaagccctgtttatttaaactctttatcagattctgaagaacagttcatgtttgtgatctatatcatgaaaaaaaatcttatcctgtgatgtattgcttatttttttattttggagtattttgcctgtagctttaaagctatgatttatataattgtaccgtctgtgttactggtagagactttaaacacttgtggacccgagaaaacatttatacttactttgaacttctgttctttccgtgtaacacaccgtagtgatggacatgtaggtcttcctaagaggacagagcttattttgtccaatggagaacagcctacccatgctttcttgagatagtatctatttaaaattattttagcatactttttgttaacgagtttgacagtttctatgtttataatttaattgtaatttggtaatcaccattgatggtctcatttcattgtactgagataaagcttactaaagttttatacacgacaaggatgaatttccaatgaacctcttagggctaatctctctaggaaatgatggtctctgtcatttaggctttttatacttccttggggtcctagaaatggtcttgtgagattgcaggatagctcggctatataacaagaactgtattgctaatgacatgtacgttaaaatcataaagggactgggaagagagtgtcagttgatggcccaggaaacagagcttgtaagtcttgcagttttactacctggttgaactcctgttggggaggaatgaacactccgtgtcctttaaaacctggtggcttaagatataagatacaatttcctaaacacatgaaactcaagaaaaatgaagactgaagtgtgaacactatgcccctccttagaagtgggaacaaaacacccttggaaggagttacagagacaaagtttggagctgagataaaaggatggaccatgtagacactagcatatccggggatccatcccataatcagcttccaaatgctgacaccattgcatacactagcaagattatgctgaaaggaccctgatatagctgtctcttgtcagagtatgcctgggcctagcaaacatagaagtggatgctcacagtctgctattggatggatcacatggcccccaatgaaggagctagagaaagtaccaaagaagctaaagggatctgcaaccctataggtggaacaacattatgaactaaccagtaccccggagctcttgactctagctgcatatgcatcaaaagatggcctagtcggccatcactggaaagagaggcccattggacacgcaaactttatatgccccagtacaggggaacgccagggccataaaaggggagtgggtgggtaggggagagggggtgggtggctatgggggactttttggtatagcattgcaaatgtaaatgagcgaaatacctaataaaaaatggaaaaaaaaaaaaaaaaaaaaaaacctggtggctcctggggcagcctgtcatctcattactgctatgctgccccctggtggctcataccttagctcaaaggcagtctcttggcaacctgatttctgtgctgtggggagactttgcatcatgcgaaaggatctcagctgaacttggagcttatttgtctctgtttttgtttctaaaaactgttaaaaaggggttcagaaaaatgggcattagatggttttgatttccagattttagaaccaaagagtcccagctaataggagagaaccaatgaatggttgcttatttttaggagttggcacacttgctgcctggaaaggccccagagctggtgctgtgtaggtgtgcagagggagaggtctgttcttgctttccctgaagtccttcatcccgtttgaccacgaagtgaagaggaggggcaagctggacacggtgcttccgtggtgccatgggtgcccacagcatgccctgaagagccgttcattcagaagtccccttaaatggtccctggtctgtaaatagtttgagcttaactagctatcaaagaagcacgagaagggtattttgggagagatgcttaagcttgatttcttctatctgggcctgtgagctgctgctaattttaaacctggtgtcagtccccagggtcatgttccctaaatgaggttctttgttggcttccgtgggtcaagttaagtgtggtgtggtagactttcctcagtgaaatggaagagtttcaaataaccaaccagtaggtatttttgttcctcagtagactagggaaacttactttgtacacataggatataaaggattttatattaattagaaaattattctccgcctgcctgcatcaccttttgacacatggtagtcttcagcagaaagagtcaaagtgtgctttgagatagctgcttttactgtttgtggcaaatgagctaattatggcaccagatttccaaagttcataggtcatttacagccatacttcagagtcaaaacaatatatttgaagaaagaaacgttctttaaagaaaagtattttataaatcaaacatttaatctctaaggacattttgatattgtgtgagagaaggtggggggaggatatatttgacatcaccttagggaatccagagggatccttatcggatggaagataattgttaattacctgtaacattattctcactgtttatccctcattgaaggggcaccactgcctgttacagggtagcagtaggatgtaagctcacagcttggcttgtggatgtcggtaacacagagcgagtgtgaatgttctgattgtggtacaggaggggtcaaggcagggcctgaatgttgactggagtgatgtggaggaaaacacaaccaagttgacaacaggatggatcattgtctgttttttttctttgttctttccttaatatgaaataatagtgacgtatgatgctagttcagctgctgtttggaatgcttggtgtacccttttagactgacaaatcgttccccttctacttccggtgttgttgttgttgttcttgttgttgttttgtgggtttttttcccctgagacaaggtctgtcaagtatatagttctggctttcctggaactcactgtgtagaccaggacaacctcaaactcacgagatccatctacctcaaccccccaagtgccgggataatttttttgagtggtttctatgactttttaattagatatgttctttatttatatttcaaatgttatcccctttcctagtttccccactgaaaactcccctatcctttccccgctccccctgctcaccaacctacccactcctggcttcctggccctggcagtccactatgctctggggcatataaccttctgtgattatttctacacagaagtcactacacagttttaaaagatatcttttattttcatttttgtattttcttgggcagtgttatgggagaagctttttctgcaggatataaaaaccacagcaaatgcatgtgcacccaggaagtctgctcacctccaaaagggaaccagtgacaaacctaatgcttgccgcagagtccgccttggtgaaccaatggggcttttgagggttactaagaggagcacagctgcatcgtgagaaaaacccaccctaagacacgagaaaagctgtgtctctggggccctcagcattacacgcacaactggtcagggccttcccctctaacagctgtttgctgccccgtctgagttcagccttcccgggcctgttacatttactccctgggtctcgtaactgctctcctcctgcatgctacttggaaggctgtttgaatgactatctatatccagatggctaccttagaacacgctttggctttggttgttatggcactgggaactgaagttagggcctcacacataccaggtaagcactctccactggcagtacactatcttcccaacccacttccgttttaaaacaacctaagccagctgtatttcttttttctctaccgcctcagtttacttttgagacagattcagagctacacacacatgcttttatgttcagctaatgaggcgcaatgcgtagacatctgaggtcttaatttttttaaagatttatttattattataaataagtacactatagctgtcttctgacacaccagaagagggcatcagatctcattacgggtagttgtgagccaccatgtggttgctgggatttgaactcaggaccttcggaagagcagtcagtgctcttaaccactgagccatctaccagccccctgagctctcaattttaagagaaagaatggaaaggcacagggtgaagtgcgatgggaatggagaattggaagataatagctctgtgcacatctgctcttacgagaactgctggaatttgaaacattgggtatgctctgacaatgtccagtgccactagactgaatccaaatccaagaatgacagattaacaggcagactgtacaggggtcctgctgggtctgggcacgagcagctgattggttgagtgggaagtgattctcttcaggctttataagtaggttataagactcaaatcccaaggaaaactgtagtgatgagttttcagacagctatgcaaagtgtctcccatcataacaaccggggaagaattttcgagtggtccattccattttgtatctgcctaaaagtgggcagatgcggttctttctgaaacagcgggaaatacctgagcctggagtcttgtcatgcgtggagattggggctttagttttatctttgttggtggattggctctcttggtggcactgttttttgatgtgaaggatttggggttctgtttatggggtctagctatgtcatcaagcccatttcctgtttctgtcgaaggctgaagcaggaagcgtgtcctcagctttacagtgcggccttcatgttttaaaactattatacgtagaagacgacagaagtttgttttttctcctcttccagacaaaagtaaatgtgcttatcagagagagtttaaaatagtgggaggaaaaaaagcagaccattattttataattctgttatcctgagacaacaggaacttaacaaataatgcctggactttcatcccattgtatttatcatgcatttatattagcaaaattgatgttttatagctgatgtccccatcataaaactctaaatatcactataaatatagaaatgggatacaatcttgactaggtacttagtcagctgtttaatgttttgttttggttttggtttggggttttttttttttttttttttttttggtttttcgagacagggtttctctgtatcgccctggctgttctggaactcactctgtagaccagactggccttgaactcagaaatccccttgcctcttcctcccaagtgctggaattaaaggtgtgagccaccgctgcccagccctgtttaatgaatttttaatgtatttctaatttttgtgataaatgatgtcttggaatctctgattactgaatatttatggaaataccctttcatgaaatgtctgggttggggtaggctctgctagcattgggattctctgaagtaaagggaaccattgttcatagtacacggctgcatgactgctttcttgccattatatcctttaattttgccaaccaaaagtcgctcccccctggtacattgagggctgctacatttcagggtcattcaagcatctatgggagcagagagttcaaaagagagaccattagataaactgtaggactgtagggcagccaagagaaagaacactctacagatagtgtgaaatctaagcattaaacactattaaataaacaaggtcaagtggagactggaagatgtcaccaaatgcaaaacttctcagagccaaagtcttagtagtctgggtagaccagaagccagagatgtgcgttttctaaagccagccatccctgaagctccgctaagtaggtcagcgtacacttaactgagtgctttcataagggatgatttttatgtgtgaaccaaagctggattgtggaattgtgaacaccgcatgtagtagcagttgaaaagaaagaccggtgtaaagggtacagcatcaaaaggagtccttaaagcccccgactacagaaataaatatgttgctccttcagcctacattgttcctctaacctttcatatataattttataaattctccttacataaattaactcttcaaatgccaaataagaaaatgtacagcctatatgagttgctttggagaaagcattcagcagatttccaaattgagttaatggagaattaaagattttattcactgaagaggtcaattaggttattgttgacatttatagaacgttctagtaggtttggaaaccttatctgaacttgagacttttgtaaaatgtcagtttgtttcataataaagtgatatgaattattgatttgtatttcattttctaattaacccctaattctgctcttttgggggagatactgtaaatgttgaactgttgtacaggtctttgagacaaggtcttgctatgtagccccggctggtcccaggctcaccatcctcctgcttcagactcctgagttctgggattgctgccatgatgcttttaaacccctgtgtcctgcttaattctggttggtggtagttttttgttaacaccaacactgttttgtttctagacactattccagatggcaagtctatataatggcttcttttgaggatgtataagcaaatactcctaaatgattttgtagttttgcctgattaaatcatctgtatatttccagaatgattgccttagcttattatgcttccttgaagatctggatttcataattaactataaattcattatatggtggtgtggcatatcattgaaaggcttttatagtattaaagagaaaggaaccattttaagaatttgagccccaatattgtataattatttttcatttggttaaaaccaaatagaaagtcctgctgggcttccatcctgtagagagcgtgtgcttagggtctgcctttaatgaagtagaacactgatcattgcttagcactctttggacgccatgctcacatctgggaggctgttgactatctggcagcgagagtgccctgcacagcccctgtgctgtagagccttgtcttccctttgtatagaattctagaccagtcatcatctgactggacttcaatctctaaaaattatagataaatgagagttcccatacctcttctgtctctcaaattatgtaatatttgaagaggaaatgtttatttcatttttattcttctgttatttcttccctattttgtacaataaatccagtaagctaggccatgtattagttcaacctggcttttctagatgatggtggttgttacccaagccgacctgtcttctagatcaagctgtaaagatgttttgcctgtctccatttggaactgcttcactacatctctattgagtgagcaaggccaggagaaaaatgagtttctcgcttctgcatctacagcctggccctggagtctctgaacaaagttgttagcaggtgccaaatgaaaagctaaacctctgtgtagcaggtcccttccacagaagttacctttcccagatgcctaacttcagcatcagctccaggaaaacagccggaatacttgttttcaagcttcaaagcttgcttaagagtaaaggttcatgtccccgtaaagctggaaaattatctttgccctgcattagagagatcggacattaggaaagttacctagaagtgacagcttccatgagcatttatgaagtgttactgtggccgcgctgggcattgggaaagaagctaggacgttatttaaagaataagatgcttaatgaagaaacccaaggtttttattcctttaatgtggctggagtctcgtaatggttgtaccctgtgtgaatgtgggtgagatacttattaggcttttttgttgttgttgttgttgttgttgttaagtcaaaatagtctcggaacaggtaaaggactttgataagtcatcagtgttgactgcctgacatgttaattctttgagcactatccaagtggtctcccccacaaatacaaatagttagattctgttgtatgcgtggatggtagtgaggaaggaatttggaggatgtagaaaagcagaagacttagggaagactcttacgcatcgtcaagatgaagacaggattcaagtcaggggaagtatggggtatgtattcagggggcagtgcttttgtggtcctcgcttgctatagaatggaagatgctggcctgccctgtagcctctttaggagaattcctggggctatcagaaacttcttgatggatttggccttgcagaattcttgttcctctatgtagcccatgtttgatgtgtttgccatgccagaaagatattcgtctctgtatcagtggttctcaacctgtgcctagtcacccttttggggtcaaccaacccttttacagggtttgcctaagaccatctgcatatcagatatttatattacatttcataacaggagcagaattacagttatgaagtagcactgaaaacaatttatgcgtggggtcactacaacatgaagaactgtattaaagtgttgcagtgttaggaaggctaagagcctctgatcaacattaagttgtctcctataatttgatttgtttctgttttgaagcttgtcatcacttagtaagagatggtttgtctacgtctcaacagagagaagtagtgaaatcttaatcttggtgtagtctgtggtcctgagggtttcatataacggcacacttcctgtggtggccaaggaatggggtgggatggggaatttggggaaagccagtagtatccttttcccttgggccgaaacttgaaattaagattttttttttttctttagcattatcgtatagatgttaggggtatcctagatctgctgagaagtgtttgaggagagaggccttgagtctcaggcctaggagacagatcttatgtcccacccaacctatgtaaggactcaaggttggtacacacaccttcagcactcacggccgttctcaccacacatggggtttcttcccagggctatcagtgcaaagaaagtcacatttggctttctttctctctggaaaatgttcatattttcattgactattcaagatactttaaaagagttttcaatattagtgacattactgggttaatttcccattaaatagtctacccaatgctagggatatttgtgacgatatcaaccagttattgattgggtagcctttgagccctggggacatgaagtctgcagctggctgctggaagtggctgcctttgcaaggttcttctgggagcccagctgcttagggagagagtgtgtcaggggaggtataacacacccagaacacttgaaagcacctgggctgtgtccttaggcttggtagtaccattggtgctattaaaaatgggaggttaggggctggcgagatggcttagtggttaagagcgccaactgcttttccgaaggttctgagttcaaatcccagcaaccacatggtggctcacaaccatccgtaatgaaatctgatgccctcttcgggagtatctgaggacagctacagtgtacttaaatataataaataaataaatctttaaaaaaaatgggaggttggaaaagtacatgctgtctttcctcattctagaatcagactgggggttcagtgtgagactagttggagagaagagcggcaggagtgggccaacttaaggaagtcaatgtgagaagcccctctaagcgctttctctgtttgggaacgcctcagagattgatcgtcctaacatgtttataatggaagtggacagaatgcagtgagtgcacttggctgaagagccttctaaagcccaagatacttcaccagacactattccacaaagacactcttagggaagcaatgtcaccagtaacttccagcttctaaacttttaggtcagcggaaaggtttcttcggttaacacgacaataatcactccagaaagaatctagccagtcgagttcattatagtgtgataaagtataacagaggctgttgaatactttgattaataatttgaaaaggtatcagtaggatgtaagtaccaacaagcccctctgaaaatcactacttacagagctcggctgcttcatctgctttcgtatgtagactcagtcactgacaataaccctatgtaggaaatactttgtggttactgtacccattttaagcatgaacaagccgaagcccaaacaatagggcaagcaggggaggtgctgggactaaagccatgtttcatagctctgttgtttttatatatgaagttgagtcttctgctttaagcttttcttacctttctaaaatgattgtttaaataagagtagtagccgggcgtggtgcacacgcctttaatcccagcactcgggaggcagaggcaggcggatttctgagttcgagaccagcctggtctacaaagtgagttccaggacagccagggctgcacagagaaaccctgtctcgaaaaataataataataataataaaaataaaaataaaaaagagtagtatgcggttattaaacaaatcagtgtcagaagactgggaacccagtcagaatctagtataacttagctgctttgacttcccacttgtttcctgcagggcggtgcattagccaaggactaaggttgtatttgttttgtatgtatgcacaggtagaccctgcctactgttgtacaccactggttaattattttaatgaacatacactctggacttacaagccctctctacactcagttgtgggcaaggccatcttcttatataaataaaaggtggatcaagtcctcttctttcaaattatggggatcaatagaagtgttgagggactgagggtagacagatcagcagagccttggccctgggctgcctctgtgtcagcccaatcagcctaagtaagtgtactcttttccatattagggttcatacgtgtttggaaaaagtgactttttggaaaaaaaaaaagtatgtaaaatgattagaccagatgattttatgcttagcatttctgtgattttcttccatgatctgtaagttgtcacatattgtgcacatttcaatattcctcaccagagagattaatggattaaacaagtttgccagcttccctcacgttctatgatggaagtatgttagatgaaaagagaatcagtggtgtctgctgaccagtgactagagcccattgagttattcttattaagtactctcccggagagccatccactgctcttaactttacacatgttcagatccagtttaatgatctgttacccgaggaagatgggaaaccagggaatgggcaacgcttgcccttccacgttcattatccacattgagcctctttgcgttttgaaggaactgatctggaagtctcatggtcctgaccttttcttttgctcccacagaaggaagaattctgttcagaaatgaggcgaacgaatgtttggacaccgttgcatgaagtgttttaaaactgccctgaccatcttgccaaatgagtctctgctcatgaggcccaacaagatgaaccagccaaggagggatagtgtcctgccctgtacgaacagtgactgctgacgtctgagagcaagctgggggtactgaatgttgtctgccaggaccatgaaggaagtggtttactggtcacccaagaaggtggcagactggctgctggagaatgctatgccagaatactgtgagcctctggagcacttcacaggccaggacttaatcaacctaacccaagaggatttcaaaaaacccccactgtaccgagtctcctctgacaatgggcagcgactcttagacatgatagagaccctgaagatggagcaccatatggaagcacacaagaatggccacgccaacggacacctcagcattggcgttgacattcccaaccccgatggcagcttcagcatcaagactaaacccaacggaatgccaaatgggtttaggaaagagatgatcaagatccccatgccagaaccggagcgctcccagtatcccatggagtggggcaagactttcctggcctttctttatgcactttcctgttttgttctcactacagtgatgatctcggtcgtccatgaacgagtacctcctaaggaggtgcagcctccactaccggacacgttttttgaccattttaaccgggtgcagtgggcgttttctatttgcgaaattaacggcatgatccttgtaggactctggctatttcagtggctgctcttaaaatacaagtaagtagagtaaacactcttgagatccagccatgaaggggtttgcacacagggatccagttattggaaatgaaatttaccaagtgttgaaatcaaagcttaggaattccctttcctttccattctgaagccacacacccatggaactaattgaagctcctacagctttgagaggatgatgtatttgttgcctgttcgctacaagattgctccagaattaagaccatgagcaatgctagtctattttcaagcagtaggaaagaaaacacttagacatcttcagagagctgaggctgttgagtaacagagggggaaacacctacctagtcttgaatggtgtttactcaggtgaattgttgccaacctcccacccctgtcagacctagaacctcatcactaagtattcacagtttttgacatgttttagacagatattctacaatgactttgcttgggaaaaatttgattatctcatttaatttaagcaggaagcatggtgcagaatctatttgattccatcttacaggatgtgtggataagtacctgtattcacttttagttggttccactgtgattttcacgtcccaagctctaaacacaacggggaccgcccaaagggagctgtttacttaggaacacctcgtcccttcctttaattaactgcgcttgttcatgctgtctggttgtcttccgagtggaccaccttgtggcattcctggatggtgttgggaattacagtttctccctacccactggatgtaggagcatcagtaggaggtactagccacggcccaagcttgctgctcttgtgccttggacagtgtcaccaaatccacagagtgaaaaaggctatccctgggactgaggcactcatccctggaactgccactctctgtgtcactctgtgtgtctgctactgatgatggggacactgagtttctctgtagtagactgagttgcctgagcccaagtatggctggctattaaaaggagtcatattccatcaagaaaacaaaatgcaggtggagtgttcctgttgaacttttctgagtggtttcctggtgttggataaagtctctcagcttatgaagtcatgtgtcttcaagcagaaggagtaggcccctgctggctttgccaggggaccctcgtccctgtgagaagtcactgacatagcagccacgggtttacttggatctagcttgacaattttataagtgaagtagaagtttgaatagaattgatgggctatgctaccgtggaggtgttggagaaaaaaaaggaaaaaaaaaagttttgctgttgttgttgctgctgctgcttcttctgctactttggttttaagagaagctggtttcagagagagtgatgttcagaattcctgacatgcatgctgttgttgactgacacattttagtcctgtttttcccttaggaacattttaacatttcccctttgccccgttaaaggtccattgaaaatatttcccacgctcctcaaattatgctacctattttttttttcccttaaaatttgctttattttttgtgagtttactttctgggttttccatcaaaatttgtacacacaggcaattttactgccccagaacataactcggtcagtcagactgagtccttcacagaactgcggtgttttatcatttcagtcttgctctgaggaaacgttcaaatcacaggaagagttcatttaaaggttttctttttctagcagggaaatttttcacaaaattgaactttctaactctaaactctttaaactttctaattcggtattctcctggtacttatggccaacaccgcgatcatttatttacttatttattcagattctccagcagcagtaaaccagctgggatgtgttccgcaaagctaactcagagcaggcctgggtccttgctgtggctgtggcttttcattcgaggggccttagatgagccctttcatctcaggagcctaagcctgtccagcaaacagcagcttcccaggcaaggcttctgctgccctagaaaacgtttgaaactggccctgactttgctgggtaaggcactgtgatggaatttgagtttatgtatcctgtttaggcctctgtaaggccctcacttcagctttttcctttggaagcagattgtcgccctaagtgtccccaaccatgactgtgtcctctgtcctctcccagtactggtatgttgcactccaggcatgggtggggccgggcagggcggggcactgatagtgtaggaagtataaggggaggagtatcttccctggctcttatcagaaagacaaaaccttttgtactatgacgttgatacgacaacccaacacctactcgtttctagttaactggctatgtgacactttttttctctgaaccattttggaaacatgggtgttctccttaactttccttgtgtttgactcctatgagtttggcccctctctctggagtccaccagccatgagccatttaactcagcccctcagaatcagagctgtttggctggtattaagttcccaataaagcccaaattccccccagatgattctgactttaagaatcccagagtccgtttcatgccagcctgttccttcttccttcggactttctatctttggagaaaagacaaagttgtcaggaataatgtactaattggaaaatgagaccgctggtataatggccgatatccaccagcaccaagccctttagaaccaggctttcagggctctggatacctcgattctgaatctgtgacattcagctctgtcttatattgtatacagttgtccttcactgtgaaagtaggttctgaagtttttggtttttaaaattgtaaataatgttgtctccccatttagaattggactttcaagccactgactaggaaaaattcccgggaaatctctgcctttgtgtcagacttcactgcaaaccaggtaccccttgttttaagaaagcaccatgacgagcattctgagcttgcagactgtagagccgaggcctgggactctgtgtatggctctccgctaacacggaggctcctgcatgttccctgcggccccactctgtgaggacattgccaacccttgacagagaaggtggcgctgtagtgttcaagtcaggtttccttactaggctgagtgtgtaatctgggtgcctcagactctcctcgaccaaaaccagatctgtgagctaagtttcctaacgtggtctccgtctccaccagcgtccctcagccccatctctagaaacacagatcaaactcatttagcattgtccagatgacttccgtcagttctgtttgtaggcatgtctctcttttcacttctaactggggatccacactgtggaatcagatgaagctcaaggctctccacaatagaatttaagtctgaccttaacgccgttcctccaagtctctgtaaacacctgaagctcacatcactttccattctgtcaattttatatctctctccttttgaattttcttaaaggagaaaaggacacaatgtcccttactcactcttgtatcccaatgcctgtgacagagcgtgacacacgtaaacataaacgtaaaatgtgttcattttaactccatcccttcattcaacttgaagtcagtgagcaacctactgtcctcgagctgtgctgggccccgggagcactgagcaagtagagagctctagtgaggtgatgtgtccgtgcagagtgaggcaggcaggcaccagctgaggctatgacaatagccagtgtaagggacctaggaaaggggagtcagcatgagggctcagagggttggaaatagggctaaagtgatattttcagattgggtaattatgaaaggccactggtgagagaggagtttagtagacacttgagtcaaatgaaagacaattccaagtaggtatttgggaaagagtgttctagatagaaaccatagcaagtgtatgaggctggggtttatttctctgactcaattaagtatttgtaatggcccaggaagctggggagagttgtgacgtaagactctagtgaattatgggcagggcctcaaatggaaccagtagccactggtgtgtaatgctataaacacacttacactttggaagaattatgtaggtcagcagaatgaaatgatcaggtagggcacttactaccaagcctaaacctggaatttggatctcagaacccatatggtggaaggagagtagtgaatcccatgagttatcctatgacctacacacacacacacacacacacacacatacatacacacacatacacatacacatacatacatacttgcatacgtacatacacacacacacacacatacatacacacatacatacatacatacttgcatacacacacatacaaataacatgctaaaaaatttttttaaattatatggttactttgtagataataggatagaacaagttaagtccagagaattgtttgagacaccagttgccatagtggaaaaagctggtttgttacattgtttctcatacaaagctttggatctgctcatgaaaccctggtttttatatgtgacttacagagggaggatcccactaattcacagattctcacaactgttgttgaatagattttctttggaacacagtcaagtagctcatatcctgtgctgtgttttctgctatagtttgggggtcagaccctcccctcagaagaacggggtagtcatttgggcgaggggcagattatctaagtgtgaattgaatatacctagtagcaacccattggtagtataaatatgtgaagaaaaaagaaaaagagtgtcagattacagggtggactcaaaggagctcagtggcagaggtgtttggtgataagtaagagatcatcaggagctgcagggtcacagtgggattagttgctatgtggaaatgatcattgaataaaatctatgaaaactgatcccaaagggaagactaagagacatgattggacagattctgactatgaccatttgatatttgcatttaaaagtatctcacacatgtggttcccagtgttgttcttctaggctgatcttcacagtgctaggatgggtttttagtgtttagcaacagtttgtattctgtgaccagagatctctttagacaaagttagtttgggtttttggtttttttttttagacttgtgtttttatgtacatgtatttgcctgcatgcatgtatttgtgccatgtgtgtacttggtgcctatgggtattggattctctagaactggatttgttggatggttctgagctgccacttggaaactaggagctgaaatctaggttctttgcaagagcagaagtattcttaacactgggcctttcttctctttcaattttaaaaatatgtgtgcgtgcgtgtgcgtgtgtgtgtgtgtgtgtgtgtgtgtgtgtgtgtgtgtgtgtgtatgtgtagggggttgggggaatgtaagcagttggagctgatatctgagcctagcacctccctcgtgctaaaacacctcttctaccactgtgctatactacctcacattttaatctccaaccaaagttgtggtttggggaatcttgtatatttggttgagttttgccaccataagactataacattcccctttcttctaatacttgagtttagtttctgagaacaggctctttggggtgatggccaccagtgtgtgtcagatgctaatttaatcgtataggtctatttgttactaccgcataggactgtccactaacattgcctttcattttgctctagcttacttccttcagtgctttttttcacattagctgagtatcaaagtactcgttcctctccagtctccatcgtagtttatgaccacagatactgtcagcacaacatcttgtctttgatactgatgactaagtaaattcttaaagcacttgatgtagaacatttgatggaaatagttctttccaggtctttattcatgcattcacacacacacacacacacacacacacacacacaaacacacacacacagcaggctatgtattccttccctcaaagaaacagtcttgtatgtttaatattatatacacacagagacacacacagtgttttccaagttcctccatcagccattttctaggatcgggtcactttacttagtcttatgatagaccagaaggctcttttctaattggccttccaacctccttttctggtttagttatttaccaagcattattgcaaagggtataggcaggggtctcagaaatctcctggctagcagagtaacactctacaagaagcaagaagccagtttgcttcaacccaactcactagtcagtgttggttcagccttctggggtctgacccctagtagtttactataggcacatttaagtacagtacaatttgatgaagatgcattctggtgctaattcattctgtcccacatgcaaaacaaagcatagataaatctctttgaggaatgaataaagaagtgagttaaatatagatcagatgttagtgcactgaaactcattgtaaagtccataacgatgggtcctatatattcactgagaagtaagagcttataataagggtctggaggaggatccagccacacagatagtgccaaaggtcaacaagatattaaccctagcctcgtggttctcagcctcgtgggcagatagcagcttatgtattccttccctcaaagaaacagtccgtgcgtttaacattacagtccccctagtgcttgcccatgagtacaaagacctccgtgcctcctacaggtgtactgagggtacagcagagaagttctgtagacatgtgttctaggggagtctcattgatctcatagcaatgcctcagatgttcaatctcaggaacacagactcttccatgtggctgcagtggttttagacacctctcctgttatttgattggctggtaagccatcttagttccctctcggtaaataagagaggagctcagaatagtcctttctatttcttttttcatttctcttcccacgatgtatagccgaagctatctttactcagtctcttttattctgcaaatcttcatccattccaagatgtaaaaaaaaaaaatctttccattcagttcagttaaggggcagattccaaaatagctgttgtttgcgtaacaaatttttacttgcattatatcactggttcaataagccttttaaaatacatggtgctattcttttctctccatgaaggtgactgagacttaaggtctacttacttgtcctgaatcccataagaacatatattgggagtgaaggctctttggtataagtcctctcctgaactttcccactataccacacactcgctgcaaatgtattttcttagcacataaatagaatgaaatgaataaatagagtgaaaacagatgagcagagtgtttttataataacacagtgtgctgttttcatctggaagacatttgaatgtgaggccaggaagttcttgccaaccctgatagctgtcatgtcatgtctgttctctgtacattgtagccgatgtacttagttgggtcctacctgcatgctgtcttgtatgtcagaacaaccattttggaacaaatgtccctaattctgtagtcctgatgtcccaccaaagttgtcaaggtgtcttagttagggttttatggctatgaagaaacaccatgccaactcttatgtaagaagatatttaatttgaggctggcttatattttctgaggtttagttcattatcgtcatgcaagaagcatggtgccatacaggcagacatggtgctggagaaggagctaagacttttacgtctcaattggcaggcagaaggagactatgtactaccatccccatagtgacacacttcaacaaggccacacctcctaatagtgctactccttatgggccaagcattcaaacacatgcgtatatggggccatttctgttcaaaccaccacactaggcctgtccaactttgttatctgactttctgtttttttgaccaagtttgtatgtttctttttgttgttgctgttgctcccttttgattctgacccatcatctctccagactcaggactgagttgttttcccactttcctggggacctgctctgaacccccaggtcacgggtaccctagcttcttgtattctgcatggcttcttctgtttttttttttttttttttttttttaggaatgttgtgagacaaactgtggggccagggagcagattcagtccctcatagtcttacctgggctcacctcctctgacttttttgccattatagattccatgacctaaatagtccaggccataggaattgggtagaaactagatttccctggatagccattaaattaattaatcttagagcaatttgactaagttattctgtattagccttttaagaatcaaattaagatttttatttataacactgaatccaacataagggatgatcttgtgtggagtcaggttaataatggtaagtgatactattttaatatgcccccctacattcacatgttggaacttaatcccccaaatttatgttaatgatctttggaagtggggcctttaggaggtagctggaactaaatgagtcaggaggggatgggctcccacctgtctttgagcagagaggccctggatagctgacttgtcctgcttttctttgtgatttctaacatggaagtaatgtagcaaggaaccctttaccagatgctgatattggcacaaagatatcagactttttagctgctagacagactcatgggcaaataagttatataatcttaccttggtgccatgcttatacatggatatattataatcttacctagttgcttcctcacctgcaagataagaatggctatagtttttctcccatattgttatgatgctgaggagaaatcgatccacagcatttccgtagagtcctttgtgctcaggctgatggtgttcccaactcctccgtgggaaagagcctgtcagtccttcccagtttccaacccaaatatccttgagttctcttcctccatactgtttgtttacccagcacctagtctgtaaatctgagccctctccctgcctctgtcactgccgcacttccactgtcacctcctacatgaggtgtcactggagcctctgttggtctattccccttgggtcagtcagtggtcagtgtttgcaactcccagagagtatcagcgtcgttgctcttctgcctcgggtatcactgaagccattgtcttcatggtggcctaatggttctgctaaagccagcgcttcctttctagaccacagtggccttgtcaacttggcgcagcactttttggttttgggtttgggtttggttttggttttggtttggtttggttttgactttggtgttttgagacagggtttcactgtgtagccctggctgtcctagaattcactttgtaggccctaaatgcagagatctgcctgcctctgcctccctctgagctaggagtttgggtttctggattcattccaccatcttgcctgtagagatgtccaagtgctaggtgagtgccaaatgtcctctagaaagcattgcttggaatttctttgcaagtttggccttggcctttcatcctttggactagcctttcctttgaatgttcctcgcagtagccctgagtgaaagtccaggagttttcctggtatgccttctggtgtcttggagattcaaaggctatatactgagtggggtaagttctgtgttggtgacaagaaagggaggggaaggagagaggtggcagaagtcagtctctgatctctagcaattttaagaccaagctctgtttgaatggagccgcctcagcaaacattttaaatgaaaatgtgaatgcaaaaaaataaaaaaagccagatatggggtggaggggcagtgagcatctgcgcagattaattccagtaaataaatgaaagggcttacagggcaaatgtgtttggacagaaatggggaagggctgtcaggagtaagagacgaagctctaaacaggacgagtatggtcctctggtgctagtgcctctgctgtcagtgctgagatcattggtgttagaaacacacattattttgctttcactgagttgtgaatgggttgttaatgctggaaagaagttttaaaaacataaaaataaagacaggataaaaagaaacggggcttccttagaggaggtcagctctgaactgaatatccatggcaggcatgtagaaagggaaaatacagacagtccaggcagagagtcactgtctcagaggtcctacctacagtagaagggactctgcagctagtgctcaaagaactttggataataaagtagaagttcagagatttactttgaagggtgggagtgggctaggtgggcagtggtggacagaggcgaggaagacctaagactgtgaggacctagtgaggaacataaagtgtgtgcatgatgaaattgacagccacttgatgggttcaaagaaggtgactgttcgtggggtttagggtaatcttactgtggctgttataagtaaacaccacaagctagattcttatcagcaactgcttgtttcttctttttggaggccgagaagaccaaggctaatggatcttgccgggatctctagctgctctttgtaaccacattctcctcatgtggtagannnnnnnnnnnnnnnnnnnnnnnnnnnnnnnnnnnctcctcatgtggtagaagaacgccagccagcactctttgatctctctctcatatatatatgtatatatatgtacatgtatatgtatatatatattaatttattttattttatttttttaattaggtattttcttcatttacatttcaaatgctatccccaaagtcccccagaccctccccccaccactcccctacccacctactcccacttcttggccctggcgttcccccatactgaggcatataaagtttgcaagaccaaagggcctctctttccactgatggccgactaggccatcttctgatacatatgcacctagagacacgagctccggggtactggttagttcatattgttgatccacctatagggttgcaaatccctttggctccttgggtactttctctagctcttccattgggagccctgtgatccatccaatagctgactgtgagcatccacttctgtgtttgccaggccccggcatagcctcacaagagacagctatatctgggtcctttcaacaaaatcttgctggcgtagcaatggtgtcagctttggaggctgattatgggatagatccctgggtatggcagtctctagatggtccatcctttcgtcacagctccaaactttgtctctgtaactccttccatgggtgttttgttcccatttctaagaagaggcaaagtgtccacactttggtctttgttcttcttgagtttcatgtgttttgcgaatctcttaaatagacgcttatctcattcctaagggctccagccttaggatggcatcactgatgatcggatttaagcttgaatttgagagtctcacaaacaccgagaccgtagagacaagaattactctgaggacagattgataccaaaaacagtcactggaaattcagatgaagtggagggttaaggaagagaaggtgtaagggtgattgaataaacaggacatgacacatgtattgtttgaagccttcgtgaaagtgctagattatcagtggtttcatagttattgtggaataaggtgtcttagtcacaggttctgttgctgtgaagaaacaccgtgaccaaaaagcaaactggggaagaaagggttttacttggctcacacttccatattgctgttcaccactgaagtcaggacaggaactcaaacagggcaagaacctggaggcaggagttcgtgcagaggccatggaggggtgctgcttactggcttgcttctcgaggcttgatcagcctgctttcttatatcacccagaaccaccagcccaaggatggtaccaccaacaataggctgaccctcccgcatcaataactaagaagatatattacagccagatcttatggaggcattttctcaagtctctctattctagtttgtgagtcaagtgagaccagccacagataaggaaattatcaaaatgttttgtaaagttctagtccattgaaaatatcacacaaagcatgagatgaaaaaaaattaaattaagtttaaaatctaactaaagtataatagaatcttaactcacctgtgcgtactcaataatgggatttctagtgctgttaagcatgttttttgtcttatgtaattatacttcagtttagactccatgagactcagttttgccttgtatgaaataggaatcgtagccatgcattgctgggtcattttaagaaataaatgagggggggagggatggctccgaggtgaggagcactggctctgcacagcgttcacagcaggtgactcagaaccacctgctatgccagttccaggggtctgacagggcctcttcaggcctccttaggctcttaggcagcaggcacacatgtagtgcatatacatatattcaggtactcacacatatgaaacgaagtagatggtacaaagcttaaaggcaggaaggagaaatttgacaaaatttcccatgtttttctaagcaagttaaagtaagtattgtgataccccattcttagttctgttccatagcctttccatccattgctagcctgtttccctactaagaaggaaggtagtgtccttgtcctcctccttctgatgaagaagcaaatttcataggagatttacagagatgactgaggtcaccaagaaagtctttgttaaaggtaaagctagctagcccgcggtgatggcagtggtcctgctgtggcccagtgatgctggtggtcctgctgtggcccagtgatgctggtggtcctgctgtggcccagtgatgctggtggtcctgctgtggcccagtgatgctggtggtcctgctgtggcccagtgatgctggtggtcctgctgtggcccagtgatgctggtggtcctgctgtggcccagtgatgctggtggtcctgctgtggcccagtgatgctggtggtcctgctgtggcccagtgatgctggtggtcctgctgtggcccagtgatgctggtggtcctgctgtggcccagtgatgctggtggtcctgctgtggcccagtgatggtctgccatgggttgcatgctcgaatcaccttgagctctgcccaggatggctccctctgattctgtatcacactgcatgccatcttcctcatttgctgcctcttagttgtgagtctgatgcttggtccactgttttgtgtatggacatatttgtttctaaaagctaagagcttccagaaagcagtaggtgataaaatctacatccaagaaatgggttagaaacaaatggaaaaagtacaggaaatagtactaactctggagggtcagaatggtcattatctataatttctttaactatgtttgtctttaaaagcttggaaaacagagtaacttaattctgagtccatcagctcagcactttagtgatagagttacaggtcagcagttgaaagccacttttagctacacagggtgtctgagacctgggactcaagaaactgtgtttaggtgtgtgtgtgtggaatggagacaaggaacataccctaaagatgtttttgtgctgatatacttcttcaggcagcccgtgttctactctaagccaagaattatgagtgtcctgctgctgtgcaaagacagcttgcggagccaaatcactttccagtattaattgaactttacagtgtcttcctttcttcggccatttttcttttagatttttaaacctttgtgctaggtgccagagacagtctgatactgctacattcagtctgatcattgagtcacagaatcagattctaagtcctgtttccttttaaaattttcaatgttaaaaacgttcagtagcagcctggggccatggctcagtgagacagtacttgcctgtattccaggcctgaactcaactatgttcacccaaagccccagcccaacacagctttataagtcacctgcactggaggcagcatgctttttcagcaagtctgaattgtatgtaaaatatcaacgcctgtactcatattttttataagcaaatttggtagatacaatatttggggggagcagaaatgagcctgatattcagtaataaggaacaatacttatctgtttgcagatataatctgtgatacaataattatttccaagtgtgagcagataggaatgccgacttttgaacattaaagacatatttctgggcatttgatgaatatcttggtgttggggaattatatctggcatctaactcttgttagcatttgcttgatctctagtgacatcccatgaaccttccttctataattctttttctttttagaatattatttctatttttgaaattataatataattacatcatttcttccttccctgtcctccctcccatcccttttatatactacccctttgttatctttcaaatccatggcctcttttgtcattaattgttgttaccagcatatatgtatatacatatatattccaaaatacataaatacaactgctctgtctgtataatattacttgcgtgtatgttttcaggactgcccatttgttattggaataaccaattggtgtgcttgtctcggaggaagactgtgtctcccacccgcagcagttcttagttgcctggagcctttgtgttaggggtgaggcttcgtggtcttcacccagccacttttcgtgcctgtcgatgccatccctgtccagctcacgtttaggcagtcatgtaggtgagactcacgaatgtgacttgggacattcttaggaggcacagtctcacagcagtctccctgatcctctggctcttacagtcgttctgctccctcctccacaatgattcctgagccttaggtcaggacttgttttgtggatataatcgctgggactgggctccaaggctctttttattttattttattttattttattttattttattttattttggatacatcatgaattttaaaagctttgaaaaagaattctaactgtgtgagattcttgagtttaggacaggagtacaatcctttgaaccatgcataccctgcttttagcatacagccagaccacaacagctcacactgttcatttcaccctggcacttccctcatggtattcttgactgacatctctagactttacttttcgttgtgctgtggctttcattagacttgaaaccagtggtacccacctctgcaagagagctttaagtagaataaattcttagcccatcgggagagatatgaacaggtgactaagagaaacaattaaagtcaacattaatacaatagttttgacccagcttctgaaacatagagaaggcaacaaaatacccaccagtcttcaccagtcctcagttaacttgtgtggagtgtgtgtgccagtgaaaggctgctagaggagcagaaagctgtctttgctcatatccgtatgtatgtatgtatgtatgtatgtatgtatgtatgtatgtatatgatcacatggtactgggttactcagttcctcttatggaaacaacaattagaaaaaacagcccatcttgagcaaaaatagatacagtacacagtacataatggtaagggaaaacccatcccatgttcctaaattttccatttaatttaattcacacttccccagagcaacttgaactttccaagcctgaaagaaaagaatcacaggatgtgattctgccccactggccggccgggagacagttagagaggggtcttgtttaaggatgcttaggactgcattgacaaggttaagtccaagaaacagatgggctttggtgctagaagaattcataggacttgggatattcatgtattcatcccaagaaactagtgcttcttgttcttgttcatattttgtagctgcctgtctattcctgccctgtgtgagggatttccagatttcatttctagagctcttgccccattttatttattctgaggcagcagagttaccaggagccttgtcagggttgggctctgtcttccatggttcttttctttgatggtctcctacgcacactgctgtagcagtttagcggccgacttcttaaacagcagaacatctatagttctcgttctgatgccattctcagcatctctgctgtttggacagagatgctgaacatttgccacctgcgctgcacaggctctggccattctggacgggctccacttgtccatcatttgagcggcagcaacgcagacttaaggcccgtgaggcctgatttgtagcactgtggatcactgtggttccttttggccagttaatggcacgttggttttttggtttttttgttttttgggttttttttttatgtacacctgacgttagtctgcgatgccccatccaggtcttttgctagtgaaacttgtagcactctgatttcaagctcttgactagatttctgggtttgttttgttgggtcattgaaaactttgagtaaatgaaactgcggaatttcttgactgagaatctgccctgtttttccctttttctaggtctattattagcagaagatttttctgcatagttggcacgctgtacctgtatcggtgtattacaatgtatgtaactacactcccagtacctggcatgcatttcaactgttctccgaaggtaaactactcctccctgtcatttcccacttttgtttgtttctcttcttgccctggggaccttagactaaggccaagatgaaaactgattaagattcatttctgggaatgtccctaagctataggaccagagagccacgcccttctcagaattccctagcttcgccagcccctcccagcttagaaccaatgggagctttatatgggagtggagctctttgtatcctgccagactattaaatatgttctccttctgtggagctatgggaatgctctccgctgagacaggcaggcccactcccagcccctggcagtcctctgccaattcgtatgacactgttcttgggaagagcgtggggtcctgcatctgctatcttttcttgtagcccggaaggttttgaacctgtcctttattcctagaatcaagtaactgttacctcagaatagatttttttttttaactagaaagcctttggaatctcatcaaataggaaaagacttaattctttaacgcattaaacctctttagtagtgcaatcaggaaaaaaagctaagttcttgccttgatttcttgattttaatatatatgtgtatatattaaatataagaatataaaacatagacttaatatatttaatgtatattatatatacaaaataaaaaaatactttgagatcatttatcttcattaaatcatgtgctgagatagccaggaacttctggtttcttcccttttaagtctcttcctgccaaagggtcatcctgtcggaggcgctttacagaggggacttcaacgctcactctggaggtttttttattggagtctttatgatagggacttcgggatcctttagtttccctgcgaatcttctctcttcccaaacttagcggacgttctcacagaggtggctgggtactttcctgactctgtccaaggttcactgaactctggagagtggatgtcccaagcacagagccttgtcatcagcccttcttctctgaaccttctcgtgctgttcctcagtccttcccaggaagccagcctcacatcctggttttatcctttgtaaaagcttcccaaaaccagcttgccctgcccagattgtagaattcattctttatttatttaatagttggaaatactgtactattgagagtctagccactcttgttaagagtctggttgataaacaaaatgttctatactgtaaacatgacaattgtgatacacacctaagtgcagttgaactgtttgtttgctttttttttttttccccctaagacagagtttctttttcctggctgtcctggaaatagaccaggctggcctcaaactcacagaaatctgcctgtttctgcctcctgagtgctgggattaaatgtggtcaccagcaccactgagctgcagttcagttccttttgttttgtttgtttgggtttttctgttttgtttttgtttgtttggttttttttttttttttttttttctggcttttgagacagggtttctctgtatagccctggctgtcctggaactcactttgtagacgaggctggcctcgaactcagaaatccacctgcctctgcctcttgagtgctgggattaaaggcgtgcgccaccacgcccggctctgcagttcagttcttaaaagaatctgtatattggtaaagttgctgcaaagaagtagaaagatgtggattctgaaggtaagtcccccatccagggactgctttcccctccctggttctagtgctgtgcctttgtgagggtgtctgcatctctactcagcccttcgagtccagagaggtgagccagagtcaccggtgtacctaaccacagtccatggctaagaatagctctcaggttttgttggtagaggcagagatcacaggcacggcatgtaaactaactcacatgtgtcacccaggtgttggccaaaactccaaactcgtgcagtgattcttcggcaatcttccttctagaactcagcatcttaaaaatgaacagtcgaaggtatcttagcacacctttgtgaacagtagttaaaactcagactgacttattttgtagattaagaaaaaagaatttagaacatagcttttatttatttatttttttaatgcaagatttagcccagggaatacaactttttattttgttctggaattttccagtgcatttagtgtagagagacgagtgtaaggacatctgttatactcaacactcagattcacttcctgttacaacttgttattgttggttcgtctaccttttttttggaagtgtctatatcaccacagatgtagcatgcactggaacactgggcattttattgcattatactcttggtagtcaacagaattaatattcctttgatattggcagttatcagttcgtggaattagtccacttgtcttgaaggcatttttgatggtctgtttgcattcattaggatccagactctttacgtgacagttgctttgtctgtctgtcagactctttctcctcatggcagtgaaatatagagtgcagacccttggtcctgatgccacccacattcaccagtttcttgtgatgtcagctcacttgttgctctccctcctccatactttctgtcaacaggaagttgtctttgaatacttgataaggtttggttttagcaagtttggcaggaattcttcatggagagaacataacgctgtctgaatctagatagaagagctcgatagaaccctcgggtggcagatcaagtctgggaatcagtgttctgccagatgatggaatgatccggtatgggccagtatccaaaaggagagagggatggcactcagaggtctcagagactagccctgcccattttagtcactaggggaagggaatcagaatcagaaatagcctcattgaaggtcacttgttgtcaaaggcctcttcaccaccaaactgccatcagcctcgaagaccaaagtgggcgtggtactgtcatgttcttccactgagaactggacagtctgcactaagcagctctatgttttaggagctcaggtacacgggatgagccagtagagatgcactccattgaaagcaccctaaaacttgcctggttcaggctcatacctgatggaatgaaattttggaatggtaccataaaaggatcaagataagtcactaaccctgaggatgggaaggaaacaccagacagctaggagcagtgtttgtttatgaggtcagatggcagtaattagacaggaaagacagagaaggacttcagtgactgcgtttaccactagaatacttgtaagtgagaagaaaaaggggatagtgactttgggaagaatacatgttcatgggagacagccaagtggtgatatttctgatggccaggtttgtaagtctcaagttgaaaaccagggctaggatttatcatgttctgagtgatggtaaaacctgtaatatagatgcaaagtccacagacatagaatacttagtgcttatagcacgacctggatattcaggatctgaggtctcttcaggcctgatattagtaggttcccttaaagtctcacttactactaaacttaatggaagtcagctaagctttatgtcagagctccgctgagtgaggaacttaaacctggttccaccgtggggaatggggttccacactcacccctatactagtcacctgatactttcctcagcatcaggcttgaaaacggacagcttatcagaaaattgttgcagcgaatggacaacgggcatggtagaagtcgctctcaggggagtgttcgagctttagcctcagtcatgagacagtgggtcggcaagtagagcaggcctcctgtcagatgttgctgcaaccgtgataagacactgggaacacggagggaagggaagtggatctgcttacttcctgaattaaaaatgaccgaagcaccttcctctacccatgcgggggttgtgtgccgggctgatgctggaagctgccagccctgttaacacagcttttcaacaagagcttatgcgggtctcccccaccttcctcttcctatcacagctgcttaggatttactttaaacaaaaaacaaaaaaacaatatagtaacagatgataatctttgattttaggtcagtttgtggtttgtggttggggggttgggttgtttttttttttttaactcatagaaaaaacaaagcaccctgttgtgctcactccccagatgtgcactccccagatgtgcactccccagatgtgcactccccagatgtgccccatgataacttttgggcaagttgagctggtgctgactactaagccttaacctaagccacacgctgattctattgtggtttctgtgctgaccttagatatcaaaacggagatgacacctcagccagggcatttggcagaagaatttcatttgaattttattccgaccgccaaccaacgggtccccgtcagacagggaccttgttcgtgtttggtaccatctgatgcttcttgttgagtggggcagctttgggaagaccttcacagtttgtgtgtctgctgctctccccttgtctcagagtgagatttcaggcatcaaagccccctggtcttgctgctgatttcccttagatgttggcctcatggaccccctgccttggacaagtccatccttgcaaggcagcagactctgcttcttggcaatggcaattgtagttatacctgttcagaggtggcagttggcatatctcacaagcctcccacactgacacactttggtcgtctgatgagcctttagcgaccttgtgaggaaagagctggttccaatacaaaagtaatttggtatcacagagttcaatcatgcggagctttggtagtctgattagcccttggcagccttctgtggacttcagaaagagctgattccattgcataggtaatttggtgtcaccgagttaagtcacatgaggcatggggacgtgctcgcttttgcgcaatcttctctctactcctatttcttgtcagtataattttccttttttgttttcactttttttctgtttctcttttctctctgttgctattctctcttttcacttttaggagcaacagtgacagcaatgtagtaaaaatttgtcttttaaaaattacttttattgtaaataaattttatggcagacatactgaaagtatgtactaaagagaaatttttaaaattcatatttcaatacaatagtcctttatggctgtttttctcacaagtccaactctactatctgtacatttatcactttggttaaaagttgtatttgacaagtgcactttgcatcattttatagctccttggcagctccagtttccttactgaggaagtgtcgtcacttgctcagattgcaagaaaatgcagaattgttgatatgatttcagttgattagaagagattatttttccaagcaaacatctctggagaacctgtcatgggtagatatagtgtggaatattaaggtcacaaatgtacatagtaagtgtcctgtccatccccccctcactccctgggcctccagagctaagggtcctgtgtgatctaacaggtcactccctggcttagtcattccttcctgtatggatatgggggttctggttgccatggaagcacagaaaagcagccactgtgctgggcgtgcatgcagctagaggtgtgtctgagccaaggctcagaggaacaagtcagagtctgccaagtggaagcagcgagaacattggtataaggggaccatgcaagggaatttagaataacttgaggttgagggaacacaggggtctggtcgtctggtcccagtggcctgagatgtagcaggcaggctgtgggcagatttaaagggccttgaacccttctaatgagtttggatttccaaaccatagaaagtcaggaaaggttttagtaggaggttttgatggactgacagttgttttttaaaaatacatttacccagtaatgcagtgggatgtttgggtgagagggatataggctttggttggtgctaagttgtgttatccttttttgatgtccacccgtggtccacaatgtcttgtcctcatttagttctcaaaacagtgactggaggaactgcattaagttcagaggcaggtggctctgcccagtgtttcagagtagctagggagcagagacaggatatctatctggccacacatctgtagtaggtaatgcttgttcatggtcgtgtgaactagaggtgagggatgtccaagccaggccctgtgttaagggagacactggaaaggcaagaaaagtcttacagatattaggagtcatacaccatggagactataggcattaaccagggagctccagacagccgcagaggagactttacccactggctcagggtgcaagaaggtgggcagtgacattttcaccatggggaatgtctcaagctacctggacacgagaggccacccatgagcactctaaaacaccaggctgtcatgcttgggagctctccctctggctgtgtcattttgcgaagctttgtttcttgctttggcagtgctgaggttcgagccccgggcctgtcacctgctcctcttctccctgagctgtcctctcagtcctcagtggttatgcttaagacagtttgagcatgacgatatcagactgtaaaaaatcaaaaggggctttatataatgtcagaggcgacttaggaaaattaataaatgtaaaagaaatagatgactatttggtagcctttgaggaaataattcaaaaatcataatctataatgggtatgtactgaagctattaggtgaaggttaaggccaataacacttatacagctttttaaattcacatttcttattaactataaaggggcaaagataacatatttagtagagaagtctggcaagcattgcaatggccggggtggtcacaccagtagctggacaaatggcaccagggcttcttcgcaggtgcatggggtggagaccacagccgttgtgtttgttccgccaacagcatttaatttgaacttaagcagactgcagcattcggagaggaaccgaggagggagatgaacctgaaggtgtgaatatcacagaagaaaaccacacagaagaactctagtggatgccgacagctgagcatgccaggccacctcagctctggcctctgagctgatcctgaatcagccgggaaagggagatggagatattgttggggctgttgagggctcagacagagactatgaagtgtgattggggttgaatcattgcagatttcatgagcctgattacaggagagaacttcttattttggactttggagtgaggtattttgataaaatagttacagttgataagccaaaatgaagggctttcttattcattccactgttctttccatataaaacattttaaaataaaagcatgaatacatttttggtaacctccactcactaactaggttgattagaggacttgaacactcccacccccgaacttagagcaatgtcattttggtaaagggacatattgctttaaacactggagtgtaggtaatagctgatctatatttaaggtttttatgaggcctttggatactgtccttattaaaggatgtgaaaaaaataatgtttttggctggggggacaggaggctagtggcagatgagtgttttgttgctgatgttgcttagagacctccactcacccagaagcctgctcaatggaggaactgatgcaaatgtttgagaatggggaagggccaaaccctccacagccaagtggaattagaactcttagaagccatgtagtaggaagagacagtccagcgaagcctttcctgctgctaagtcgtggtgggtggagtgtgtttgtagagggaaagcctgtctcttcagggctgggagagtccaaaagtgtctcttgagtgatcaggagatggtcacaaatgagcatccctcagggctgctgattcaaggagagccatgtcagtttatagcctttgagcctgagaccctgtcacaaactgccttacttgttagtagtgacgttgtcttcaatttctgtaatatcagcaattactttgaaaacaactagtacccaaggctagagttgaagaaatgattcctgcttggttaacttaaaaactgatgttggactcatgacattcttagggaaaagaagggagtagagaggaaagaatggatctaaacacattatatgcacatatgaatattaaataaagtggtttgtgggggcagagagtttccagaccaagtgtctctggatagccctggatgtcttggaactttctctgtagaccaggctgaccctggacttagataatccccacctgcctctctgagtgctgggcccagaggtgtgcaccaccaccaccaccaccaccaccaccatcaccaggcttaaagtatctaaaataaagtctgaggtagatttgtgttcactgttgatcctggtgtgtctggggagcccgtgagatggtttaacacataaaagcatttgtcatctacctgtgttcagtcgtcagagcagtgggaaggtggaaggaaaggctcagctctgcaaagctgttgtccagcctccatgtgggtaccacagcacacccatgcacagccaccccacccatacacgcaattatagaaacaaagtatatttgtgagccagatgatggtgcatacctgtaaacccaacactaggcaggtcatgagtttcaggctagtctggaccacatgatgaaaacctgtctcacacactagtaaaatctcttagagaccagtatagcatcatataaagcaggagagcatgaaccaaattgagattttaaaatgcataggaaaggtaaaatggatgaaattttattagaatagtagcgaagtgtgaacctggaaaggctgccccttgctgtttctgaaggtgtttacagccataacatctcctaggtagagagatcccttagttctgatccccagtcagtgtgtgcatccttgggaccagtcggcagcctctgtttacttcctcttctgccagatggacaacataacatcattattagccagtgaacaggcttcagatgatgtgatgagacagttgatgggaaaatctgttaaaactttagaatctctgtaaagaacacatggtcctttattctgtaacaccaccccaccatgacgaggagccagtgaaacaaagcaaggggaaagaatcagcagctttgagcagctcctcccgccgaggaatctagagggatctacccttccggttgttttatttcccactggggcctaaagaacctttcatgtcttcctattaatttgtaaatatctcttcttggttttggacagcagcctgtccatcaacctcagggaatggcttgcttcacaggcatttggggagttggctgggggagatcttcaagcgcgtggatttcttggtggcgggctgctccaggcatgatgatgaggtcttctcatctgtttctgtccctgctgggtggccccttacctgccccgctgttggtttgggtctttaaggagttttcagggacatgtgctcaataaagaattttctgttttggaggaagactgttgtttaggaaccatacactgtaatttgccagagtaggtagatcccataaataggttccttaaatctttatacgggatccttggcagatctgagtagcacaggaatatgacactaacagtgtgctcatgctcctgtgagctgcttgggcttctgcaggaagagttattccgtatgaattcagggcttggtttaatcaaactctgggcatggtggttggcacagtgctctgctaataatgtggccgtgcattgtttagtgacaagggtacgttttggtgtatgtcaccaggctgattgattcttatgcaaactccatagccctgagattccttctgtgctacaaaactaggctcatagcacgagacagctttgaccattcaaggccagtgtaacctgattgcagtatgtatacgtctaatcctaaaaggatacagtaccaactataatggggcttaggacagtcaccatgaatggcacttgctggcctataggttgctctgggagggccacggaatgagtgtgaagtcctggaacatgactgtgtgctgctgtaggcctaacagacactgcacagataggctgtgcatttataaaaactgtttaccctctgtaataagttgacactgtaactctttataaagttttgatattaatattcttttgtaaggttacttaccttaaaatacattgtaaaactgtacaaaaatatacagatacacattagcttaagcctacagcagattccctatagacaggaatccttcagcactctatacagaatccccctcatcactatacacgggatgccctcatcactgtgcaccgggtcccctcccccacactgtgcaccgggtcccctcccccacactgtgcaccgggccccctcccccacactgcaccaatcccctcctcacactgtacaccaatcccctcatcactgtgcaccgggtcccctcccccatcactgtgcaccggtcccctcctcacactgtacacaggagcccctcatcactatcgatgttctccacgtctcttgaccccggccccatctgggctccttttcctatttctttttcactcttaacgagatctcaccacatgtgtagctctttcttcctattttcctcttttactagtgatatggcaatataatttcttttctgtaattcttgttgtttgtttatttgtttgttttttttttcctgcacagtcatctcaggctcccaagtgctcagataccaggcagctataggtgattacctcatctggctataatttttggtttgaggggacagaggttcatggtaggctggctttaaactagcccagaatgcccttgagctctgatgttctctgttattaatttcctgctgtggaacgtgagaatttcctgtcctctgtaccttttccttccttcaccctgccatccccggggcacagagcatcttgtcctgtcttccctctgtggttgtgtgtcctctgtaactcagaagacagcacttacccagttacagctctgtaaacactcttcacccttaagctgtgtccctttcctataattactgtactgtttgtttcccacggagccagtttttgccttgtgttttctttagtagttttctatatatttacccatcctcggcttctgctttctagtccagtgtcatggccagcccgtgagtctcatgcccccgaagacctctgtaaagcatatgggctgggcactttgtgactcaatgttagagccacatagcactgccgctctttcattgttgccattctagaaaggcctggttctatctttctctttacttattaatttgtttgtagaatgcatcctctgcaggtcctggagaagaatatagacatggcaaacagtctaaagtcttatgtatataaaagaaggtttagttacacggctaggtctaaaacctacactggaaatcatactgcttaaaatcttggagccccaccccaccttccacccttgaagcaatctttttttctagagtgctctctaagcgtcatatgcatgtaggtctttcatctaaagctcactataatctgaggacttcgatgtggcagtactcagttctgatgtactacaacatgggatctttcagtgtagtctacttccttctgttgtgctgagcattttaaggtctctttgaatcggaatgggatggtcatatcctctgtgtggtctggcagcttgctcttccaaaatagaaatcctaattgcttttttttttttaaattataatgaaacatgcattttccaaagctggggtgttagcaattagatattgaaaaggggattgtggtgattaaattggccaactaggatgtaaaaggatactgcaggggctggaaaggtagcccaatggttaagagcacttgtggctcttacagtgtttgatgttccagcatctacacggtgacttagagccatccataactgctgttccgggggaccctcttctgacctccaggggcaccaggcacacacttggcacacatgtatacatgcaagcaaaacatccatgcacataaaataaataaatctctgaataaaagggatctacaaaagggtgctacaatcatgagatacaaacatttgcatgccttctttgatggaacaaatacaagttaagcaagtcatttaagtcatttattactcgagtgtccagcccagacttgcatctcaggcagttagattactttataaacttctcttactaaaaggaaaactagccaggtctgcctgtgtgatttcagagggccgaaggtacatcgttatgcttttgacccaccagcttccagttagctaataagtcagaactgccatcctttgggcagaaacacatctgtaaataaatgttcgctcaggatttacactttctttttccaaagaaattacggcaaatcaaccacaaattctttctggtttatcgtggtaaagcaagttggatggaggcacatggcttagcggtagggactagcatgcttaaggccctgggttagaatctcaaaccccccgacacccgctgaaatgtgctgttgagaaagttcaccacatgcattctgatgaggattgtattgtctgtgtctcgatgatagcaccggtcaaggtgaactaacgatgactctcactttctctttttctggtagctctttggagactgggaagctcaagtgcggagaataatgaagctcattgctggaggtggcttatccatcacaggctcgcacaacatgtgtggcgactatctgtacagtggccacacggtcatgctaacgctcacctacctatttatcaaagagtgtaagtctaaagcaaccttgctttgtaattgtctcacctgccacgccccagggtcctttggaaaatcagtgtgggcaaagttccttaaagccagactgaggcccgaggacagctgccttatcttatccttgtgcgcccaggaaagcacttggctacacttctagacaggaagtaccttgtctgtggatgtcagctataatgtttgggtggttttacatatatgtaaatagaatcatttatatatagtaaatacattttaaaaatcctggtgggagggattctatctgctttagaccatttatgttcccagattaaagacagacagacagacagacacacacacacacacacacacacacacacacacacacagcctttatatttttaaaatatgctttaggcagcacaatagctaggcagctgcctaccctccatgctgttagaatctgcctccctaactataaccctgaattatcaattactatgtttcattgttccatctgggctgctctcagctctaattggccagcccatatgaccacgtcttctttactcctactccatgacgtctctctctctctctccctcttgtatgttcttcttcttccatggccaatccttcctccttcctctttcctcctgctaggcccaccaaaactcaaccccacctatctctcttctgccagctattgactgctagcatctttattcaccaattagagttgacttggaggcagggtcccagaggctacatgcagactcccaggtcttgggctccccacttaacattacaataaacaataaaagaaaaccccaacagttacatacatgtatatgcatatatgtgagtgcttatatatatgtgcatatatgtgtatgcatatgagtatatatatttgtatatttgtgtatatgtaaatatgtatatagatatatgtttgtgtgcatgtatatgtgtgtattatcttaattaggggtttattgctgtgatgagacatcataaccacagaagcttttatgaaggaaaatgtttaattggggctgcttacagttcagaagtttattcgtccattacagctgtggtgagaagctgggtggtacacaggcagatgtggtggcagagagttaggtgagagttgtacatttgaacacatgggcagtggaaagagctagtgagccaccaggcctgatttgagtttctaaaaacctcaaagcctgccaccacatgtggtttggatatataaaaaaattaaatataaaaataaaataacttgtatataaaaataaaataaaaattttgaattcaaacaacacatataaacatgttctgttgctttctgctctcaggttgttttgagacatgaaacctggttcatccattttaattgctgttaggatttcagccctgtaattgaacaacagattacttccctggaaaattcagttattcataatttcactgttagaagctgttcagtaaggcagagtgttagacaaccggggggacacagaggatggacacagaccacagtatggagttaggagcattgtagctcttgaaatgtgtctgctgggagctgggagtagtcctgaagaagaaaatggacaggaagcagcgcccaggtcagaaagagcccgagccacaaagcagaggcttggcttctgtctgcggcagatggggacacttagagtggttgggaacaaggggacagtgtcagctgagttttccttcagagaagtagctttcaagaagttctagagagaacaggctagagaccaagagacagtcctcagcttctgatgcaggtatgcagaggaggtgtggcctgacctgtccgtcacccttggggtaaagtgcaggccatggaagagcttggtgaccacacacaggacaggcaatacggaggagacaggaggacgcaggctgcccaaccctgtcgtgaaccagaaggaaccgttatgaagtgagatgttctgcaggggcctgagagagagggagaagagatgtcctgtttatttactgtgtgatcgactgcagtgaattctagaaatgtctatccacagggcatctgacctttataccacaacataaccagccataggaagtggaaactttaggagtcagttgctatagggcccttgggaataagggtgctcgccccctactggttcacacctgaaattgtttttcatgttactggacagtgcggagaccttgcaggagtcacaaaaccctgatttgggatcctggaactatcggcccctccccgaattctgactgtggggaaaatgtttaatctctatatgtctttgtttcctcatctttaaaatgagtctttatttcatgagtgaggaagaggctataaaaagtaaaataagtggtgtgcatggatacgcagtgaggttcacagaaaatgtgtagtagctgttcttggtgtattgttaaggtatgaatatgagtggccagtttctgcccccagcacccaatttaaaattgcaaaaacaaccaaaggggcggggggacctctttcctcctcttccttctgatcccctcagcttttaacaactttcacctttatataatatgcaactctgtagttatagtgtcttactctttgtctgtctcgccttctggcaagggttccccccacagaggcacgcctttgcttacttcctttgttgattcagacatcttgagtaggacctgtccagggaaaggtagatgcgcccagcccgagtgaatgaatggcagttggatctcttgagaatccagtaaaagttggcaataccttcttctccaaaatcagggcagtagatccattcagagctttgtctgaaaccccacgcgctctagacccctacgcattgagaatgtggagtacaaatctcaccgtctttcggatgagtgtgtagttatggaacctgggaagcaggctggtagctgtagggattataactgcatggtccctgcctaagcatttgtggcacaaacatgagctaaacaaggacgaccaaggaacatgccaaactagatggggaaaagaccatgaggttccaactctgcacaaagaactacagacaactgagtaaagatggaaacataagaggcatccctctccagggaagagcacagcaaacagattgtccagcatcaaaccattggccatacaagaagttgtatatagactcagcaggctataattaggagtgtatagttatatgcagacacatgaatgcatccaataacaatcagtgagaaaagaggccgtaattctgaaacagagtgggaagagatgtataagagggagggtttggagggagcaaagagaagggagaaactaaattatagtctcaaaaacatacatttagaaaaggaatatgtggcacagtaggagttagatttacataagacactaacctcagtgtatccataggttgcacttaattaatggccattggacagagcctagggccagagctcagggcgtaaagtgcctgaggtaccaagctaagactgtgtgtttagctccttagcacccacagaaataccaggtagacatggcagcatccttgtagttccagagctggtgtggaggtgacaggggtcccggcagcaagctgagtagttagactagcagactcggtgagtgagctgcggtttcacgtcgagaccttcctcagtacataacatagcgtgatcgagagagcagctcagtcaccaagctctggctcctacatgtgaggcatacacacagctgcacacatcagtgtctatgctcatgcagacatgcatacacacaccgcagtgtcaggggaccatcttttaaagatggagctcaacgcagtgacctgtgcatatttggtcatagtcaccttttatgttacgtttttgcttatatgaaataagttatggccctagataaattactgctgctagtcatatttcattaaaagccacttccttctatcccaagttatagagaaacaaaaagtcctttagtttgctggcccacaaaaatgggctttctggaggaaaggtgtaagatagtcggtcctccagaatggcggaggcgtgggtgagtggtattggtggtattgggtgagtggtatttaggaccgggactattgcacatgtttcctccttctagattctcctcggcggctctggtggtaccactggatttgctggctcctcagcgtcgttggaatcttctgtattctcttagcgcatgaccactacactgtggacgtggtggtggcctactacatcaccacaagactcttctggtggtatcacacgatggccaatcagcaagtgagtcgccccttccctgtcatcttaacttctcctgtctcagtcttggtgctgctggctgaggccggagtaagaggtgttggaaagacggggaagctgtgagtctttttcagtttctctttcttcggaacaaccacctgaggtggtgctggcttttatagcaccattcctctgcggagccagtgtgtaaagtgctgatgtaattgacacagataccactttcttctgaaacgtatgtgcttactatctgtgaaaaaaataatctccaagatggtatccgcacttacggtgcattcctaacctttggttgtgatgggcccatcactagtttcatagttacgtttaactaaggtattaaatatattttatctattatatttatatatgttatattattataacatttataaatatacatttattatataggagcacaggaagttaagatccaaggagagtgaagaaagggctgactgagatatttagtaggtacaaattgagggcgtctcagtttcccttgctctcctggaatctgacgtgtccagggtatagtgtggtgaactcagagtgaagcccggctgtgtgggtgggtgtggagcaagtctgggatcctttgaattttaacatgggaaatattttaaagggaagacagtaagattgaaaaacaaacaaacaaatgtgtatgttctttgctttcctaggtgcttaaggaagcctcccagatgaacctcctggccagggtgtggtggtacaggccatttcagtactttgaaaagaatgtccaaggaattgtacctcgatcttaccattggcccttcccctggccggtagtccaccttagtaggcaagttaaatatagccggctggtaaacgacacataacagctctgccgactagggaatgaagaacagtccgaagtgctaagaactccatgacagaagatgccataaagtaaccacctccccctgctatctctcaagttaccttgacttaacctattgcgttacctgctcagcactgtgatctttttttttctctccaaaggacccgcgttggacaacaataaagaaaagttcccacatcatgcactgtagacatttcctgttgttaagcttggggcttctataacaggcagccaccgtgtccctctgtgtcattcagccgcaccaccgtgtgcttctgtatcctaagctccggcctttccagccatatctggaaataaagtgtgttattttcttgggaaaacatacttttcatatctcttgccccaaagacagggctgtaagccattttctagtaaatgtctctatgaagggtcctaagtgtctgcatgggagttgatttagaatctctctgcctattgcactgatgctcggctgaagacgataggtccagagaggtttgctcgcctggggttttatacagtcagcagagacggtgtatcaaaaagtgcaaaaaaaaaaatctgttataaagtgatttttctaagtatttcctaactttatttttcaaaatgatgttatgaaaaccaaatttaaagatttttacatgtcacagaaaagagagttaacatttaaaagtgcttcttgggagagaaatttgtctatgtttctagtgcctttcttgtcttgattgtatggtcggttggtaggcaatcttaaatgtttttatttattccatgaaaatataaatgtatgtatacactactaaattttacatttatagctaaattaaatcagaagactgctagtggttttaaaattgttttgaactgaagaatagagggtgtgaattagagtacgcacccattcacatattgtgagcaggccgcactgccaggtgccgctgagattatgccatctgtttggtagtttggttttaactactcaataaaaacagccatgaatatctttttttaaagagagtttcgaaaatgatcacttacctaaaacttgaaagctataaactagttatccatactctcatgacagttttgttggtgaacaacaacaaaaagatctatttctttaaaatatatttgtgcagaaactgcatgtaattctgagttttcctcctgacatacatatgtttggggaagtattctactctatacttgccaacgtggagaacaaaatagttttctaagagcgaagaagtatatatatataaatataaatataatatccattctgtattttatgtgcagcaggattaccttctgtaggtttttttgtgtgtgtgcacatgcacaagtgtgtgtgcgtgttcatgtatgagtgagtgtgtgtgtgtgtgtgtgtgtgtgtgtgtgtgtactcacaaggtgatatttgtattgtaaaacaataatggtgaaggaaataaaaaggcttttaaatttttgtttgttttaaatctttgtaaagttattattccagagagtatactgatatcttacaacttacctaaatcataaattaatcaaaatgcactttttaataaaaacttatactgaaagtatgtggctattatattgtgttcatcttcacataagtcaggaagctgttaaatcaatgtaggaaaccaagccccggatctctttagagcttgcttggcccaagtctttattaatcatctacctctccatgcaggacttttacaatgtattttaattatcaaaacacccctgcatgtttttgttttccagtatgtaaaaggagccacagataagtgaaaaccaagctgttaccactgaattctgccaataactgaattctccagttctcaaccaaatcgctcactttttctctgtaatggaaacagtgtagcctttccaatggagggctggggagggtctgaaaggacctgaagtgcgccatgtggacagttcatggctcagcaaactcttcacagataaagatggtactaatcctcgatttaaagcaaggaagggcttaagagaagtggcttcttgtctgtcaaagggtagccccggagaggcaggagtggagccagtagcgcctgacagcggggagttcggagactgtgcctcccaggcctatgtgatgaagtcttccagcaaacctatcaaaatgccccacctggcccatcctcacctccctggggttggtgttagccagatgctatgtactgaaaaggaagcaggatggatatcgatatgaattaccaacacatgttagaaacgggctcttaccccaccctcagggtttttgttgtggtaaaggagtggttcttaatgctgcaacgctttaatgcagttcctcatgctgtggtgaccccccaccagaaaattattttgttgctgcttcataattgtaattttgcgactgataggaatcgtaaatatctgacacacaggatgtccctgcacaggttgagaactgctctggttgaagcctgagccaggcccttggaaataatacaccagtagctgttccctgccctacccaccaccatttctaagacgagggtttcatgtaacccaggttggtcttgaactcctaatccatcttccccgcaatttccaagcactggtgtcacaggtacacaccactccttccttccctggcctctcttgtaatttttgttttgttatagggcctgaagttgcccatgctgaccttgtactaactgtatctcatggaggcttcaagcatgtaagacacttttgctccagcctccaaaataacagaaaggagtatgcctgccattatgcctgctgaaacttaaaatgattatgttaaaaatgcatacttaggagtttatttgccttgtatgtgccaggaaattaccttgtgtggtttatacaagtatatactgtttattgagcagtacacccctgtttcctctattaaggccgtttgttcccctagacagttgtttcatttttatacacatatatgattctatgtgactacaaaatctaggaacacaaatgagagagagcgcgtgctatttctcatcttcaaacaggcttaatttgcatctacctgctgcaaatcccaaggaacacaaagagcaatgttgtatcctgaaggcaacagtacaggataaagacaggataaccacctgcagtttctgccctgtttgatgagctgaatccctagaaaactgctacagttattttacttgtgagttaagcatgctacatgtgttatcttggtaaccctcatctaaccacaactgtccccattttatgagtaaaccagccagtgactaagaccagaggcacataggtagtaagaggagtcccaggcagtgctgtaaggtatactgaatgtgggagcaacctctgcagtgggagaaacctctgcctatgggagtcagagtaagttcaggactgttaaaatggcctgtgtcacaggaggcgcaagggaatttcaccagtttgctacaaatcatgtgttttatttgtgtctgaagcacataccaggcttgatcagtttgatgtttcacaagctggcttagaaccacataaaacaagaatttatgctactgaaagttgacacccacccccattatacagaaagtcaacaaggttttgaattcactccagatttgtatgctatgcaaatcacttaagaacctttatctttccctgtggtcagggaccttacttaaagaaagtagaactcttggcattctgcttattgtcagctctttcagagtacaggttagaaggaacttatgtgacccttgtcatcaaataaatttgatctcagtaaaccagctaatgcctcctttaaaaatatatattttgtcagcataataatgtgtacttgtagtcccagatatctgctcttgaggttgaggcaggaggattatttcaaatctcagaatgccttggtagcatcactgagagttgtttcacttagtcaacggtcacaaccactcaagagcattaccagtatccccttaagcaagcagttatcttttagctcaattaagaattaagaagtagggctggagagatggttcagcggtgaagaacactgactgctcttccaaaggtcctgagttcaaatcccagcaaccacatcttggctcacaaccattcataatgagatctgatgccctcttctgggttgtctgaagacagctacagtgtacttacataacataaattaagtaatctttaaaaagaaaaaaaagaaagaaaaaaagaattaagaagtagaaaattaagaatccaaagactgtgttcatctttatgtactggtgtgctttatgaagatacaaggtttttgtttcatgttttgtttggttggtttggactttggttttttttgagacagggtttctctgtgtagcccttgctgtcctggaactggagaccagactggactttgaactcaagagatccacctacctctgccttctgagtgctgggattaaaggtgtgcagccatgcctggctagtttctgcactccattttcacttagcttgcagatcagggtagctggtggtgaactcctttagctttggcttcgaatgctctatttcccttttaccttcaaagggtaccttgctgatattgaatcctaagttgcacggtgttgatcttttatagcccgcattttgtttacatggcttctcaaaagaggtctgctgtcattcttgtttctctatagttgagtctttctgcttgcttccttaaaaattgtctttgctgtctgcagtttgaataggacgtacctaggtgatattttgaacctggagctcagtaaggttttagaatattctctctctctttttttttccttttgcatttcacataaatatcaagcttacttagtcttcagcagtgtctgtcccattaatcagcacatcacagacactctttgtgttacaaccctcatgatttcctgtggccctttctgcttataggactcccctcttccttgcctgactttgtccagttgtgtcctccatagacttaaagttctctagatattcctatgtgtgtttcttgaatctctttctttaaaaaaaaaattcttttattttatgtatatgaatattttgcctgaacaaatgtatgcgtaccacatgagtgcctaatgtccttagaggtgagcagagggcatcagatctcctgtaactagaattgtggatgcttgtcagccaacatgtgagtgccaggaactgcacccaggacctctgtaagatcatcaagtactcttaacaatagaactgtctctctagcccttgactctcagtcttagtcttgatttgtatgttctgtcttcagggtatttatgccttttagcaaactttgcaaatgtctttgctgatagacatattaggttgggaaataggaatttagttttaatatatttgttcatcagtattgtaattaagacttgcaactatagatgccagaggccccgtagttttttgatatactactattttggatgttgatcttgactgagcttcctcatagtttcataatgggtgtgggctgtgttcccaagcttgagtttcacaagtaaatattaagcgttactctacacttgtcactcaagtgttttgtctccttaagtcagatgggaaggttagagggaactggcataggatgaagggccccaagcgtttcttatgttgacactggtttctattccacctccagcaattcatcaggcttgctgcagctaccttcctgaaggcagaacttggtcattattctagacacacacatattatggtgtggcagttggacctgtgatttctgttttgtggtgtgtccaataaaagttgttctctatttgatccaacattttctctctataaagatgggaatgatgactcccacacttttacactgcagaaaagagacactggtgatttcttttgtagacaataagtggttatctataaagtattgttaatgactgagcccacaaacttgtctgctaaacaatagttgaagaactgcaagcaactatcagagtctactttgtgttccaactgtcaactcagatgtccaggagatcatgagcagaaagtgacacaggtgtgaaaattagaccagtcatagtctaggacagcggttcgccgcctcctttcctagtgctgtgacccattagtgcagttcattacgttatggtgaggccacaatcataaaatnnnnnnnnnnnnnnnnnnnngtcgctcaacctccaaataggttgtgactcagtattgagtagcaactgctctaggaccttgtaattgacattcatttagattattaccaagacccacccattctctaggctttttggcaatcagtctccagaacctttgatgtgctggtgcacctggtgatgcccatatgggacctagaatgcaagcccagctatcttattgggacctcatgaaacagagcttttttttttttttttttttttttttagatttatttattattatatctaggtacactgtagctgtcttcagccataccagaagagggcgccagatctcattacggatggttgtgagccaccatctagttgctgggatttgaactcaggacctttggaagagcagacgatgctcttaaccactaagccatctctcagtcccagaaactgagcttttataaagcaaaggacaccatcacttgaatgaagagtcagcctacagaatgggaaaacgtcacttatatgtggcagaggattaatgtcttgaaaaaaaatcctcaagaaaactaaacataatagttaaaagagagggctcagcagttaagagcaccggttgcccttccagaggacccagattcaattcccagcacacgcatgagagacacaactcctgtctagagtccgtactagagtctgtaactctagtcccaaggacatcctgttttggcctctgtggtcactgcatgtatgcaggcatatatgaaggcaaaacactcaaacgcacaaagattatttaaaattaaaaacccctaaataccaagtaactaaactatccaattaaaaactgaggcatggaactaaactgaattctcaaatcatacacaacacacacatctctctctctctctctctctctctctctatatatatatatatatatatatatgtgtgtgtgtgtgtgtgtgtgtgtgtgtgtaattatctctatacccatagattattgtattatatatatataatatatatatatatatatatatatatatatatatatatgaggggtttttttttgtagtattcaacatccatagccttcaggagaatgcaaattaaaattagcttgagatttcatcgtaccccaatcagaacatatgtgatcaaaataagtaaattaatgacaacatgcaggcatggatttggggaaggcgaacacgtattcactgctggtgggaatactaactgctgcagacactatggaaatcagtgtggaagttgctgttaaacctggaaatacatgtgtggtccagctagaccactcctgggcatataccaaaggactctatatcttactgcataggcacctattcatccatgatccttgctgctctaattgacaagagccaggaatggaagcatcttagatgtccatcaaaggatgcatggaccataaaaatgtgagacatatacacactggaactttattcagctctaatgaaatcaggaaagtttcagggaaatggatggagcttgaaataatctaagtgtagtaaacccagacccagaaagacactgcatattctcccttatgtatggattctagctttgaatttatacgcttaatttggagtaccaggaggagcatagtaagaggccatagtgatggatggtgagggatggggaattgaacatagatggttagaaggaggaaagcagaatagcagagcaggaaacattagataatggaagggcagggcagagtgtggaaagaatatcttgtgtattgtttggatgcatcacctgtcaatttaaaacctatggcctataggaaagggtagagtagaaggtgggccatccaggaagcagaaagaattctgggatagagccaggtacaggaatgcatccccggaagatgtaattagacagacacatggtacttgagcgcaggagtatttaattatgacctaataatagaaaagcatagctctatggccaaggtatttataaatatatttgagtctgagtcttatttctgggagtatggggctggaaggaagaaccagacataattactacagtagaggagggagtatggagagagataaagctaaagacatataaaaaaggcataggaaaactcaacacagaaacttctttaagtgtgtttgtgttgtgtgtgtgtgtgtgtgtgtgtgtgtgtgtgtgtgtaaaagaatttaaatagttatactataactggtaacagtaaccctactactaggctccataggtcatcaagaactccagtgccaagtatgaataggtgcctctttcaatttgttggtcagtagggttccatacacccctgcccccaaacatcacaggttattaccactgtccttggtttccctccagaacatcatgggccactcatactttgttcctgaatatactgcattcttgtgtcacagagaagaaatcaataagactagttctgacctggacatttcatccctgctggctagcttttatagtacgtatgctctcggagaagaagatcaatcaacagtcttatccagctgtgaaccctgagagcgtcagcaatgactggactggtaaaatatgcccaccagtgcaacagtggcgtgaatgtaactgatcactttctgattggttttgaggcccatgtaccgactactacctgctatacgaaggtgttagtaaaatgcccctaggtaattatctctatacccatagattactgtatctctcatctgtcgccagagaagctcctattttgcaatacagagacccacaaccagtacattcagaaaacaagagagtgagcaatgctcagccctaaaaaggacatctgtatcatacccatttgcagcatt

SEQ ID NO: 290 - DNA, 1360 bp, Mus musculus
acacacttagagcacagtcgccactggaagactgggtacactggggacactggggacacgtgtcttcatgcttttgtctcagttctcagatgcattgactctcaccccagaatacaagcgttccccgtggttgatttgaacatgatgctggtgggtcccgtgttgattgctgagcaaacaggaagaggcggcctgtggggaccgctggccactcccaaccgctggccagctgcacgcagagacccgcgtaaacttgtcaggaactttccaggaggctgcctttgggaggagaggaccatgaaggaagtggtttactggtcacccaagaaggtggcagactggctgctggagaatgctatgccagaatactgtgagcctctggagcacttcacaggccaggacttaatcaacctaacccaagaggatttcaaaaaacccccactgtaccgagtctcctctgacaatgggcagcgactcttagacatgatagagaccctgaagatggagcaccatatggaagcacacaagaatggccacgccaacggacacctcagcattggcgttgacattcccaaccccgatggcagcttcagcatcaagactaaacccaacggaatgccaaatgggtttaggaaagagatgatcaagatccccatgccagaaccggagcgctcccagtatcccatggagtggggcaagactttcctggcctttctttatgcactttcctgttttgttctcactacagtgatgatctcggtcgtccatgaacgagtacctcctaaggaggtgcagcctccactaccggacacgttttttgaccattttaaccgggtgcagtgggcgttttctatttgcgaaattaacggcatgatccttgtaggactctggctatttcagtggctgctcttaaaatacaagtctattattagcagaagatttttctgcatagttggcacgctgtacctgtatcggtgtattacaatgtatgtaactacactcccagtacctggcatgcatttcaactgttctccgaagctctttggagactgggaagctcaagtgcggagaataatgaagctcattgctggaggtggcttatccatcacaggctcgcacaacatgtgtggcgactatctgtacagtggccacacggtcatgctaacgctcacctacctatttatcaaagagtattctcctcggcggctctggtggtaccactggatttgctggctcctcagcgtcgttggaatcttctgtattctcttagcgcatgaccactacactgtggacgtggtggtggcctactacatcaccacaagactcttctggtggtatcacacgatggccaatcagcaag

SEQ ID NO: 291 - protein, 454 aa, Mus musculus
  VARIANT (1)...(454): Xaa = Any Amino Acid
THLEHSRHWKTGYTGDTGDTCLHAFVSVLRCIDSHPRIQAFPVVDLNMMLVGPVLIAEQTGRGGLWGPLATPNRWPAARRDPRKLVRNFPGGCLWEERTMKEVVYWSPKKVADWLLENAMPEYCEPLEHFTGQDLINLTQEDFKKPPLYRVSSDNGQRLLDMIETLKMEHHMEAHKNGHANGHLSIGVDIPNPDGSFSIKTKPNGMPNGFRKEMIKIPMPEPERSQYPMEWGKTFLAFLYALSCFVLTTVMISVVHERVPPKEVQPPLPDTFFDHFNRVQWAFSICEINGMILVGLWLFQWLLLKYKSIISRRFFCIVGTLYLYRCITMYVTTLPVPGMHFNCSPKLFGDWEAQVRRIMKLIAGGGLSITGSHNMCGDYLYSGHTVMLTLTYLFIKEYSPRRLWWYHWICWLLSVVGIFCILLAHDHYTVDVVVAYYITTRLFWWYHTMANQQX

SEQ ID NO: 292 - DNA, 338702 bp, Homo sapiens
  misc_feature (1)...(338702): n = A,T,C or G
agaatcacctggaaggcctgtgaaaacactggttgctaggacccactctcagagtttctgattcagtaggtccggggtgggtcccaaggatgtgcatttctagcaagttcccaggtcacatgatattcctcttctgaggaccacacctggagaactaggaaggtaagctgagtgaaagtaaagtcagtctatgcttctgctccctttcttcctgtttatgaggttataagaagtttgtgtctgattctcctctatgtccttccacaatgctaactcacccaacaagaatactagaagaacatcatttgctgtgtaaatgataaatagtctgtgagcatcagaagtgtttttaaataaatcaggcaatgaatcccatcaggctttgaatgagttctaaggagtttgccactattttcagtaggaaaatagacatccttcaaagaaaatgtatcctcaaattcagttgtgctactcattctaacagcatttttaaagcctttgcagttattcctctttattatttttaatgaagtcaagtcataaagtttgtggaacagggaaaaaaccttgagtctgttaggatagggtaatcagatttagaaaaagaaacaaacaaacaaacatacacatgcacacacataggacatccagttaaatttcaatttcagataaataatgaataattttttaggataagtatgtcccatgcaatgtttgacaaccctgatcagggctaaatattgggatgggaataacataaatgcctactgtggagaactgggacataccatatccatttctgttttatggatacacagaattacttacttgatcttgtaccttgtccattgcgaactcaaaaaacattggctgaattgttagaatatgaatacctaagatataaatgcaatatatgaaagtgctgagtgatttcaaagaaggatgcttgatcaacttaagattgcagtgccttttgatttagttgccccactttgatcattgcctaaaccagtgattctcaactgaggatgattctccataacaggggacatttggcaatgtctggagatatctttggctgtcacaagtgggtgggggaggtgctactggcatccatttggttgaggccaggaatgctgctaaacacctgatgatgtacaggacagcctctggtaacaaagaattatctggcccaaatgtccacagagctgaggttgagaaatcctggtctagataatagtgcagaggatttagcaaatcttttgttgaatttttctggccatgtcctggagtgagttggaatctcattcttccaggtgtcaacggaggatagatgttttctcctattatactgtgaaggaatgggtggaagaattttgatatgcttcttcgaaatcttacgaaacaaggaaggtgctgctgaggttccagaaaaggtgccagtcttcagttgctgctgttcttcctgtagcctagcctagatttgaagcttttgaagagttcatgaaggcactacgaaatttaggtgagcgcgctgtatcaatctccccttctttagtgtgcgagatataatttttgtctcaaccttccaattagttctggccatccaggacttgtttgcaagtggtaattggaggaggtgctgacccaacatgtattcattattttgtgtactaccactgttgatataatacaggtactttgtactaaatacagcaacaatgaacattcataatacattgaacaatatcttacgtttgcatttgtttacctctaatgaactataaaatattttatagacatatattcttattcaataattaattaattctcatgatacccatgggaagcaaagtgggggtgggtcatattattcccattttaacaggagataattaaaccttgcctggagttacacactgactatttgaaaagccaggagtaaattacaagtcttgacaatggtgccatgtctgccagtcagggcagtgttctgctgatggcactgattcatcagtccctggttaatgcccaggcataaatgtctaatttgaaaatcctttttaaatgtaatgtggcagattgtgaagggtggttgctaattagagaagaaggataacatagcaaggacatttccatccctggtggtttaccctttttaaacaaaaacataccagtgaaaagtagaaaagaaaatcatacattatggttgaataactgtttactatgggctacttggtgccaagtcctatgctaggtactctgaaagatgaaagctagatatatatcctcaatagaaatttaatatgtaattgaagaatcaagacttacctgcaagaaacatgcagagaactgtaaaagacataacataatcaagtgccaaaatgtgtgtataggaggcttctgtgtcctggaagacagacttttttttttttttttttttttttttttgagacagagtctcactctgtcacccaggctggagtacagtggcatgatctcggctcattgcaacctctgcctcccgggttcaagtgattctcctgcctcagcctcccgagtagtggggattacaggcgcccaccaccacgtccggctgatgtttgtatttttagtagagacggagtttcgtcatgtcggcggggctgatcttgaactcctgacctcaggtcaggatccacccgcctcggcttcccaaagtgctgggattacaagcgtgagccactgcgcctggcccagacatcttttattttaaaaaggtaaaattggagagagttgcttggtgggaccgccgcggcagcgagggcgagccgcgctggcccctgcgtctggtgccgcgatgctgaccccggcgttcagcctcagccaggagccggatttcctgaccatcgccatccgcgtgccctatgccccggcctccgagttcaacgtctacttcgaggggtcggcctagactactatgccaagccgtactttctcagattaacccctcctggaagaattgtagaatatggatacggaagcgagcaagggtcctatgatgcagataaaggaatttttaccactcgcctgcccagagaaacccctggccagcattttgaggggctgaacatgtgttgctcttctggcaccaggaaaatccgggacagcaaaaccacttgtggaagcaataggtgattctgaaattcctgaggaagtagttgacgatgaagagtttgattgggaaattgagcagacaccctatgaagaggtaacagaaagtgctttgaatcctcatgccactatgggtttggaaacttacgatcaggagtgtttcagcagttacaggatgaattgagtgatgttattaaggatccagatttcatccctgcagcagaacgaaaacaaaagcacctggccgccgagctggccaagtttgatcctgatcattatctagctgacttttttgaagatgaggcagttgaacagattttgaagtataatccttggtggactgacaaatattaaaaaatgacggcctttttggaaaagagtcagaagcaagaaaatcatgctgcattagtgtctttttctgaagaagagaaatatcagctacaagaatttgtcaataaatcttatctgctagacaacagagcctgtcgtcaagtgtactacagttcgattgatatccttctggcatattgctaagaaacccgtgtcactgaaggagacaagaacgttgaatctgcatggaatatcacgaaacttgagtccaatactatgctggtttgagacttggactaatgttcatgatatcatggtgtcttttggaagaagggtattgtgttacctgctctatcgccatttcaaactggcgatgaaggcctacggggagactataaagatactgcaattaagtaaaagtgcagttttaaagtgtctcctggatattcacaaaatttttcaggaaaacgacccagcatacatactgaatgatctctacatctcatactactgtgtgtggactcagaaagtcaaatccaaaacgttggcagctcttgcagaagccttaaaggaagtctcccttacaaaggcccagttggggttagaactggaagaactagaagcagcagcacttcttgtccaggaggaagaatctgcattacaagcagcccattcagtttctgggcagcagaaactttgctgcagctctgaggcaggtgattcagaggactcagacagcactgtgtcatctggaaacaaagactcagactcacattcagaacaagatgaactcaaagatagtccatctgagacagttctttgcaaggtccccttcttgaagaaagcagtgcccttctgattgttgatggtggagtatgcagaaacacagccatccaggagtctgatgccagtcagggaaagccacttgcctcttcccagcctcttggagtgtctgggcctctgatagaggagcttgggggaacaactgaagaccaccgttcaggtttttgaacccgagggcaccactgctgtagaccacatcaacatgcaggagagagatggctgtcagacaccaaatatttgactcttaagtggttttattcattgttgagaaatgtgttagatttggtttcatttacagaatgagaattcctcattttcactttgtaatttttcttagtatatacagtcagcctgctgtatttgtgggttccacatctgtggattcaaccaactgctgatcaacaatttttaagaaaaaactgcatctgtaccaaacatgtacagactttttttcttattattctctaaataatacagtgtaactattcccacagcatttacattgtattgggtaatataagtaatcttgtgatgatttaaagtgtacaggaggatatggggaggttatatgcaaatactgtaccttttatttttttatcagggacttgagcatctgaggattttggtgtcctcaggggtcctggaaccaactcctcacagatactgggatgactttatgacattgtttttcaatcagtgaatgtttataccttttggtttccttgctacaactgtgaagataaaattcaaaagtatttttaccaaagtgtagctaatatttcaagctgaaaataatagttctactgccagtgtctccagaatgtggagcccattaatatttttattttagctttactgaggtatacttgaccgctgataaactgcacatatctaaagtgtacagtgtgttggcatatgtataccctgcgtaaaactatcactgcgatcaaggtgaaaatcagacccatcatccccaagtgcccttttgccccattattagtttgcatgtcctagaattctatgtaaattgaatcatacaatatgtatccgttttttggtcagccttattttactcagtataattattttgagatccatccatgtggtagcatttgtcaagagtttttgtttttgtgtttttcattgctgagtaccacttcattgaacagatttgtccattgacctaccgatgaacacttgggttgtttccagtttggggctgttataaataaagctgttatgaacatttgtatacaaaaaaaggtgaaattggagatggaccttgaaatattagtaagattaagtggccagtgggaatctggggaaataggattcaactagacaagagggttaatgaatataggtagggttgttcttgttactctctggaagagattaaaaacttgggagctctcaagtggtcatttcatggaactgaaggaaaaaagccagaaaccacagggagagaataaatagaaatgcagaggagacagagggagactttctgggttcctttcaatactccagttcctggtttccatctcatcccgaggctcagctgcatccctgatctaccctggtatcttcaaataaattccaagttttttgtcaatgaatagaagccaagcagttattgaagccaggaatcctagccaggtacacaggaatgagcacagaatgttgagtattatcagatctaagcctcggggccaatacttggaatgacctttgttgtcttcgactagcttttttggttagccttggtttggaacccaggttggccagaagagtttaaagagctaagcaggggctcctaaggtcttgctcctgttattcaggctacgtggctctggatcacattgagacaaatttccatggatagaaacaaaagtctccttgcttccagagcactatttgaactttgactacaggtggttggtagtgatacctatagtatctcccatttaattccccagtttagactgtgcagaagacaaatggatcttgaagaatgactgtggaatgtcataaatgtaatcagatggggactccaatttcagctgctctcccagaagtagtacctttactggggcagattaacacattggtatgcacctggggcagatctgacatttggtatgcacttatttacctggctaatgccttttcctccataccaatttgcaaggtccatcagaagtgatttgctgttacccaacagggccaacaatatgtcttcccagtgttgccacgggctccattagttctcttgctcactgccataatagtctgaagtgatcttgattgttctgacattccacaaaacatcacactggtccactctattgatgacattatgtgagcatcattggatcccatgagtacgaaagtagtaagtactttagatgccttagtaagatgtatgctaggagggtgaaagagacctacagagattaaggtggtgagagaagcccaccttctcaatggtgagtgatggctactgctgaaaggtccactgaataaaaccacattttaaatcaggtagtttaccttcttaaaggtagaaaagtcattcatttggaaccaaaccacctactttcagaatagctgttttggtaagtgaagcatttgcttcagtatttgctcttagtattatttttaacaagatttctaatgacagattgtgacttggaggtgattcacttttgtttcctagttgtcttgacagcaacgtaattcatgatattctgagtacttgagaatccaaaaattttacaatccaacaatatgatgtttattaaaattttcctaagaaatacactggtaagcaaggcacagtggctcatgcttgtaatctcagcactttgggaagcggaggtctgtggattacttgagctcaggggttcaaggccagtttgggcaacatgatgaaacagcctcggccaaaaataaaaaattacctgggcatggtggcttgcacctgtggtctcagatactcaggaggctgagggtggaggatcactggagccctgtaagtcaaggctgcagggagctgtgatggtgccactgcactccagcctgggtgacagagtgactctgaagaaaaagaaagggcactgataaaaattctttaggattggatggactaaagagggagaactatttttattcaatttttttttttggttacaaataatagtgacttaaggaccataactaaatataatttcaaggaggggcaactcttagtgtctcttataaccacttcacacagaatttacttttactgctatggtgatttctctttagatttctttctgtatttatttacgcttttattttttatgtatggtgtatatatctatgactttttctctctgattttatgaaactgaaattaaagtggaaatacttctatgccctgcttttttccatgtgctatatatatatcatcctaaaattacacatggaaaaaaatttaaaaggattttattatgaaacatttcaaacatatagaaaatttgaaaaaaaaaattatgccagtaccttagacacacgatttacattcaagaagtattaatattttgaaaaatttagttatctttcatgtgggggtggggtgcattttaaagtacatcaaagaccagatgcttacttggacctttgtttcaggaagtccagagcttacagcatattctggatagcactggagagaaaccaacacgggagagaaagcagccagcagttttctggcactcccttagtttgaaaaaatttacatcacaagaaagcaagccttcctttcaccttttaggtgcaaactgataaacataaccagtagggctactatacttcacagagccttgctcccagtagatactcaaaacatgcagttgaactgaatttcagttgttattttaaagccgtgcttgaaaagcgtatgtgacaaatgtactttcctaatcttcctgagaagagcagtactgtgtcttacgggcgaaaaaaccagaggagccaggagtggagggtgcaataaaacgcctgcattggggcagattgcctcattttgaatccctgactcctcactgtgctttggggaaaactatggaaattttcactgcctagcttattaaaatggactgcttagctgaaatatagaggcgtccatgacaactacccggagggctttgttaatcatattgcaggactccacccgcagtttctggttctgtaggtctaggtggggccgaaaacgtgcatttctaacaaattctagggtgatagtgacgcggcaggtcccgagacaacaggaaacccaaggggactcgaggcaggcgctcaataaatattcactatgaacctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccaagtccccgaccccgcgggaggcacggcctcgggctgcctgtaggccaccgaggtgcggcgcgggccggccagggacggcgggcatcggggcgggaaggccagctctccccgctgtccatcctaacttgggcgctggggcttcgctcggggagcagaggaaaaccttccttcaggcgacttgcaccacgtggggctactgggcatgcgcgggctccgaccccggcctagccgctctccgggttttcgccgcagctcggaggggcggcggaaggtgggccccaggcggggcggggcggctctgacgcagtcggagttttcacctcgcgcggttagagctcttgcgcctccgtcgcgctcccaggcgtcgccagaggctttttttttctgttgtgggagaaagatgagagtctatggttagaggtttgaaaatgggccgaatagtcaggtcggccgtttcctaggaatgatccattgggcattaatcccaagtgtcgcagcccttgggcttggtgggaaaaagaatccagtagtagttcgcaaactcgtgcctggcttccagcaggctgagtttgcgttccctgctttgtgaccagctctagcggctcccgtctccggccctgccccaagggatttaccgtcccagattgtaaaatctggctcccgctaggccttacttagtgggcccctaaaaacgctggggaaagcgcccgcctcctcagtttcccattacttgaaagtaaaattcaaggggcccaaactgcgactgtcccttggttcggggtcccgctcggtcccgggagggagccccccgcggaccccgcccggccggcccgcccccccggccgcagtgaacacccggaggagcggagtcgcgtcgcgcgggaagccgggccggctcgggcagcggactgggcatgctcggcagcccgggaggctcgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaagtgagtcgtggggcagggacagacagccggcctcacggttgcgggggccgatcggacacctgtctcgcgggcccggccttatgccggggagcagcgggcgggctgctctggggcgagggggcgtgagcgcagcccgcgcggtgccgcgcgcgtacctggcgggcagtcctccagagctgctgctcccgtgggtggtcacagcggggaggtccggcggccgggatccgggctcggagggggcgggccgccggcggggctccccggctaagttggggcggggaggaaggaggaggcgtcagtgggcaccttttcagagctactgcgtgcgggctggaaggctgcctggtgtcggattggggcgatcgggaggcggggagcctttgggcagtagcccgcccggggtccggagacccccacccaggggccgactccaatcacggctccacccccacagcctaggtggcggtgtgacagttggtaccttcggtccagatcgcagccggccaggcgcccactatttcgggatccccccaccgtagcccctcgatgccccctgacgacaaaacaggtgggaccccccctccccgaggagcgctccccttctctccaggccgcgtaacagcccgccaggctcgcgggcggctctgagaccccgcagggctgcccccgcggggcggggacgtttaggggcaaggcctggaggggaatcggcgcagcccagaactggacagtctctccaggacgccgcttttccgtgacagagggggtctgcgctatcccccagcgacgtgtcaagggcaaaacagcagcagcagcggctgcctctcccaccgtcttaacccgaactcgggcttgtggcgtcctcccgtgggccggatagagtgccctagtccagctaacggattcagcctggagcgttctggtgaatgctgctttcctctttggtgccgcgaagtagaaatcgggataagggttgtcatggccggagggagcgaagagaatccaggcaggtgcttctcagatgtttcttttcaccttcaaacagtacagacttcagcggtacacgcttacgaaaccaagtgaaggctgctttctgaaagggaagtttattttctatgttctggggcctgtcgactattttagctcccttgacatttatcttcctggacctttaaagctgtttggacaggttattttgcttttaggtttggggatgtttctagttggctccctggatgtggaagtggcgaatgtctgatgtgctgtgctgtgaactccccacgcttcctggcactgggggttgaaacattcaggggggactgagtgggccgaaggagaggagtgggactggtgacgtaggaacgcgatgggtgttgcctagagctgcccagatggaaaggggttggcggctgttttggcctgtgcagaaggggagagggcggggcgtttcattggtcggggtgtgaaacgtccacgggcgaaggctgcgggggatgggtgcctgtctggtcagtgctccaagggaagcccagggatgtttggtgattcagcaggtggcagccttccagctctgaagacatgccgtggccaagcaaagaagcaagcaagcaagcaagcagcagcctgtgcctgctgtcggaggcgccagctttgggggaacctccaggtgctgccttctgcctgtggcagctcacttgtcttatcttgcttcctgtttagctctggaggccctggtatttcgagtttccttactgcgcctcttaaaatatacagcaatatatagcatgtttttgagtctctgcatctctgtgacctgctgggtagcagtggggtggctgctgccgccatgcagttttaagtagttactctgcagaaagtgacagtgatatgtaaaaacagtgaagtggcctttccttccatttctgcttcacagaatagaaatttatgtttttagtaaaataataagatacatttctgcaactcttcagtgatgatagtgagctatttgaaatttccggaaactttttaataaaagacattaactccagagatgtattaaattgacatcagagggacacggttattaaaccagtatcttactcattggaagatttctagcatcttgcacagtgtctaacttgtattcaatacatgcctctgcagctgaaattttaaaaattcttcataacagaagagtttaccagtatttaccatgttcatcatctatttttaagtctgtattaatatggttagagtaaaatatatgcatcaatacctttgcacattgacatttaaagaatatttatgttttcgtaagacatgattgctgggttgaccataaacattcaattttagcttgaaaacttgattcttttacttttctggttaaatttattaattttcaaacttggggcagatcctacatttcagctagagaaatggtgtgctttgttaacatacgtcatgaaaaccaaacggactcctgactcctaagtatagccatcagtttttttttgtttgtttttcttttgagacagggttttattctgtcacccaggatggagtgcagtggtacaatctcggcttactgtagctttgaactctccaggctcaggggattctcttacctcagcctcccgagtagctgggactacacgcacgcaccactaagcccagctacttttttatagagatagggttttgttatgttgcccaggctggtcccaaactcctgggctcaagtaatcctctcaccttggcctctcaaagtgctgcgattacaggtgtgagtcactgcacctagcagtattattattattatttttaactaaaaagtgctcctgttggatgtcaaatgctttaacttagaaaacttcattttatacataacatttcaggaaaactctgaaaagtgctgctatagaaaagctgaaagagtattttgggaataaaaattctggattgtttgcacacaggcatcaatgccctggtctttaggagggaggcatgagtgtgctgccagttcattctgctctttaccatcactgtctgttccttcctccaattgtttaggtatttcttcttctcctaaagatgtactttcttggcatgagcttgctttttaaagcaatcctgtcagaagaatctgttgcattttctcacacaaatttgatcaatggtgatttttattttttgattgccatatacactttcccaccacttcatatggcaaactattcagtggctcttgtgtccttgtgggggcataacatgttatagatggctatgccttttttggatggtagctatagccataacagtctcttctggaggaacttttatgacatgctggtcttcaagatttttggctttcctattaaaggcttttggtcaggaatataaatggctatttctcctctctaagagcatccctgtaaaggttgttacctccattaagctacccagtcacaagaggaccttattttggatcagcccacttggatgtgggagttgggaggcagcattggatgtcagggaggagagagtgaagaaagggaaagagaagggtgggcggagccccaggaaggtagcttggttttataactgacttctggattcagtaaagctgcattgaatggtgctgatgaataagtttggctcaggccctgctggaatgctttgctgttctcccagtcctccatctccacagataaacacatcacacacagatccacagacacagagactcacacagacagcgaagagaaagacacagagaaagagacacacacactctgccaaaagccaagagcaccagtgtctttttaaactaatatgtcaaagggaaaatccaggactcagtagcaggtttgattttgggggcctgaaatcaccccaagcttgtattgagaaagattcccctccactctcagtgacaagctgatctactcccttaatgatgtaaagccacaagggctttaactgaagcaaccattatacgtacagacaggtgagtggagatttagataatttgggtgatttaccttttagactcctggtgctgagagctgagctcacattccagttcttggcacaggatcctctcactgtgcaaaagccccttgcttgttttacgtttttctccttcattcccctcccagcaccccccaggcccctctcccccagaggagccttctttccagtgcaggatatgttcttgcatatgtatgtattttgttaaagatgttgagttactttgtttgtttttgatttacataagtggttctgtgctatagatttcattctttttttattcaacattagagctttttattatggaaatttgcaggcattcataaaagtcagaagaaccttaacattttatttgtgagatccttgttagtgcaggtttatctagtgcgttgccttgactgctgctttgtagggctggtcttttatgtgtctcctacttttacttacccatttccctaatgatggatgcttaactcacctccactcctgctaccactagcaaacatcctgtatgcattttctttcttttttttcttttttttgagacagagtctcggtctgtcgcccaggcaggtgtgcagtggcatgatcttggctcactgcagcctctgcctcttaggctcaagagactctcctacctcagcctcctgagtagctgggtctgtgtgcattttcttaatgatctggttgagaatatccctagggtagtggttcttaaagtatggtccacacctggcagcatcggcatcaactctgaactgttagaaatacagattcttgggtcctaacattccagaattcctgaatcagaaaccctgaactgtgtttcagcatgcccaggttggagattctgatacatgggaaagtttgagaaccgctgctctaagggtatgtacttaggagtgggatggctgagtaatggtgtacaaacatacctgtttttactaaacactgctaaattactctccagagttgctcagctgctttctgttccacatcagtgcacaagggttcctgattccccacgttcttactcaaatttgttattaaccaactttctagttttaccaatgtttggtggctgtaaagtgggatctcattgggttttctttttgtgaacttatatgatttcttagtaaatttgaactcttttaatatattcattagtgattataatttctttgactagccatacttgcttttcctaatgtggtgatttgaagatttttttggtatattctagatgttaatctcatcctgtcttctgtttatcaactttgtcaatggtaactttgagaaatttttagttttgatatagccccagtccattaatttttgccttaggttgcactttaagagtataagatatttttccttaccccaagattacaaagatattctgtattctgtcagctttccagttttacctttcacattgagggctttattctatttgaagttcatcttcatatatgggaaaacaaaggaatctcacattatttttttcctttccattctgtgagacagttttcctaaatcatctattaaacagtgtattctttccttcatatagttttgtggagccacttttatcatacctcagattcccacagacacatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtggctcacacctgtaatccccagcattttgggaggctgaagcaggtggattgcttgagcccaggaattcaagaacagagaacagcctggtcaaaaccctgtctgaacaaaaaatacaaaaattagcctggctaattggtatagtcctagctactcgggagactgaggtgggaggattgcttgagctcaggaggcggagtttgcagtgagcccagattgcaccactgcactccatcctgggtgacagagtgagaccctgtctcataaataaataaatacataaataaaaataagagttgtaacttatataggtaaactaaatccattcaaagtgtacagcttgattacttttgacagatgtacatacctgtgaaaccatcacagtgaagatacagagcatttccatcaccccaaaattgcccttgggcccctttgtaatccctttgtccccagacttaagcaaccactgatatgctgtcactgtagtttagtttgtgttttctagaattttatgtaaatggaccatacagtatagtaccattttgtgtctggttcctttcattcaacatactgatttttaaaaatctttttaaattatgataaaatacacataacataaaatttatcatttaaccattttaagtgtataattcagtggcatcaagtacatttacattgttgtcaccactatgcatttccagaacattttttatcaccccaaactgaaactgtccccattacttgcgacatactgataccaatcatctgtctgtttttatgcccccccaattttttttattatagcattgcagtgtgttttatatggcagaatgagcccctacttttctttatactttgacttggttatttgtggatgtttatacttccatatgcattttggaatgcttattaagttctcaacaaagttaggaaagtgtgatgggcattgcattgaatatataatatgatttttctgtctaatattgtaagattttctgtcttattgtaattctgtccgtgaacatggtcatcatttcatctttttaaaaatgactttttaatagagtttcaaattttctctgtcatgataacattttttataaaggttgctttgaggataatttgaatcttggcaccttagtctccacattagagggaggctaataggtgttttgggacagatcttttaaaatcttccttcatttatcagcctgtaatgacattggtgaaattactcacccctggtaggccctggttcctctttcctcaaactggaataacaacaccccccgccgcttagggaggctgctgaagggtttaaaagatattgtaggagatgcttggaatacagatcttgaaacagagttgttgcttaggttatgttggtggaatacctcccctaatgctggttttaaatagcataaactgtctgggtatggtagttcacacctgtaatcccaacactttgggaggccgaggtgggaggatcacttgagcccagaagtttgaggccagtctgggcaacacggtgagtccctgtctctactaaataaataaataaataaatacataaaattagccagttgtggtggtgtgcacctgtagtcccagctacttggggcgggggggctgatgtgggaggcttgttcgagcctggaggttgagcctgtgatgagctgtgaccatgccactgtactccagcctgaatgacagagcaagaccctgtttcaaaaaataaataaaataaatctcataaacttaatacttttgtctgtttttaagggttgataataaagaagagtcagaaaagcaaagtgaattagctagccaataaatgtgtaacactctctaagactacatttgcaagcccatgtttctgcctagttttgttgggtttcacaaaaaatatgggtacttccaaagaattttacagtcgactggggaagaaaaggctaatgtgcaagaaacaattagagaactctatgtgacagatggtatataattagaggtgaagtggtgcagtgccaggggagttatgagaggagagagattctgctctgtgaagttttgatttggcttgggtggaactagtttagggaggggagaaggcgctggagaaaccaagtagaattatcatttctgttgggagccttgagggcccagcattgaatcccatgacagtggatattgtgcccaaacataagtatctcaaaatcagtgctgtgggattggtgataaatagttagaagatgcctagataagcaatagctctctgtcttatagtacagtggtgaagagccctgaccctggaccctgggtttggatctcagcctcatcgtgtagaagctgtgggaccttaggcaggttatgcaaaccttctgcacctcagtttccccaactctctggtaggtgtcataacagcagccatcttacagggttattgtggggactatattaacatttataaggtactgaatgcctggcatggtaaccacaacataaatgttagctgttattatgacaacttttgttaatattcatcaccttcctcctgtacctctcttgaggtgtgtgaggctttatgccccagaattggatggcttttgtccggaaagacctggttggaggctgtacaaatttatagaatggctttttccacatgtcggcaggcattcagtgggcgctcaggttgcagactgaacaagtaaatactgaaagacagtggagccaggtgcattctctgtcattcctggatgtcctcactcagggctctggaattgagtggggagaaaaagtcaggtggtaagcattcaggaagcgaattttattttgctatattcctagttctgattagaccttttggcagagatgtcggaatcacagggattcacacttgttgatggctaactgcatgccagccactttctaagtccttgacccaatgaaatggatattgtcatcataccttttttgaggacaaagagagtgggacagaagtaatttgcccaagaaagtaggaaaaagaatgccctggagtttagtgtttggggcctttgccaggtggcagaaataacaagaagtaggtactgttggtggagagccagtacctttacataaagcgttgtaatacacaggttagcccagcagggcattcccatgacctcagatgtttatcaggtgaagccagtggctctcagatttcagcgtgtatcagaatcactcgaaggctgcttacaacgcccagggctgggacccacctctgccagagtttctgaggcaaagagcttggggcaggtggcagtgggcagttgacatgtctaatgtgttcctggatactgtcatgctgctggtctggggaccactctttgccaaccactgccatcagcagtgcccatgtcagcgaggagccagctgctactacttctagttacagtcaggtgggatgatttcagatttagacattggaagtgccttccgcctcatgaaataaaaactgaactcatgtggtcctgtttatctaggacagcagaggggtgtctgagccagtccagagcagaaacttgcttttcctgctcaccagtggttctggcatggctcaggagagatgatcccaaggtggagagaaaacttggaaatataagtcagcactcattagaagcttggagtgccatcattacatcccatcttaggaagatggcctcatttatttttgttatttttcattcccccttccattggcaaaaaaaaaaaaagaaagacttcctgttcaccacttatccccatggaggaatttaggcacagacaaattaaaagtatattgagatacataacctgacagtggagaggcagaagataatcttatttgcctagtttaattatagcagaaaactgtgtttgtaggaaaaaagagctttgtacagctttcctccagctgccacgaggtcacatagctacaatgtgtaccaagcttagtacagcacctacacacattaagctctcaagaagtatgaatagttattattatagcagaagttttctgtcttgcaatccaggctacactttttcctatttgaaagaatgttacatatataaaacctcgggacgaaaaccttttataatttaaatattttgtaggaactcaggatttagaaagaactcggaggtgaacaatacaagtaagttgtatttgggaaggaacactggtttagatttttctctgtgctagttatcaggactctcctgtgaccctgtcagcctgtaacagctcgtttgcttggtgagggaatgtggcagggcagagaggatggggggattgccaggggccgactgaagaggctagagaggcctgttcaggtgtggagacactctccagtctggtcattttataactcagggttgacagtggcagtaaatatgtgttgaaaatcccctatgggccagtttccctggtgagctttgagatacagagatgagtgcgatggggtctgggtctttgagggattagtggggagacagacatgtccacagatgatgtcatcaccaagtagtgagtacagtatcaaagctgcacacctagcctccctgggtcaggggtgggatgactggacagaggtcacctgcccagtttccctgtgtcagcagagtgcacagaagggaatccataccataggtcagtgtagatggagccagaagtggcatttttttggtttttattttcttttgttttagggttgaaagccacatgaggttttcatttttagtgacataatcctgacagcagagacaagcctaggaagatgtgtgctataagtggtcagcccccaaagggagaatcagagctgggactgcacttcaaaactacttggggagttacaagagtacttaagagtttactttctttgtttttaaaaaacgtggctatgaggtcaggaattcgagatcagcctggccagcatggtgaaaccccatctctactaaaaatacaagaattagcctggcatggaggcgcacgcctgtaatcctagctactcaggagcccgaggcaggagaattgcttgaatccacgaagcagaggctgcagtgagccgcgatcacgccactgcactccagcctgggcgacagagcgaggctctgtctcagaacaacaacaacaacaacaaacaacaaagtggctaaatgttagctgtctgctaggaatgtaaaacctggagaagattaacgactttctatctttaagataaatcaacttttaaaagaaagactctattaaaaacaaagttttattttattttccctgaatttttggctaagtgtgaaattcccctttcatttgtgttttcagtggttccagttccttgttttcttttttctcccctccactcctccttttcgccagctgcttattattcattaacaaaagaagctgatttcagcactaccttccccagtcctatttaatttcatgtccagaccactttatagaaatagcaataagctgtttgcatttcccaggttgtaatggatattccttctggcaggctgtctccattaagggagcaaaatgtggatgttcagtcttctaaaagtttcatgcaggtattctatgtgaatccatgaagacgggatgttataacaaatctcaggttaaggggtggaggatcctcagctaagcttggcaggtggaagatgcttaaatttggaagggagttcccaatagtcacagatggagatggagggattgaagaaaaaagccctggggcaggatggtagagaacaaacctcaagaaaactatctcctaaggaagtggtggggagggctagctgaagtggtacccaccccactggcagggggctgggtgaaagcagcagaggcaggagaaatcaggactgggagggagatagggtgggaaggcaggctttgcccacagcttctttccccctaacagacacaggctgacagtttaggcaggagttggaaaaggggatggggggtgccagtgtgtctgaggccaacagagaagaggaatgttttactcctgaggaaaccaggaggggagagggaagggtggaggaaaggcagggggcagcggcagggatgaaggtgcacaggcaggtggaggatgactggagagcagagatgcttgggatgctggagaaaaggccatgggaccagaagaggattgtgaaagaaacagtctgtatagaggacccacggccttcagcccaagtcaggctgtcctggtcatctgagacagaggcagagtaggtgagggcagtgaggaaagatgctgctggctgtccaagcacactggtgaggtagtaatgcaatttctgagccatttgtaagatgtcaggacacccagggtcttctagataacaggaactgggaaggcaaggacccaggggccctgattttgaaagccagctgaggagtgatgaagaacagtgggcttgggtttaaatccttttggggcagtggctttctcatgtgaaatggggataataaccactctgtcacaagtgtcgtggtgtgaagacccttggcgtgtgtccacagtagtacagggttgcattctgcagttgttgaggtggccttgggatgtggcagcagagggtgaccctgagatttcctgtaagagagagtgcgtgttgattccctttcctctcctgggtggcgtgttgaccattcatttgactagatggaccataagtgagatgggctattgcacaggcactatctgtacccagttttctggccgtgtgttgtcgagattttcaccacgtggactgcatagtcccttcctctgtgtttctacctgatcttatcccagagcctgtccctattattcccctggctattagttcactctacacacccccagacccaagtacacagaatgtcccctgtatgccattgctttttgtggaagcctttgtagatggcctccatctctagcctgagccttcagaattgtggagactggcagctttgacgttgaacgaggccaggatacaggtgtgaacaaagcaaagtctcagctcgtatggagttttcttggtaagggtcagaccgacaataatcaaataagcaaatatatagcatgtcgggttgtcaggaggcaaaacctcacctgtgcctcagaatgtctctgccacctgttcacaaggttggtaatttaacatttgctttactgctgtggtccatgtagtgacaactaagttactttgaaaggctctacaaagttccaagcagttggctgggcagtgttccaggtttccataggggcctcagcatggccggctttccctctcactttgattttagaaacaggcaggattgtgagaacgctctcaggagtttctcaagcctcattttgctcattcgtttcaaggccctatgtgtggcccacaggttcttattgggggtccctggatgggtttcctgaagccaccatgtatttaagtgtattttgggggacagtgcatctaaaactctcattaaattcaccaggaaggtatttaaaaggcccattttttatgaaagtggataaaaagtgaaaattatgccatggaaagttccttcatatttctatctttctctttttagaggaactaatgggaagtgactaggtaaaagggggtgaggcagacacacactgacagccttgttgtagttctgtgcggcttgacgtttctgtgtcttacgggtgggatgggaaacaaaatgataccgctggcatcactggaagaccatttgacttagtggaagcaaaggcggggaggtgcgtatgatgctacaatgtgtttctgtcttccactgagcaagaagaggaggttgagccattgggaggagcacagaggccccttggagcagttgctgcttctcagatttctgtgtctgatgggtactgaagataggtctggagctttggctgctgatgccaaaggcacctgttttaggagattgctctgcttgagaagtccatagtagcttacctaaatagtaaagttcatgactactgccttcaagataagggtctagagggtagctttgaagagtgagaccgtagatgctcacacactctttgacccagcaattctacttttaggggcttattttaagaaataatcaaggtcattattcatcccagagctctttatcatagtgaaaagttggaaatgtaatattaaaatataggggattggttaaacaaattatgtatatccacacaatggaatactaggtaactgttgagaatagtcataaagaaagttgttctgaaagcattgttatgtgcaaaaaggtatgtaatgcctttgtaaaaaaaaaaaaaaaaaaaaaactattgagaaggtactggttgggccctactatgggccaggtaccctgtggagtactggtgacacagtgatgaactagacagatatgtcctcaacaggtcttagtctaccaaggcaagagtcaggtcatactgactctgtcattaaaaaattctgtaaataatccatgggttctgcaaccacagattcaatcacatagattgaaaatatttggggaaaaagccaaaaaataacaatgcaataaaaaaaatacccccaggcatggtggctcatgtctgtaatcccagcactttgggaggctgaggctggtggatcacttgagtctgggagttcgagaccagcctaggcaatgtggcaaaatctgtctctacaaaaattagacgtggtggcatacacctgtagtcccagataccagggagactgaggtgggaggatcgcttgagcctgggaggttgaggcttcagtgagcagaggttgcacctctgtactccaaactgggcgacagagtgagaccctgtgtcaaaaaaacaaaaaacaaaaaattatagcataacaactatttacccagcatttacattgtattatgtattatacattatctagagatgacttaaaggatacaggaggatttgtgtaggttatatgcaaatatcatgccatcttatatgatggacttgagcatccacggaatttggtgtccctggaggtcctggaaccaatctcctgagttactgaggggtgattgtattcataggaagtctacaaaaagaatgtctccttcacaggcaattttgccacctgtatagtcatatcaggtgtgtttctctgtacttgttattaggctacatctttgacttgaaattactgattttttaaaaagctttaagtaataaagatatcacactgattaaatttcgatgataatactatcttccttgaaactctcttttctctcccagcactgtgggaggctgaggtgtaagggtggggtggcttcagcacagtgtttgaggagtgggcactgagtagcgtcccctgaaatcttgtggtgtacagcctgtgctgaccgcccaaggctgctctgcactagccttttagccagatgggttttctttcaaggacaacttttctttttcttatttctcttcctcctcttctcttacccttttccttctctttcccctcttgctcttcctcctttatttagaaaatgtataagttaaaataatagtaataaccctattacacatagataactgctgttatcattttggtgtatatctctctgatctattttctataaatattagatgttcaccaaatgcacattttgatcaaatgctgaaaggtggaatgctgaaaggaatagtattgccaaagctaaatcttgctgtcctagaatggacttctgggatacaagtacaagtttgacattttataaacattattacagttttgttattaaaatagaatttggcattgtggtacagggacttgatttcttagcatatacgatcagtgctgttaatgtttgtgatactgggtggatgttgactttgatctgagttggaggagggaggagcaaggcctttacttatttgtttagtttgtttttatattattatttttgctggctctgtccatgtaatacaatatgagtggtagtttctttccaacttattaatcttttgtcatataactgacttgtcttctctgtgactcctggacctgaagattttcttggcaatgatgatgtggtttcattttagtatttcctaaccccagctttgtgcactgtttgaaggagaatatatctggataatctcagaagcagaagtgaaattgttgtccttctacacatttttccctgatatttttgtactcacttgctgcttcacacaaccagttgagagaaaaatgcatccttaagctttggctctaaaagtgtggctgtagagaaatgaaattggctttcaagataacagagctgttttggaatctccatctgcatcttagctttcactgcctgcacactaatttcaatatcttccctggagaagaatgacagaagaatctttgcagaggtaatatgtgacaaatgtttgccctctcaaggtaccctcagttttcaacaattgactgctttccctgcaagcaaccattgactgttagtaagcatgctctttaatattgttagtagacttgccatgtcaatgctgttatacacaaagtacaatgctaggccaggtacagtggctcatacatgtaatcctagcactttgggaggccgaggtgggtggatcgtttgagcccaggagtttgagaccagccttgacaagatagcagaaccatatctctaccaaaaaaaaaaaaaaaaattacctgggtgtggtggtgtgcatctgtagtcccagctacttgggaggctgaggtgggaggatcacctaagcccaagaagttgagactgcagcgagctgtgattatggcactgcacttcagcctgggtgatggagtgagaccttgtttcaaaaaaaaaaaaaaaaagtacaatgctagagctgagctttgttatataataaccagacattccatctttgaacatctttggtaagtacgtgacaaaatcttgagtgtcatatagtttgctgatggatgcaggagattctaggatacatctggaatgttcaccgacatttgaaaatgagtctttggatactaacagcagatattcaaatataatgccttgttcatatcactgacgtcatgctgttgtgatgtttacttacacggtgatgcaatcattgatcatacatcagttcaaggatgccagaagtgacatttgaagaatgcatcctgctctttagctttccagactgagactgaaggtcagattttcgccaagtgtggaagctgaagacaactttggtagattcttaaatatgcatagaaatatatgttgtatttttatagttttaaaatatttctactattccaaatctatactttaaacaagtacaaacatcttttttgattatagtaaaatacacatacacaaaatgtaccattttaacaatttttaagtatacagttcagtggcattaagtaccttcaaattgttgtgcaaccatctccaccatccatctccagaatgacttcctcatcccaagctgaaactctatgcccatgaaacaatcattcccattgtttcttacccctagcccctggaaaaccactgttctactttctgtatatgcgaatttgactatgtacctcatataagtggaactatttagtatttggcttgatttacttagcataatgttttcagagttcacgcatattgtagcatgtgtcagaatttccttcctttttaatattccatggtatggatataccacattttgtttatccattcatctgtcattggacacttgggttacttctatcttttgctgttgtggttagtgctgctgtgaacacaggtgtacaaatatttgttcaagacaaacatctttcaagagactctttttaaaagaaaataaggtgtctcttaaaatatgttccttgtcatgaatgtagagagtggaacaatagataatggagactcagaagggtgaaggggttgaagtggggaggatgaggagaaattggttaatgagtatgatgtatattatttgagggatggataccctaaaagccctgacctgaccactatgcaatctatgcatgtaacaaaattgcagatgtaccccatacatttgtataaataaaaaggaaaataaaaatatgtgccttcttgtgatcagttttattagagggtgccttatcactgtgtggtcaaggaaattctgcctttacagttataaacacacccaccactttgaacagtgtttagttgaaggtattagtactgcctgaggtcaagagtgtggtttcacaatacttcagagcagtctcaccagcaaacttggcagcaaccttgagcaagtcctgtcagggttgttggaaaacagccggtgttttcatatcttttgctctgatagctcttacttgtcagtaccttaggagggaaaatctggcagtagtgtttggttccttagttcactctgagctggttaaatgctcactggatatgcagatatgatttatttcagtggtatgcttctctgtgagcctgtctcactgtggcagctctggaatttctgtttatggatgacattctgtttggaagtggggctgaggttctgagctacaggctgtgtttgcacagcaagctcccttgattttaatttgtattttttcccaaatctgggtggtaggggaggcccaatggagaatatagagcagtatgctccccactgactccatgcagtggtccggggttttgtggtgcctgggcatcttgcagtgacatgtctgtaggtgcttttttgtggagatgtaggaaattgaaattagcttccagctttgtagtaacagaagtgaaatgttttgtaccgttataggcctgataaaaatcaaatgtgactaactggtggttttaaacaatgccagtcaaatctgtttgtttacattgctcacattttctaaaggcacatgatctatctgaagatggaggcttatcggtgagtttactgacagcattgtgtattgtgttatatttatatttcttgtatgatctttttagtcatttttttggagtctgtcttggtctttttactgatgggtgtatgtgtagatttatagggataaataatctttcttcttttttgtggagttgatcaatcgaggactttttaagtccttgatttaaataggtgacctctggaacaaagtaaacacacatgtttaatacttagtcatataatttatacatttggcaatcagtcaaatactccattccaaagaataaccttgaaactgtttgaataaattttttatttcagcatgcaagatgtaatcaaagaaatgtgtctctgggaaaaaagataattgcggttcttttgtgccgttaaaatttcaagtgcagtgagctaacctggcactgtatcagacgtctaggcaaataattgcctgtttgctgttggagtctgttatatgttgtgcatttttggtggctctctacagttctggttctcttatcttcctaatagttcttctttagacaccgtccctggaacctctgcttgggttgcacatgtaaatttcaccgacggttcagccctggtggtgagcagcctgttacgtgcaggctcatgtgggggaccagtttgctttcttttgggtggggtgtcaggtttatgagggtccagctggtggagggctctgattatgtggttttgactcagcagtttccttactgtctgagagctgtcatcagagcttagactgtgcaggaggaagtgatagaaaagcaaagtgtacagtgccgtttttgcactgaggcccctattttaggaataaactctaggggtcagaaatgttgacgtttagattaaatctgacttttctcattttctgatctatattttgtttccagaatggttaatgtaactcctactagaataaacaatggcatgtatttcaagtttaatgttattctacatttttgaaaatttagtaaataataaaatcttaacctgtttatgtatgctctagcttgtcctgcccctctgtctacatgtggaagataaattttgtacactcttcacagtcacaagtgtttaaagatacataacattagaaagtgattttaccaattctttttcttttcacaggtttgttgctgactacaacattaaggtcccttcagaggttaaggctgttcaatttaaaacaatcatgcagtgtttctttgatgactgcagtgtgttgtgcaatttagttttttacccctcaatttttttgttgccttgagttaccatttggaggtacggtttttgatactgtatctcaagactgtgatttcttggattttgtgtgtgtgtgttttttaaatttactgaatttactactagagactgctttctctgtgtaagatccactcctttgtgggagcccagaagtttacgataagtaagagaaggagtatcagatagtgagaggtgtgcatcatggttaaatgaaaacaaaaccaaggtgtttgactctcggcagagagagatttggaagctagctctgttacccacggttcagccctggtggtgcgcagcctgggctccggcctctcaccagcaatggaaccaatggatgttgaggaaattacttaagttgtttgaatcttaacttcctcatctgtaaaaagctcatcctacaggtttattaggggatcatgtttgtaagaccccagcacactgtagatgtagaataaaatggtagtggttattattagggcttcctcttcagaggcaaaaggttttagaatgtggttatgtttttctggtattttattttatcatttaacattgcagaggataaggagttggaaatgaagacagcctagactggctgagaacctcattgtgttgctgaattgaattccattgtctaaactcgttcattttcaccttttctcctgattgttttgtctgctgtggagcatgatgttaaaaacaaaatagatcactgtaaaattttctctatcctggcactttggaaataagttagtctgacaaagcagttctttccacagagagtagaggctttatgtttattttcttctcattacaaatttttttattgttaaaatattttaaatgttcaggaacctactgagaataatacaataaatgcatatatatccagcttccagttttatcaaatgttaactttttgatgtgtttgctttatgtatgtgtgcatatttatttatttagaaaaataaacatcacattttcagtgtaagttcagggaccttgctgtctcagtcattgccctctcatgcctaggagagtgcctgataagtgtttagtaggcaggctccaaataaacactgtgcatcttctccagtagccttcttctcccttcttcccctgatataacacacaaaaagatattgaacagggagaagtatcatgcttggttcagccagtgacacaagtgttagttaaataaggactgagttaaataaggactaccctgaaagaactttaaatgctatgacataaggtaggacaggtgaattcagaagtagctcctgtgggaagcagaacattctccctgcatttgcagagccacagagtggctggttattggaagtaggcattggaatgaacttgaagaagcagagatggggcagggttttctaggctgacaggatcattgattgacagctcagcagtgggaacagtgtttggagagattaaaacaaggtgattcagagttacctgaactctgttatcagaggcgagtatcaggagaagaataaagtgtccagagaatgggtattggttgagcatcccaaatctgaaaatcccaaatctgcaatgctccaaaatccaaaactttttgagcactaatatgactccacaagtggaaaatttcacacctgacctcatgtgatgggttgcagtcaaaacacagtcaaaactttgttgcatgcacaatgttattaaaaatatcgcatataaaattaccttcaggctatatgtagaaggtggataggagacataaatgaatttaatgggtagacttgggtcccattcccaaaatatctcattaggtatatgcaaataatccaaaatcacaaaaattcctgaaatccaaaatacttctggttccaagcattctggaaagagggtatccaacctgtactacatctgatgagtagtgttaggcccttacttaatggagcacaatagcatgctagaagaagagctgatgctgtggaagcagaccatcttggattaaaatttaattcctcttttattggctgcaaggcctagggtaagccacttaacctttctgagcttcagttctcatgtcaggtatgttctcactttggctacaagaggttaagaatgtggaagtgggttcttgcctagccattccattctgtcttaagtggtcctcttgtctatggaaatttgaaacaggcagctaaatgatgagaaaattaaaactttttggttggtcacaaatgtacaaagtgacttcctttacatgaggtcatttaccaagtgatacaagtaaaatgtgaaattgtcttgcctgccaaatccatacttcttcctgtatcttgtgaaaaagtccaacatcctcttagtcatcaagacagaaccaaggaatcatttacaattcctcttacccctgcatccttccagtcaccaagcaagttcattttacctctttttattagctcattctcgagcccctatcacttggtgcctggatttctgctacagctgcccattttctgcccttcttcatttcatcttcccaactgtagtcacagtcctctttctaaactgcaaggatgatcatgttagtcactgcttaaaaatgtgtctgtggttccttggcccatgggttaagacctgagagtcctagttgaacacatgggtttttattgtcatgccctctcatctgccttcctgtcctttgtggttccttgctgctctactctctcacccctgcttctctcctctgatttgtcctcatcttcctagactcggttcttggctatttctgcatagtggtttccagagtggatgtgcttgagaacacagcctgttttgtcaaaaattaacgtgttcttagtgtccagcatggtgtctgacacatagaagactctcaaaaaggttagtggaatagaaatggataagaaatggcttttctatcttcacccagccaggaggactgaagctgggtaacagaagcattctctttcagcacctttctgtctccatcaatttggcatctgctcaacagcccagctgttgatgggagagaagcatatggttgacttgaaagaggcagctgggatgtgattgggtgttcaaaatatattcattccccttcccccatatagaatagcagtaataacaccttctatttgtatttgcattctccttgagtgcttccacagacatgatctcatctgggcgtgtcactaatagcctgagtgctagatggagaatgtgattgtccccattttgtagatgcagaataggagataaaaaggagtaaatacatttgctcaaagttagtaaattgatagtggtataaccagacttcaagcccaagcaagtgcccttctcttttccctcctctttcataaccagcagaaccaggttatatgaaattgatgtttttacatgtaatcatcagaaagaaaagttggcaaaagtaattgtgtttgaaaagtttactctgtgttaactttgcatgtgggcattctttgtaactgttaatttccccaatcctctggttctggttaagtgctcagagttatatgccgccttggggtcacttggctgaaatagcttgaagcatgtgaaatagtgtcctgaggcccactctggatagagatgaaggatttgtcatatttcagttggtcagtttgggaatattgttgacttcaagctatttccctgcctgacagactaagtgacaataataaaatcttagtacttctttctttctttcttttttaaaattttttctgagacagtcttggtctgtcgcccaggctggggtgcagtggtgcaatcttggctcactgcaacctctgactcctgggttcaagcaattctcttgcctcagcctcttgagtagctgggattttaggcacgtgccaccatgcccagctaatttttgtatttttaatagagacggggtttcactatgttggccaggctggtctcgaactcttgacctcgtgatctgcccacctcggcttcccacagtcatgggattacaggcattcttagtgcttcttaagttaacgttaagtacttcgtaagtatacatcccattctgttaatgcaatggtttcttctctcctagaattctggagtctttgaataaacttaagtaggacaagtaaaaaaaaaggctcccagcacttaacagtcatattcttaatttccaggaatttctaaattttgaaaattacagcctctgaagtgggctgttgcagggaaactgttcctacgtgttttattaaattctatattcttagcagcaaagatgaagaaggcagagtgagactgaaaatgcaagggcaaaagcagttaggacacaaccaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccagctagcatgattgggttctggtgagggcccttcttgggcttcatagatggatgccttcttactgtatcctcacatccagagagagaagtcatctctctctgtcctgtctcttctgataagggcactaatcccatcatgagggctccctgctcatgaccttcccaaaggagtcctctctgaataccgtcacactggggactagggtttcaacatatgaattttgtggggcggggcggggcaggggagcacaagcattcagtgtgtagcaacttctgtgaatttttttttctttttttttttttttgagacggagtttcactcttgttgcccaggctggagtgcagtggtgctatctcagctcgctgcaacctccgcttcctgggttcaagcaattctcctgcctcagcctcctgagtagctgggattacaggcattcaccaccaagcctggctaattttgtatttttaatagacacagggtttctccaggttggtcaggctggtctcgaactcccaacctcaggtgatccacctgcctcggcctcccaaagtgctgggattacagatgtgagccaccacgcccggccagttctgtgaattttaacacagacattaattcacgcaaccaccactacaaacagcatacggaacaatttcctcacccttcaaattctctggtgctgcctttttgtagtttaaatcctctttcctcctgaactcctggcaatactgatctgttctctgcctttataattttttctttgtaagactattatgtaagtgggattatacagactttttgagactagctttcacttagcataatgcatttgacatccatccacattgtgtgtatcaaaggtttgttcctttttattactaactagtattctgttgtatggatgtgccatggtttgcatatgtattcacccattgcattcccagcagcagaatatgaaagtcctagttgacctgtatttttgctggcatttaatattttcagtttatgcagttcagctattctaataggtgtgtaatggtatttcatgatgattttgatttgcatttccctaatgattaatgatattgaacatcttttcatgtgtttgtttggcattcatacatcttgtgcccattacgatatgtgttatgctcattgtcattatcataaccttgttccaggtggttattatgcctttttatatcagcattgttgctcacctaccgcagcatatgccaaggtcaaagcactgagccagggactttgtgtacctaatctcattttatccttaaaatctttgtggaattagtagtgctttttatttttgtggtggagaaaataaagaccccatgttcaaaacatactgagtgcctaccatgtgcaacgagccagttgtacccatctgctagtctgtgggactagcagtcactgactttaagcaagtcagtgtatgaatcaatttccttttctgttaaatagggatctgtattatgatatgttctctcagggttgttgagtgaggggttttaagagagaatgcaggaaacatgctgagcaggagatctggctcatgatgtattctgagtaaatgttagcaatagctgcttctgtgttcttcaaacacctcatactgacctgaggtggtttctctccctccctggccacttttctagtcagtaacagaaaggttaaatgtgccaaatgttttactttgagtccattccagctccaatgtttatgtaaaaaatgatatcataaagggttgatctagttagcaaggttattgtgcttacagtaggccagaatgtggaaactatcatattagtaaaaaagaaattgggctgggcgtggtggctcacgcctgtaagcccagcactttgggaggccgaggtgggcagatcacctgaggtcaggaattcaagaccagcttagccaacatggcgaaaccctgtctctactgaaaatacaaaaaattagccaggtgttgtggtgaatgcctgtaatcccagctattcgggaggctgaggcaggggaatcgcttgaaccagggaggcacaggttgcagtgagctgagatcgtgccattgcacttcagcctgggcaacaagagcgaaactctgtctcaaaaaaaaaaaaaaaatcgtgatacaagtaagatcttttaaaaattattgaatcatccatcttgaattatgtgaggctttatatatggaagcaagaaaatgtttaaaattacctccctgctatttcctgctagattgctggggcttgttttctcttaatcttgccattgccaagcatacatctgatgcctgctgtgtgccaggtgttagtctctctaatcctcacagcaaccctttgaaataaaagatatccacattttgcagaggaaaacattgtgcctgagaggccagttgccctgcccagtggaacccagtcgtcttctgactgagtcctctgctcttatcggcacccactctgcctcagtctcattgtgatgggggcatgaaagctactgtcactaggaacactggcataccttcccccaatatggcatctgtttccttcacggggactgtttccaggaccttaaggtcacacttgcctaccacaagccctgaaattagatggttttattttgtctaaaaggcccactgtggaaacagcatgaactttgaagtcaacaataggttcaagtggtgtctccaccattttattttactgcctatgtgattttggccaagttacttaaactctcagagcctgtgattcttcacctataaaatgggaataatacatacccggtagagatgtggagagaattagaaataacacagtaggctgggcatggtggctcatgcctgtatcccagcacattgggaggctgaggctggtggattacctaaggttaggagtttgagaccagcctgactaatacagtgaaaccctgcctctactaaaagcacaaaaacgttagccaggcatggtggtgtgcgcctgtagtcccagcaactcacgaggctgagacaggagaattgcttgaacctgggaggtggaggtggcagtgagccgagatcgtgctactgcactccagcctgggcaacagagcgggactccatctcaaaaaaaaaaaaagaatgcagtatgcagtagagtgcttaataagtgcttaggacattgtagatgcttattaactggtagctactatcatcaccattgcagggccttctgacttgtcttgggggactgaagaagctgtccagagtggtggttaagaatatgggctctggagtaaactgcttgggtttaaatccttgttctaccacttatcagctgtgtgactgcataactgaattccttcctgtacctcagtttcttccatctacaagatgggaataaacagtttctaccttgtcgggataaatgattttaaaaagacgagaactgtcaggaggttgagttgaaatgaacttattttgattatctactgccattgtttcttcccatgacatatgagtctcttttaaatttatgataacatttcttctttccttcctactcaaattgagataatttctcattatttgtatttcatgctgataaaaacatttgctatcacatttttcctagaaatgcagattaaattgtaaaaattactattttcatctaagaaactggattaactaaacctataaaggacagctttttatagagaaaataattgagaattttttgtagaattactataaataaaatcaagtgtaataaataacaattttataggtaaaaatattaaaaaacctaaccaactgcctgtttaaaaaaacacacatagatattccattatttcacagaaattatttgattctcctgttttaatcttgaatttggctgggttgcatgtgaattactctttttctccttcaagaagataccagtcaggtgggcccatagtatgtgaatctaccaggaagaaaacagcctctgaatttactgtatgtctagaaatcaaatttgacttatacccatgggcagtgtgtggtgttggctgggtttgcatcattattctgaagtctgtactgatgtcgtgtgactaatatgttccagctgtctaggtcactgctttggagtactatttatttgtagtagtgatgctgcaaataggaaaagctttcccttttgttggttgaaagctttcctggtaattggcaaaacaagcatgcctcttatttggagagaaactggaaaggcggctaaagagtcaattgtacacaaccactttggaaaacaatttggcattagaggagttgaacacgtgcaatccgtagtccagctctcctctcctaggtatataccctggagaaattcttgcctgtgtgtaccagaggacacacagtagaatgtaaatggcagcattattcaaagtagcagaaaattgcaaaatccccagagggtccccaacagtagaacagaacagtaaattgtgggtatgttcacacaatgagaactgtatcgtggtgacaaaatgaatgaactaaagccacatgagtcaacagggatgaatctcaaaatcttaagaggcaagtctagaagagcacataccgtattgtttcattcatagtaggcttagaatcagcaaatcacaacaacatattgatagcacatatgtggcaaaaccataaagaggagccaaggaatgattgactcaaaattcaggctagtggtgaatcttggtggtggaagtggtggtgaaggatgattgggagacatgcaatcaggaaagacacacacacacggcttccaaaaaaagaaaaaaaaatttaaacactggtattaggtacatgagatttattttattattctttacacctatatatgttgataggttacttatcactgcataacaaacctcaagacttagcaccttaaaacgataatacacatttgtcatctcacttagattccatgagtaggccaggaatttgggagcagctaagcagggtggttctgactcgcagtctctcatgaggttgcagtcaagatgtcaactgaagctgctgccatctatttgaaggcttgactgaggctgaaggatctggttccaagatggctcactcacatagctgttgccaggaggcctcagttccttgctggttcttggcaagaggcctcagttctttcccacgtgtatctctgcagagcttcttgagcgtgtcctcatatcagaacagccagcttccctccgaaaacagagatggaaggtggagtctttggacttttgcagtctcacgccagcatttcagcaatattgtagtggttcccacatgccagccctgttccaagtgggacgggactatacaagcgcatgaatactgggaggcggatatcaccacgggccatcttggaggctggctaccacagttaaacgcacttttaaatatagtatatttcacagtaaacatttttttagagacaaactaaattggcgagctcatttttctttagtaatagtgcagccatccatttaaatgaaaagttttatagatactgaatgtgttaccaattagtatgggtttaaagaaatgtcagtgatgtagctgagtatttgagtggcctgagcttgcctgacaagaacgtacctgaggcaggggagtgggtgggaaaggccatgaggaaaggaacttcagtaatacttgcgccgggatctgtggtgggagatgggatgatacgtgcctggacttcattctacgtgtacctagatctggcaacaatctgagactcttgattttgaagagaattctccacatgaagggccattgtgatattaaaatctgtttcagccccatactttttcccaagaccatctttaatgaaaaaggagagaagggtccaccccttgctactcacccccacatctaagagcatggccaaaaatgacctaggcaagcaaggacaggggccttagcttaaaaatctatgcaacgattacattctaatccataatttatacttgttttaatgttaacaacttttaaattattgattcatttacttaaccttccctcaccaaaatctttgagtaacactgatgtttctggaagctatgtcatgtttatttttctttagctttgtttggctcttggcataacttcttagtgagtattcctgggggtctaagtgttctgggttgtgaggcagtgagtcgcaccatctcccctttgtggatcccaacatccttgtgagcaggtgttgcagccctcaggtgaggaagcagccggaagaggttctctccatttttaatgaagctaaaaagtggaggagataggcctgagagccaggtgcacggggttccagactggctttctttaggcttttgtacaccagtacttcgcgtgttagtcattgatactgctaactctctgtgtctacagaattctggtgattagcagatgaagcgccaagtagggccatcatgcagagatgtcacgttctccccaactgtagttttgatgctgcttccatctttatttgcggagctgtgtctgtggcattatattctagtgtattttgcgttttataaaaatgaaaggaaaatcctcaacagcaaatataactgcctttcattatggagaggttaaaaatcgccagcgatgcagtgtgatgcttgttttccttctgttagtgaacagtgtgctcttttgaggaagaaggaaaaaataaagtgcatgtatgtatataaatgacaaaaatacattaagggttattgtgtctacaagagaagtataattactaatagtaattatagtaattggtaataatgattatagtattaatggtactattaagaaagattgtgaatatatgctttcagggagcacactgcagtgcccggctgcctccttggtgtgatgtgttgtttggccatttggctgtggggttggttttaaggaaggcatcatgttcgggagcaggagggtggaggtgatctgtatagtgagacaagcccggggcttggggtcagaagacaaataggagtttaatctctggtgctttctagttgaatatccttgtcagatatcatctctgacgcttagctgccttctctggaaaatgggatccataaaccctgcttacctcacagggctgtgatcaaatgtgatgggtaatgccaaaacagaaggtatcgtcatggcaacaggagtatgactttcaggccatgataccactttgccgcaaacttgtgtgtattgtagttgagtatactgtagattggatctgaatacctttgctggaaaggatttgaggaggttcagcaattcctgtgtggttctaggtgggtacgtggatgccttctaagtgtggtctcagaaatccaaggtcagagtaaatctcaagtcattgaagctccagtttttgttagagtggatgtttgggctacatcactgccctgaaattgctgtgattcgacaggaactgaggcaaaccttcagctataagatgaagacctaatgcatggtgactatagggaataataatgtatatttgaatttgctaagacagtagaccttatgtgttctcaccacacacacacaaatggtaactacactgtaaggctcttttagaatttatctagcaagttttcttgtttttaccagaaaactcctcaaaaaaaagggaattgtatgaggtgatagatatgttaagtagtttgtggcaatcatttcacaatgtatacatatataaaaccatcaccttgtacactttaaatatatgtaatttttatttgtcaatcatacttcaataaagttggagggaaaaaaaaagaaacttacagaggaattcctttattccaaaatttcctagagtgggtggggctgatagttgttccctacattcaatatgtgatgggattattttttctttttttactttttcccctattaaaaagttgtagcagtatttaaatttagaggcttatcatatattaagaacacgttctcaactgaaatagtattaagagtaaaaattcttggtgataacacgcatgttgctttgcttattcttgcagcgtgacgacagcatgtacgatccctgaatgggcccgtgggcatatttagtcattcatttttgatcaggagaaagaagacagccatcatttgaaaggtaagtaaatatttctatgcagctttttattgtaaaacattttcaaccatactgaagagagttaagagaacgtgcaatgagttcctgcctatctacaccttagctttaacagttattagcattttgccacattttttggtgtgtgtataggtttgtacattttttagctgaaacatgtagaagttgcagatattatgacattttttcctaaattcttgggatgcagctcttacaaataaggatattcttccctgaaagaccttttagaactacgtggcacagaaccatttaattaaatttatagttttgtactgaagtgtgtaactgagttatgctcccttcactgttgatagaaataaagtcagattaaaaacatttttaggccaggcgtgctggcttacacctgtaatcccggcactttgggaggctgaggggaatggatcgcttgagcccaggatttcaaaatcagcctaggcaacaaggtgagacccatctctagaaaaaatacaaaaaaaattagctgggtgtggtggtgcacacctgtggtcccagctattcagcaggctgaggtgggaggatcgcttgagcccacaaagtcgaggctgtagtgagccgtgatggagctactgcactgcagcctgggtgacagacaagaccctgtctcaaaaaacaaaacccaaaaccatttttaatagcaagaccttgtctacaaaaaattaaaaatttagccagtcatggtggcacatgcctgtagtcctagctacttgggaggttgaggtgggaggatcgcttgagcccaggagttggagggtgtagtaagctatgattatgccactgtactccaggctgggcgacagtgagtcccagtctatctctctcacacacacggagagagagagagtgatttctttaatgaacagataagtaatatgaatttgatatgagaaaaatctgaatataaaggcatggaacttgtactgtacatataccccaagagagaaattactgtgctttcttcatgtaatctacccatccccgccatggctgatgtttcatggttaggtcagtggatctgatcaccagcctcaccttctccctgatcaagattcacaaatagaccagggctgggcctggtggctcatgcctgtaatcccagcactttgggaggccgaggcaggtggatcatttgaagtcaggagtttaagacctgcctggccaacatagtgaaaccctgtctctactaaaaatacaaaagttagctgagcggtagtgacatgtgccagtaatcccagctactcgggaggctgaggcaggagaatcacttgagcctgggaggcagaggttgcggtgagccgagatcacgcctctgcactccagtctaagtgacagagtgggaccctgtctcaaaaaaaaaaaaaaaaaaaaaaaaaattagatcagtctctgtgctctgatgtgatcaaaggtcttagctgattttttaaacctaaacttataggagaatgtggaaagaatatgactggtactgtgaagttgatgttatataggttaatgtattaaaatcagcattagagagattaaaaatgattcccagcctcataatttgactacctacattgaaactttacttaaaatctcaaagacatgttcagctatgattacagttgtagatctttacacattatagccaattacaccatcagttatctgtggttcttgcaagatggctgtcgactgttctgctttccaatctcagttactatttatttacggtatcttcctcaagtcgtccctgtgtatctaagcattgttttacagacatttgtgtctataaggttgcctatttagagcatattttaaagaaagtctatttaagtgagccatttagggcagcagtggcttcttatactctcatttctgatttagaacaaaaggtcagtgatagcagtaaaggttcttcaaaagatactggcattcagaaggagttgtgtctggaatcacgggtagctcagaatgattgagttttgcttttttattctttggcctctgtatggttatgctttgaaaagatgaggaggagtgagtgggactccacgtgaggcaaagggggttttgaaggatgaatgaagggaagacatatggggtcctgtctagtcctagaccactgagatatggtgattttaaaaaactttctactgaagtagaagatacatatggaaaatagacatattataagtgtatagctcaatataacttcacagattgaacacatccatgtaaccagcacccagattaagaaacagagcatgactagcacaatctcatgcttccttttagacactacagttgactcttaaataatttggggattaggggtgcagttgaaaatccaagtataattttgtctccctgaaaatgtaactagtaatagcctactgttgactggaagccttactgacttactacataacgacacacacacacacacacacacacacacacacacacacacacacacatatatatattttgagatgcagtcttgctctgttgcccaggctggagtgcagtggcacgatctcggctcactgcaacctccgccttctgggttcaagcgattcttcctcccgagtagctgggattacaggtgcgtgccaccatgccaggctaatttttgtatttttagtagagacacggtttcaccatattggccaggctggtctcgaactcctgacctcgtgatccacccgccttggcctcccaaagtggtggaattataggcgtgagctgccacgcccggccaatgacatatattttatgcattcacagcatacctcatatttccttaatttttttttctgctatttgtaggctatttggtttatctgtgagctttttcaaagtgttgcaaatctccaaaaaaattttccaatgtgtttattgaaaaaaatctgcctttaagtggccccttacagttcaaaccagtgttgttcaagggtcaactgtacccttgctccatggatgactactctcttgacttctaggagcataaattagttctgcatttgtcttttctttgtgtgtgtgtgtaatatataatgcagattgtactcttttgtgtctggcttctctcattcaacaacatattagattcctgcatattattgcatatagtttagttattgattgctcattttcatttctttagagcattccattgtgggagaatataacaatttatttattttactagatgtgggtaattgtttgggtttacccatctggggcaccctccagaggaaatgagaattaaacaaggttttctcctcatcatggttatagtggaaatagtaccaggttgtgctcagcttctgctgtgatatgagggaggaatctagacagcagcgagaagattgagacacacttgggagaattgggtgtggtttcatcagtcctgtgctgattcctgctgctcttcctgtgactcaccatgtcccttctcacgtcgttccctactggcacatgttttctacgtcctcttctctgccattattactttctctacagcccctccaaggagactgtgcagaacatgtcaaacaacaggcaattgatgaatatttaaagttcattaggtgttgatattaagtgttaggtgaggggcaaagagttgaacgtttgggcttgcccttgaggagcctgtagtatagttatcaattcacaggtatggcagtgggccacatccccggaagccagttgttctgtagagttcagggatgtaaattcagaggcttacatgggccaggctggtaacgtgactgaaatgaatggggttgctcataaggattgatgggcatggtggagagtgagtgtatatcctctgcccaaatatcaacccaacaaactctgtccagctcaatttagcaagtccaccattttccaaactttagagagtagagtcatcattatataataagaaagtgttcctcagaggatttgggtgtttttatggaaaaattctgtttttatacataaagttttattcaaaaagtcatgctcatttgtttacatattttgctataactgcagagttgaatagttgcaaaagagaccagggttgagtagttgcaacagtgaccatatggcctacaaagcctaaaatatttaccatctagccctttacaaaaaagtttgccagctcctgctttacttcataaaagcaaggacatagtaatcataacctctgtagtcatgtagtaatctgagcccattaaatttagtgttaatgttctcattcatgtattcatccaacacgtatttacagagtgtctattgtatttcaggcataaaatggtgaaaatcagatatggttcttggtcttgaggagtttaaaagaagctcctctatcacttcttggccttttggctaagatcaagtatagtaaaagagtctcctatgaatttgaaattccattccatgattgtgctttctataaatcaaaaatatgacatcgtggtgtaggggcatcccctgtcagctcttctagttatgcaggtagcgcatttccgtgtgcaccaaccacatggggcttattctcagcatagctgcttttagaataaaaagtataatatggaagtggaactaaaaatcctcaatttaaaactattatgtcagctatctttattaattttataaacttgataaacacttaccctacataatttgattttttgcttccgtaatgaggagtatgtaatgtgatgtttgcacaattactgtagttttaaatgtcctaattgtttacatgtggtaatgccagactgtttgaaggtagccatgtctggagaagggatgagttttgaagtgcttactaaagcaagccaagcatatggtcagtcttgtgctactttaataataaacctcaatagaaacaacagccaaccaagataatagagtttggataataaagtttggaatgcagcataacaaattaatctatctctgtttgtgtgcttatctatttgcttatcaaagtcataaaagtttgtttcttcttaatagaaaatatagaagtatttttttacattaaggaatttgaaacttgtttttaacatcttttacacctgtgtagcattttcatatgtgcttgtatatatattatgggtggacactggggctgtgagtgactgcccattcaccacccctacactgtcctcagaccaatgtaaaggaagcaagtcaaaccatatcagtgaaccatcttcagccatgatgtctgcatcattgccttctttcagcctgagaggtctttcaggaagtgggaatttgtttggatgttatagttgcagttatttagctatgtgcagtaattcaaagatgtgaaaatgcaggaagccctggtcatacttacacatggatttgggagccatcagacatcaaatgggatgctatttgtcaccttttgaggcagtgatctgggtgacccatagtgctttcctctgaaatcttaggcttctgaagaaaccacagggaaggaatgtgaactggtacaataaatagcttaatgaatgtgatgaaaactccaaactggtttgttttgttgccaaaattaataaagttaaggtgtagttgatcttttttttttttttttttttttgagatggagtctcgcactgtcacccaggctggagtgcagtggcacgatctccgcttactacaacctctgcctcccgggttcaagtgattctcctgcttcagcctcccaagtagctggaattacaggcacccgccaccatgcctggctaattttttgtatttttagtagagacagcgtttcactatgttggccaggctggtcttgaactcctgacctcgtgatcctcccccattggcctcccaaagtgctgggattacaggtgtgagccactgcgcccagccaatcttctttaggaggaagaaatgatctatagccattcatgtcttctactttttgtgtttaaaatgttttaaagaattcagtcatattctttttagtgattctatatggatagttgtttagaggaaaaacaagaattgagaaggctgagaaaataaatatcatagttgttttcttacaaagttggaaactgtaggcttagttcttttgattaaaaatgaaattttctgaaacaaattttttgataggccagattccttgttctgtggcattggaaaaatgaagtctgttctacataatgtggagttatcttgtcaggaagtccagcctcagaagtgttgctttgtcaagactagccaattaaaattcacttgaatagtcttcaagttttatttttagagaggggaaagtactgaaagtataggtaaatttagttgatagaacagagtgccttggttgcaagtgacagaaaactcatttcaaactgtctcaactgaaaaagtctatggccttaagtaattgcaaatctaaggactggatctgccttcaggaggggctagactaaggatcaaaatgatgtcatgaggattcatcttggctacatgtttttgggctctgaatggagacttctagcagcttcaggtttgcttagttacaaacaaacttcctggtcatgatgagtcatgtgcctcatgctggaccagtggctgtggccaggtatattggcctattccgattggatagccagatcatgtgcttcactccagggcctgaggtcagcacatcttctgcagaaggtgaagcatgaactgatgatagctgggaatggttccctccaagggtgaatcagggcagttaccaagaggattgggggtgctgggaggtacactaattattataatgattattattaatgtatcttttaatggtttgaaaagcattttcagatgtattcttgtttgacctttaggagatattggggaggcaggataaagaagtgattaaaaacatggattctggggctagactaggttcagttattagcttgcatgagcttttgaccaattacttaacctctttgtatctcagttttctcaaatgtgcaatggggataaaggtatttacctaaaagagttctgagaaggatcgaattaatggacatttgcagggcacttagaatagtgcctcatgcacgctagcctctctatccctggttattactgtcaacctttaaagctgtcctgctggcaggggagcaagtgtcctcttcatttgacagataaggaagttcagactcacatgacctgtaagggtcaacactggtttggacctgacttcttccctgtccccacacttgcctctgtgttatgattgtggggcatttgggttagtaataaatcaaggaagcagagagggaaaaagcactagaaagtaggcctggattaaagtacctgtgtggtacaagaaaggcagtgtttctgtatattccacttgaacgttggtctttagcttcccacatgaacggtgcccccagaaacatttaagggaacattcctaagaagaaatttttccatcctgccgggcacatgcttgggacaatcagccatatccagggtgggcacttgcttgggaaatgtttgctgatggtttaatcagatccagtattctgagtttcagaggagacaaagctttttatggtcaggaggtgacttgaacccttcagtgtggtgtgaggacagaattgctgactctgagaggtttggaccactgcagagtgctgctctcacgaccgccagccagttctgtctgcaaatagatgccattttcctcattaggaatattttcccacagttgttgagaatgttttgtggggaaattatccaaatgacttaatgaaggagatttttttctcgagactcagatgttggtatggcccagacatctagggagggtcttgctgttctctgaggacaatagtgatttctttgtattatttactgtggactcaggacattggaagcttaaagtatttgtaagtaatctctgatacgctcccaagctatgcagctatgaaagcaaggaaaaacttagcagaaaacacaattttggtgctctctgccgtgcttttgaggaaaaatagtgcttgccattcagcattcacaaagcttgctggagggccagagccgcttcttcactgcaggacaggctctgccctgcggttgctgtttccttgcagacggccactgtgcctaggatgtgggagtctcagatatttcataaatggatcatggctttgtctttttctcaatttcttttgacaagaaattgtttaccatgtagatgtcttcaagaacttcacctgtgagtcctgcattacttctgtctggacacatcacattgtttttgttgtttctttagatggaggatgtggtgtctgagtattgatccccacacctggctttacaatggtgtttttattccaaagaacaacacctattcagagagtaaagggattagctacttattctagaaaaatgaccctaagtttgccaaatatttgtgggaattataataggttcttagatgtaatcccatttattttgttcttagctccttaggagtcttttgccttgctgcatagtcagggattgaatattaatagttccttcgttgcctttaacctgaccccattttacatctgagaaaacaaggtcaaccttatttcctgtaatgtcagcaacaaaagcaacaacattattattcattatgtgataggcaccactctgagttattttgttggttatcctatttcatattctccacaactctgtgatcattattctctagatgaggaaattgaggcataacctgcagcctcaggatatggctgagtggcacaagtctgctcttagcatcacagacgctgtactgccgactggtgtggccagtgtccagtccagggtctctaccactggctgcacattagaatcaccctgagggattttaaaagcactgaatgtgcagttccataactccccgctccttacatacttatttacttggtctggggtctcattggaggttgctgtgcattcaaaattgagaatatttttgaactagagcaatagttcttaaaatttggtccctgggatggcagtatcaggtaacttgttagaagaggaaattctcaggcctcacccagacctactgaattgaaactctgggggtggggtgtggtgatcagtgttttaacaagtcttccaggtgattcttttttataaaacatatcgtagtaaaaacacacaacataaaatttgccttctttactgtttttaagtgtatggttgactcgtgttaagcacgttcacattgttgtgcaacagatctccagaactttttcaccttgcaaatctgaaacttcatacccatgaaaacccattaaacaactccccttctctccctcctgtaacccctggtaggaaccattctactttttgttttcatgaacttgactacttcgcatactttgtctaggtggaactccaagtgattcttaggcatgctcaagtgtgagagccactgaactccaaaactcaatttggctctctccctatagttgcccactcacgtcattaatatcaaccatattgtaaatcccacactcctgtgcatgccccgctctttctagtcctgtgtctgccaccttgatgttctgtcactttgatcaagttacttaatttccccgaggtgattcccttgtctctataagtgagggttgaggggtttgggggggggtccctaacttgctgtggtaaatgttaaatcattagacacttgtgaaagtaatttgtaagttgtcagatggtataataaatattaggtatagattgtaatcatcgtctctttttaaattgtaggttttgtttttattgcagtcatacacctttgattttttaaaggattccatagttccacaaggcctcttgtggacttaagttcctgttatgcctgttatgcttgtttctcttcctcctcccccatttcttatctggtgtttacagtgtgtaaacaggattcacaaatgtgctgggtaatatagtatagtttgattactttaaattttctgcacacacacaaattgtgttttccttggatttagtaattgtgtcttttaaagtttttctatgcacttaccactactttaaccataaacagccttctatgtaaatttcctcttaatattttaagccatatcagctatcttatcaattacatctcggagaaatcttacctggagtcttacgctttgctccagtccagactacttgctctctaggcctgctgtgtaccacatcttgggatcctctctttaacacctttctgggcatttcttatatcttgcctatgtattggattcccagtttccctcattgcatattctcttctttcttggtttactcccgtatttgggaggagcacattttctggaagtgtcctagaaaatttcatatgggaggtaagacttttgtgttgttatatatctgagactgtcacattcacgtttaatttacagtgtggctggggatagaattctagattagaaatcactgagcttcagaatggtgaaggcattgctcattatcttttagtatctagtgttgattgtgagaaggctaagactgtctcccagtcctttgtaggtgacttcatttttcttacttttttctctcgggtttttcattcttttctttattttcagtgttctgaaatttcataatattccttggtggggtctattttcatttcttggaaacttgcatccttcatttttagaaattttcttgaagtgtatcattgttgaattcccccctctgttttctctgttctctctgttctttctggaattctgttagatattgacttactgtcttatgacagccttaccttttcttctgctttccgcatctgctttttagctgtattcttaggatatttcctacgtttaccttctaacccttctattcaatttttcatgtttgttataatgtttttttaaaattttttgacagtttttttattctctgattgcttttattgtatagaatcctactatttcatgacagcattttcctttagttctctgaggaggttaatgataactttttaagccttttttgcatagtttttatttccttcaagttgcttttttcctctgtttctgtctttcatgttagatattttctttatgatctttgaatgtccattcatgattaagaatggggctttacaaactggaagatttggcttattgggcctaagttagttgctgtcatctatcagatttccagctttaaaaagcttaacattttaatctttgtcctattatctttgtccttgtagatttatgcatttaaaaagaaataattttgtggtgttggggttttaggagggagagaagctgaatatgtgtgttcatccactgtctttaactggaaatcaatatagaagtcttaaaaaaaaaatccaggtcagaatttgcagcattggtatttgttcaaacacatacctgcggtggtgagcattagcttggtgttctattattttttaaagcatggtatatatttagatggtctcagcagagatcttggctttcttgttaactgtgcagcagctgcctctttttcttagctaagagcttttatttcaggtgttaaaataccaataaatttataaatgataattgggccttgtgataaaaaataaaaattgtagaaaaaaatccttattgatgttcctgaaagaattttccaagggtaagcatataatccttagattaaaatgcagctgacacattaagtcttcttacatgaaaagctgaattaataggttttaatgccatttgtccttgaccacccacaaagggcattcccgcaggctaaagagactggacataaataccgcaaagggagcggggctgtatttgtggttttgatccctcataaatgcttccacaaagcattcaagctcagaccatcagagaacaggtaaaaagctattgttagcctttctgatagcaggtctctgcaaaaattaagcagttttagaagagcagagtggttcttttactataggctaactgaccttggattatttcatgatctgctccttgaggtgataagctcagttgcttcttgtcttttctgaacgttacatgtatcctctgtcaaataccagtccttccttctagcttactggaacacttagtcattgtgtagtaaccaacatggtcatttctggccctggcgctgattagataacagaagtccccttcacaagcttcgcagctctgtgcagtagcagccctttaatagctgtaacttcaccactgggaaaggaaaggaaaggaaagcctctctgctttcatgctgattgctatggaagcttgcccaagatacttccccttgcatgtgcagggctgtgtgcaaaacagagaaattgctttccacttaaaagcgttggcctgttattactctatgaacctttgaggaaatcagattcagaggtttcctaaatatagaaagttcctttctctcttgttattaaagccacaaacaatctaggggtaattttttatattattttgaggttgcattaaaattaagaggaaggacagtactgcagagatgcctggttgtttgttgggtttcttaaaaggactaaatatgaataaattacgaattcttgcacgttaggaaagggaccttttgttgttgttgttgtttaattagctactcctgcctttctctatactttttttatgtcttcttcatgctctccaaatctgtcttcttgttcctaatgtatatggtagtgaaatgaactgtaggagctatgtccattaaagacatagacaagggtttttattgctaagagggaaccatgcagaagatgacaaattaactgaccatcacccagattgggttttcctgagctgtgtcatccccgttgatcatcacagttgttgcctctgccacaagtgcacttttaaagctccagcccaagcaagttacccctagcttaacggaagcagcctgagtcttccaaaagactcctctgaattctgagggccagccaaagaaactaaaccttttttatgaaaaggaaaactatcactgttctttgtagatactaccagtttctgatcttgcctagaactagttcactcccagggctttaagtcccagctctatgcagtatttatagatgacaggataaaagagccaaggaagagccaaatacttacagtttccaagtggatttagattatttgcccataggacaaccattgtttcacattcttttcttttgccaccatggtgttggcacttagcatgtggtaattataatttggattctttaacacacttctattggcagaagcttatgtatatacatgtggtgcaatgggtgacatcaaaagtgctctccggaaatgaagggttgcacttatgacatagatgattttctgattcaaaaaatttgtgagctattatgagacagacaacagctttgtcattagtcatttgagattgttatgaataggcccctcatctggttgagaattcacgtgcccagcttttctatgggaaaaattgttcttcagacagagcatgaatgaaatattctatctattatgggactccccctgcttttggagggggatgagaagaaagggtggcatttatggaatttggctattctgccaaaaggggcgtgctcctccagtggcagctgtggtggctgctgggaggaaagtggggacaagggtgactctgagatgagtgtactcgatcaggggcttcagaggttgctggcttttcacaagagacctcagtatatgatgcctgtgtggaggtcacagttatgacattctctgagagatttactgttgggtctataatgaggatgaactggccattgtgtttaaagaagttgggtctcacctgcagggtgagctgcctcagcacatccattacctgtcttctcagtgggtacctcatggatcagaagctggggccgagtaatacagtgttaggtggttggtgtggttcccatctcctgcttgacttttgctgggaaagtgtctgtaggttccactctctctaacatgggaagtgatgccagagggaaaggaagaggcaaggcagatgccgctgaggttggtgctgtagtggacatagctcaggcaggatgtgaatggggctagggctctgggagtaaaacagctctgggaagatcagaaacatgtgttaacatgaacagttatacttctttgctttatttctgttttgattttctgtggaacttaaaaagcctttcagaaggtattggaaatgtatttatgcttgggccatagctttcttgcttttgttttttccctagccttattgagatataatttgtatacaaaaaccttcacataattaatgtatacaatttgatgagtttggacatatgtatacacttgtattaccaccaccacagtcgagataataaacatatctatcacctccaaaagtttcctgtgtcctttgtgtgtggggggaggagggtgacgggggtaagaacacttaatgtgagatataccctctttttaaagtttatttatttttgaaacagcatctcactgtcgcccaggttggaatgcagtggcaccatcatagctcactgcagcctggaactcctggggtcaagggatcctcctgcctcagcttcccaagtaactacaggtgtgcaccaccatgcctggctaatttttttattttatagagatggggtcttgctaggctgcctaggctggtctcgaactcctggcctcatgtgatccacccaccatagccttataaagcgttggaattgtaggcgtgagccactgtgcctggcccagatataccttcttaaatttttaagtgcataatgtcttattgttaactataggcactatattgtacactatgttgtactatgtatggaacttactcattttgttttgtatgtaacttcatatctatagaacaacagctgcccatatccacccccgttccctggtaatcatgtagtatttgtccttctgtgactgacttatttcacttaacataacgtcttccacgtctatgttgtttcacatggttgaattttcctcttttttaaggctgagtaatactttgttttatatatatatatatatatatacaccacattttccttttaaaatgtttattcttttaattgacatataataattacatgtacttatgggatacatagtgagatttcaatacatatgatgtggtgtgatcagatcagggtaattagcatattcatcatcggaaacatttgtcatttctttgtgttggaaacattcaacatcttcctacggtaccacatttttctttatccattcatctgttgatggacctctgtattgtttccatatcatggctgttgtgaataatgttgtgataaacatgagcatgcaggtatctcctcaagatcctgatttcagttcttttggatatatacccacaagtgggatcactgggtcatatggtagtttttaactttttgagaaatttctatcttgctttctatagcagttgcaatttacattcccaccagtagtgtgcaagggttccaacttctccctgaccttactagcacttgttatcttttgtcttttaaataatagccattctcacaggtgtgaggtgatatctcattgtggttttgatttgcatttccctgatgattagtgatgttgagcatttggtcataaacctcttggctacttggatgtcttctttggagatatgtctgttcaatgctcatttttaaattgggttatttgtttttattgctattgagtttttggagttctttatatgtaatagatgttaatcttttttcagatataaggtttgcaaatatttcccccattccataggttgccttttcactccgttgattcttttctttgctgtataataccatatctatttttgcttttcttacctgtgcttttggtgttatatccaaggaatcattgccaaatctaatatcaagaagcttcccccctgtgttttcttctaagaattgtatagtttcagatcttatgtacaaatccttaatccattttgagtaaatttttgtatatgatgtaagacatggttcaattccattcttttggatatagatatccagctttcccagaaccctttattgaagagactatccttgccccattgtgtgttcttggcacctttcttgaagatcaattggctatatgtacatgggtttatttctgcattgtttattctgttctattgatctgtatgtttatctttatgccagtaccataatgttttcattactgtagcttcataatatattttgagatcaggaagtgtgatatttccagctttgttctttgtttttcttgcttaaaattcttttgactatttggggccttttgtggtttcatacaaattttaggatttttgtctttctattcctgtaaaaaattttctttgggaatttgatcaggattgcattgaaactgtaaattgctttgggtagtatagacattttagcaatattaattcttcctatccatgaatacacgaaatctttacatttatgagcaaagttttatagttttgtgtacaagtatgttacctcccaggttaggtttatttctaagtattttattctatttggtgctactgtaaatgagttgttcttagtttcctttttggattgttttgttggtgtacagaaacacaactcattgtttttgtattgaattcatttattctaacagttttttggtaggatctttagggttttctacatataagattatgttatatgcaaacagatagttttacattggataccttttatatcttttcttgcctcattgctctggctgggacgtctcgtaccatattgaatagaagtagtgagtgtggggcattcttgtgtattccagatcttagaggaaaagctttcagtttttctccattgagtatgatgttagctatgggcttttcatgtatgacccttattttgttggggtaagttatacttaatttgacagtttttatggtgaaatttaaaacatcctgttgaattttgttagatgctttttctgcagctattgagatgatcatgtgatttgggccaaactttcaaggtacatagaatgtttaccctggtgcaacagtgataatagggacagaaagttctgagaggaaagctagtctaggggtgctaggtcttctggagggttctctcttggtgttgaaaacgctgatttgtgttctgttttaaatggtggagatgagacaggtcctataatttatttcattactatataaatacaaaaaggatctttttctaactgataggcactcacaatttatgtgtatttggtttttaaaaaatcaagcaacctaagcatctttgcagtacagtgttttctatttattttggcaaaggcatagagtcatagttttagaaatgaaaactgttcttcaaatacattcttatgcaaaaactcagtgtacaaaacagatgattgtgtagctgctggggtggaagggtccctcccatcacccctctcctctctctctcccttcttcccccaacccatctcctacctcccctcccataacaactgaagagaccttgacaacactgcagagcacatttgaaacagtgaattctgtcatttcacaggcaaggaattgtgaattttttaggtgttggcaaatggatgagaatgttagagaacaagcagcaggtggagatttacctcgttaccacccttccctcacaaaaggagggcgcatagactctgattactcaattatctggaaaacctgtggtgtttgggttaccttgtattctacagtactctagtatccttggttacaaagctaattccaggtagtttcagaagttgcttcattttgcctagaagaagggacacaaccctgcaggaggtggcctttgtcctgggtcctggacttacacaacacagtgtggtcaggggccagagaatacctgatgcaattctcttcctagctaaagagataggtggctgaccttgttgtcagaactgttacaagatacatggtggtagattctctctcattttcctttgttggtcttcagttgtcattagaaccttctttggtgatgtgtaagagcccaggttctgaaacagatgggacagatctaggtgcaattgctgtgactgtgaccgtatcaaagttacttaaccttctaaactcctatttttcttacctgcaaaatgaggatgccatttgcctcggagtgattttaaggattaaatgagattatatgtatgtgtgcatatacttatgtgtgtatttacacattcataagatttctatatataaatattggttttatacccacataaatatacagatttttatatctgtcatatatatgtgtatatatatgcacattagatatgtctagtgcttaagtacatgcctgacacatagtatgcgttaaatacacagcagatgttattatcattctattatatattactatattattctgtaagtatactcaaatattgtgatgtgctggacactatgtgatgccactctccgtgtgccaacctcccagatacagcaggactcactgcagaaaatggaaaaggtgccaggctttgcttaaattgtatcccgattccaatttgctttccttagttaatatccttctgagtcttcagcctttgtcttttcttaatgaccattgcattcctttaaagtcttaactattgaaattgatattggtctgttcatgacatttctaggggagggaatgtgagctgcctgggcaatagcaaagtagcctcatgtagatatattttcttaatctttttacttatttaagtttgcttttccttcatggacactaaaggaaaaagtatttgtttataaaaaaatttattaggcagctattggttattctatttcttgctagtaatttgattagaactttggtcagcaagggataacaagtgtttgcagttggacttggtaaaattcttgccagaggcaaagactgtcttggcagttagcttatccagaaggatcatgggtagaatcagtttcttttaccatttaataaattttaatttattttatttaaaaatgtattattttattttttaaagacagggtctctctgttgtctgatgaccgggctggagtgcagtggtgtgatcatagctctctgtagccttgactgcctgagctcaagtgatccccccacctcagcctcctgagtagctgggattacaggcacatgccaccatgcctggctaatgttttttaaaaagtttttgtagaaataggatctttatgttgcttaggctggtctcaaagtcctgggcttaagcaattctcctgccttgggctccaaaagtgctcagattgttaagtgtgagccactttgcgtggctctaccctttttttaaatagcagagaatcaaaaggccctcaatactatgttattaggaccttaatagggcaccatgagtacagaccagtggctcatagaccttgattgggcctgtctctcatttcactcattgggtctttattcttatttttaaaaagaatttcacatgtaatgcagtggcactagctatactcataaggtccagattatgttgatttttctcaagattattttttaaaatgtcataatagttgaagtctacaaggaatgcccatttcctctgaatcattaacattgtaaggattgacctgaggattaataatggatttactggaagagggtttctgttaagcacagtgatgtttgcataattgagccctcatcctttagtacctttggtattgagagaccaagacgttgagatgcttgtcgtgtggctttttctgcaagtaaggaaggctggttcaattagtaaagactatgaggctaataccttctatttttccagcattttgctcggggaataagaagctgggaaacctagaaaagctttccattagttttcatgacatcttttccttggagggtccacagttagcagtgctttgttaatgtaaaatggttttaagaaatgtaaccataaattcctagaaggtcagcaggcggccttgaaaaagagcaagggagaagattaaccacaattattgtcaccgtggcctgctaggtgccagatgcagtcttggggtcttgttacaggcttacactagcctcctaagggagggatcaccccagcttctttggaggggacatgaagactttaggaggggaagctaccatccagcttgcataggagtggctgaatcagcactgacctcagttctgaggtccatgattttaatgaccacatgctattgcttccctggtagaaaaaactttgtttttctttaaaaatttttaaaaattatttgtttgggggaaattgagctaccatgttttttcttctttctagagatgacatacctgttttctgataagaaatctaccccacagtgcactaaaccaaagcagacaaatgaccagtaaagctgtttgctacctcctactcatgctgagctaggccagtggagcaccatttccatgggagagatttttgaaggaagaaactgcagagtccctacctaacccagagaacctaacaactggtttatacaggaaggatagaaagaactttctaccaactctaaaaccagtcttctttctgctatgtcaggttcctccattccctggcatccttacttttcatcctttccaaaaaagtgaacgtctaaaccactcttttttttttttttttttttaatactttaagttctgggatacatgtgcagaatgtgcaggtttgttacacaggtatacacgtgccatggtggtttgctgcacccatcaacctgttatctacgttaggtatttctcctaatgctatccctcccctaggctcccaccccccgacaggccccagtgtgtgatgttcccctccctgtgaccatgtgttctcattgttcaattcccacttatgaatgagtgagaatatgcggtgtttggttttctgttcctgtgttagtttgctgagaattatggtttccagcttcatccatgtccctacaaaggacatgaactcacccttttttatggctgcatagtattccatggtgtatatgtgccacattttctttatccagcctgtcattgacaggcgtttgggttggttccaagtctttactattgtgaacagggctgcacactctttactatgtctgtaagcgccctcacagcacttacattccttgcttcttttcaacaaagaaatgacacgttggtgtactgtaggttgcttaccttcattaatataggggaaaagtgtttacagtgttgtaaaaataatttgtgtgtactatcttttaaaaaaacaaactttacttttttttgagatggggtctcactgtgtttcccaggctcttctggaaccctggactcaagtgatcctcctgcctcagcctcctgagtagctggaactataggcacaagccacagcaccgccttcagtctttgctttgagtagagtaaggcagtttaggaaggtgaacctaaaactgatgaattggatgggaatgatgggaattctgaagggatgggcttagacatagtgaaggaagggaatttaggcaactggagggtagacagcaagggacgctggtggctccctttggctcaaaaataatgttgttttgttctttcaagtgttcattccttcattccattcttccttcatccaagcattcatgcatttaccaagctttttttggtggctattttcaagctctgtttgatgctatgtaagaataaaaagtgggaaaatttatcttccttcttttactgggaggaagaaaacgtttggaagaaataaaaatgtatacatgcacctgtttaaaaatattgctcttatggtactagatgctttttgtttataagattcggatgtttgatatattttaggtatgtgatggtcaaagcaaaagtgtttagaaaattgtgaaattcttatcccacctgctttttttctagagaactagacaaatgtccccaaccccctcccccaaaccttaaaggtggcaagtgaataaaatggagaggcaaaacaatattttgtcattttctaaaaacgtttaaatgaaaaatacagtgatgaaataagaaatacagtggtttagaaatttaatatttctggaaagtctgaaatccaaggattgtttgattgaagcaggaagggatatcttttccccccttttccccctgtggaaaaagaaaattgaagcatttgaaataagtgtgtgcatgtgagtgtctatgtttattttgttaagctcactttgcgatgtgtctaaaacaagaatcccaaactctaaggcctctcaggaccatgcaggtaacataaattggcaaagtgggtcggatgttagataacagtggaggttgggcactcagacacactggagagccgcctgccccgtataataggagcagctgctgcttggagcctgttcctcgttgccaggtggcagcccaagtgggggtggggaggtgatcttccaattttcatggaaatccagattttaaagtcactgattaaaaatcttaaaaagcaccaacatcatgtgtgttaaccaaacctgtctgtgggttgcatttggctcatgggtcaccaggaacttcttggttttacaccactagaatatacggtcagcccttcatatctgtggttccacatctgaggattcaaccagctatgggttgaaaatattcaggggaaaaatccccaataaagatagcaataccacaataaaaaatacagtataggccgggtgcgatggctcacatctgtaatcccagcactttgggaggccaaggcaggtgaatcacgaggtcaggagttcgagaccagcctggccaacatggtgaaaccccgtctctagtaaaaatacaaaaattagctgagcgtagtggcgggtgcctgtaatcccagctacttgggaggctgaggcaggagaattgcttgaaccctggaggtggagattgcagtgagccaagatcgcgccactgccctccagcccaggcaacagagtgagactctgtctcaaaaacaacaacaacgacaacaacaacaacaaaacaaaacaaaacaaaaaccagtataacaactatttacaaagcattttcgttgtgttaggattgataagtaatctagagaggactgaaaatatttaagaggatgcacataggttatatgcaaatgcttcaccgttttacatcagagacttaagctttgtagattttgtgtctgccaggggtcctgaaaccaatcccctgtggatactgagggaccaccgtactgtgtataactcagaatgctcacaaaatggttgctgttttctatttaaaataaaaattttccagcattaattacagaatttctagttgaatttgagttgaaatatctccatttgtgatgagtttggctataagtgcataccatagtgtttgcataaagtagtcctttaataaagatttgttaaaccgaactgaatgtgagggggtttaataacccatagccttccagtatacaagaatcagagagaaatttaaaaacagaagaagctgtcaacagagtaaagtaaaaatcaatatgttttctggttttagtgtcctctgctgtgtcaggcaaatagagaaagcatctgttttcacaaacaaaggaggtttgtcagcaaacatacctcatactttaacaaacacaaaggttaaaggttaaaaaaaaaagagtggggcagactcattgaattttacttttgcagtataaatctttgctcagttttgttttctaagttaccacttctctggcttcacttcttttgatgttttatttttgtcatctcctgcacttatgaaagccaaaggttgtcaaaactttcccaccccatccatgtattcttggttgcaaatgagaacttaagcagaaaaagcagttattgaaagaatatccagcagttatcaaaggaatactgggttgccagaaccacaacaaaaaccataccataggaacagtgagctaccattgtgctggtgtcaccttgtgaggacaccctgatgacactgttcagacactgtaagtgtggttatctccatattctcctctgtctctgtctccttatgttgcttgctccagcttccaggtcctgagtgggagcacctgatcgtcacgggcacacactgggtgccggggatggaggaagtgatggccttctcagcatccctgatgaggttgccccctaacctccactagtactcacccccaacgtaggcaactcagaccctggacactattatgttgacttcctagaggaagaagatggaggcatctgacgccaacttgaggcaaaggagtcagacgctatgtcattcctaggaattggcagcttgtggcagaaatgaagggttcagagcgtatatgttgcttatccaggacactttcggtagagttgagattttaactcattgtgcttgacttccaaacccatgcccttaaccacttctttccagacgtatcttttgtgtaacataaatggtggcattgacaaatgctttcccaatctccaccccaaagggtgctgcttactttctgttccaagcagatacagtagaagtcagtactgccctgatgtagattacattgtcatcttttttacagcagcaggaagttcttcagtggcagtatagatgacacatgtgattttgtataaaaatatatattttttatttttttagtgcattctctgaagacctattgtgtgtctgctaggtataagacactgtgtactaagcccagggatactgagttaagtaagacaatttgtgtgccttcaaaactcactctagagagaaagaaaggtaggcaatgatatgtaaatatcttgcttgtttaataaaaaactgacaaaggaaagcgtttggaggataaaaaaagtttgaagtccattgaggaaaagaagaaagttacttctgctaacccttcccccaaccctcaaatgacttacaatatggggctggagaaagtgggtgccaggaaaggggcaaaacctgcagccagctgagaatggtggagagacatgaagaccagagagggcactagggcaagttcatccagtgtgaacgtagcccttttaaataatctgatgtatacatatgtaactaacctgcacaatgtgcacatgtaccctaaaacttaaagtataataataaaagaaaaaaaaacttaaaaaataaataaataaaaataaaaataaaaaaaataatctgattatctgccattgtctcattttctgctgccctatggcattttgacaatgagtagaacattattttattgtaatccattaactgtgggtaattctcattttttgaatgttctttcttgctcataaagtgccacattaactaccactacatttgagttgcatagctttgagagctttataaacaaatgactttgctacggggtgtatgcccacctgtgggaacattgctgagttctgatcatctcacgtgcttgtggtcttactggccccatggtcattagagatgtgtgatcccaagaggaaaaactagagtattggtttagcagtaatgtcatattgcaggtgcctttaaacaatgtcgcgcagtttaaagaatataaaacaaatttatgatcacaaagtgaagacaagttgccaccacccgggtcaggaaacagacatttgctagccctctagaagcccgctctgcccattcccagtcatgaccccctttccctcaaaggtaagcacaatcctgacctttagtcacttccttgcagcatgtgttttctgtctcacactgtgccaaatcctttctacctgtggattcaggaaagccaatgtgctgacacatggtctctcgggttgtcatggttaaagtctgtgctaatgtggctgtcacaggaatgtgtttaggtgcaagggtgttgtgttctgcattttaacatcaggttagaggggaggctatggcgtttggcctgaggcctggtttctcacaggctctaggcggcgcctgcttgcaggatctggtgtaaggactggcctgggagccctgggagccatcatccaggctgctcctggcacttggaggtaggttgtcagtaccttcattccatagcacacgcaagtgtaatcagaaaccctgggcctgtggattcctgtaatttaaaccccagtcactatgggactgattgcataggatgggttccatcaaaagagtttcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaaaagagtttcttatgtaagaggatttaacgtggtttttagtatcattgtgttttatagaagttcattttaacaatggtataatacattcctgtaattgaattagcaatacatcagcattgtgttatttcagtagctacaagaccgtttgccctgtgtgtacagactgcccgccctgtaggcatggtcttggagtatggtaggtcgtccttcccacctgtctatagaatgatgggtttgaaagcagtgcccggggccgaccacgaggactcagaggtccatcttgtactgccacaggcactagatgctgcagagtgcctaacaggaagccagcatctggtgagctacttactagttcgttcatgaaattactgctctcatgctctctaggctcatgtttgattctgggaatgagttcatgaagctgtcgggaactttaatgcagaggttttctttttacaggaagagctagacagagcttacctagtaaggaccaaaacagtgaccagatcgagcagggaagtctgttttgcagagagtgcacctggaatcacaggcagatgcacaagaaaaagggacacggagcaaaccctctagttcctaaagagtatggagacggccgggcgcggtggctcacgcttgtaaacccagcactttgggaggccaaggcgggcggatcacgaggtcaggagatcaagaccatcctggataacacggtgaaaccccgtctctagtaaaaatacaaaaaaattagccgggcataggggcgggcgcctgtagtcccagctactcgggaggctgaggcaggagaatggtgtgaacccgggaggcggagcttgcagtgagacgagatcgcgccactgcactccagcctgggcgacagagcgagactccgtctcaaaaaaagagtgtggagacaatatttagcctgtgatttaaaagagatgtaactttcctcttacagcatctgcaatagtgtttttcaaacatggtctaccaaccacctgtgtcagagaggtggtggggggaaggtgattgtggtagtgggtgcgtgtaagagtgcgcatgcgcgcccgtgtgtgagtgtgtgtgtgtgcgcgcgcgcacacacacacacacacactcagagagtgtttgtcagaaatgtaaattcctgagtcctgtagcagatacaccaaaccataatctataggtgtggaggccaggaatctgcattttaatcacataaccatttttgtgcatagttgaatcctagaatctctgatctagagtggtagtttcattcattcattttggtgaaggttgagttggactgtggagaaactgggacttttaaagaagaaagaaaagaaagcgtaggcctgagacatatttgctgatttgagaaaaagaaatacacatgaactagggtggattttttcatactctcctggaagagtctcaaatttcaactcacctgttttgtaaaatgttctgaacccagatgaagatatgctctctggtggctcggagatgtcattgcaacccctccttccttccttgccttgtctgggagtggggtagtgggtgtacttttgcggtcctctgtggggagaggtccacctgaaatattagtgagtagagatcagctggtgagccttgaagctggctgtggttaatttccagtctcagttattccaaaagcaaaatatttctctgtcttgcttccttccacctttcagttcagttaacttagttctcctacatcaattgagaattggataaacaagaagcattgcaagcaccacatggatttctagttcattttaagttgacctttcattaaagtgagtgtctgtaatcggtgtctgtggtagctgctttaaatctttcagtatttataaagattaaggatttgttacttgcgaaggtcattgagcaacttcaagaaattggcatcaatgtgacgaactaagcacagctcattcttagcatttcagaatcatagaaggtttgagctggaaggaatcccagaaatcctctaacccagcagtgctcgtggttaattaagagactgagctctggacccagatggactgtgttacattcatgctctgccagttgatactagctgtattactcagtgcctcagtttccgcagttgtcaaatgagggtggtgatacctacttcattgtactgttttggtattgtaatgagttgatgtatgcaaaatgctgggactggtgcccaaaacacggtaaacattcacatgccatttagcaagtgacaaaagacccagagaaatgttgatttttcctgaggtcgtatcacaactccaaggtttagaaactaggccttttaactcatagtcttattatgtttctgtcaattgtaccagttaactagttcttaaactatgggttccaaagtttatatctgccaatataagcactaatatttatgaggctctgcttagtctcagtgctcagagataattctcaaataacaagatgtgaatataacataaagagattaagacacacagcaggacttttctgtcccttgccgagtaatgcagcctttaaaaactgttaggaaaacggtataaaggcactggatgcaaatgttctttcctcactttgctcagtgtctggcattaacacctggcaattgtatggctagagtcagcaagaaaaaacaaaactatatgtatactatgatgtttatgtatatattatgtaatgaaggaaaaataaatttttcctacacgtatatacacagatgtatatatgtaacatatattatgtaatatgtgtaacatatactatattacatattatatattaatatatactatattacatatattgtgtattatatgccatatattatgtatatttgtattatgtatatatgtcatataatatattacacataaatattatgtattatatgtgttatataatatgtaatatgtatttatgtattatgtaatatgtattacatatatgtattatatgttttatgtatatattatatacataagtacaatacacatattatgtaatatatgtattataatatatgcatatattatatgcatataatatataatatgtattataatatatagtattaataatattaataatatataatattaataatatgtaatatatgcatatattataatacatatactgtatattacatacattagatattatgtatattacataatattatgttatatattatgtaatatatatgcgatatataatatatacacatatattctgatatatgtaatgtataatatatgtctattttatatataatacatattacatatgtgttataatgtaatatattatataatctatattacctaaggtaatatatgtctatatattatattatttatattttatatatataaatctgtgtgtatacacgtgtatgcaacaaatcgaaggaaaaatagtgaaagttcctactacaaaaccacattctctctgagctacttatacttgctttatttcctttcttctattttaacaaactttcttttcctgtgtataaagaagaggtgttagatgtttcctcctgtttacatagttgaattggaattacttataattttacctagaagggaatggattttgtttttaaaaactcctaatagtgggacatcaatgatgtatatttttgtcccatgtgcctgttagccacccacttcaagccatgagtgtttacccagagtttgctatgtgagattcttctttattcctcccactgggaagatatttcctgtgccctaagggcagggtggccctgttgagaaaaccctctaaaacctccctgatgatagggtaacagtttgtacttagatctgcgtgaccctggagaagttacttctttaaagtttaatttccttatcaataatgggtttaattctagtgtatgtttgatagatcttctgtgtccagagaattggccaagagagctatatttaattctttctcttcttcatttccaaagcagcatgagtatctattgtatatggttgcttttgtggacaggattacagatatggaaaacatgtggaagataagtgatcaaaagtgatttggaatgacagtgtagggtacgcctctggcagctgggtcagggtgggctgtgtggttgtatggttggtggtttggatactgatgttgcttaaagaaacaaaagtagttgaagtaaaagattatagcaagtaaaattacattttggggggcttgtgtaactcttgtagttttagtaacaggcctttgatatgtgatgtgcaccccgtgacatgtttaccagttccccttagcatcataacctgttttagatcagcattccctttgccaggtgttatctggatggatttctctgggccagtctgcagcagctttgagacttatataaagttgaacaacataggcgttagaggcacccccacccctcacagtcaaacatctgtgtataacttttgactcccccaaaacataactacttatagcctactcttgaccggaaaccttacggaaaatgtaaacagttgattaagacatattttgtatattatccatattacatattgtattcttacagtaggtaagctagagaaaggaaaatgttattaagaaaatcatgaaagaaaatatatttactgttcattaggtggaagtggatcatcataaagttctccatcctcattgtcttcatgttgagtaggctgaggaggaggaggaggaaagtttgctgtctcagggttggcagaggcagaagaaaatctgtgtataagtggaccacgtagttcaaattcgtgttgtgcaaggatcaactgtacttactggaaagcatggacatttggttccaggccttggaatttcatgtcgttgaacactgacagaatccagccctgccattaatcaggaaaggatgccagatcccattttcattgtaatgtttggctcgttccaagcagcttatccgggatatttcaggcatgaaatttaagcagccaggagtaacctgttcactttttatggcagaaatggggaagcttccagtctgggaattagattcagtacatgggagtgaaaggtcatatggtgccttcaaatgaaatacccttataatttaaaaaatctgcaaataaatagtaataagaacaatgatcaggttaatgagagttcgttgacccattaacacataattgctcatcatactcagaagtcctagggttcagttgaagaagcacagaggcaggagggtgtgttggttactagcatacagctgcagccaggatctggtttgcttttggctctgccacttagttgcagtgtgacaattagcttaacttccctgggactcagtttcttaatttcaaggtgagagaaggtaattataataactgtctcttaaggcagctgtgaggattatataaataagttaattggctgaagtagagtttggtacttacggtgtctatgtaagttacctttgtaaactcaaaacctactgagtttttccttctcctcctatctttatttccctgtcagtccatctacagttgggaaataattccccatgtgtttctcttgtttgtatagtagccttggaagttagaagtagtgggtagagtctcctatgcagcaaaaggcaggtatgctgattgcttgttataaaagattaaggtttcctaagctcatataaacctaacaatacaaatttttttggctgccatttttttttttttttttgctgttagagtttgtgtgtttatttttgctagttcagattttatatcaggttctaatttctacaacatttacctttttttttttgcatttcttctgctaaagcatattttccttttaaaagtcttttcgttaaaaattttagtaattgagctatttttgtttgccaaagcaaaacagttattcttttttcacctcagataaacaactaatattgcttaaatatttagtgggcagtactagatctttattcctatgtgtaagcaatttattactaatttcttttaaaagcatatcactcaagaattctttttccaaatgactaataatgatgcttcatacttctgtgattaaaacatagctagcaaaaagctaattgagttactttatctttttaaaatacttccaacattcttcttgctctttattcattattgtgaatatctaaaaaattatttaataaataagtgatactaagttcaatagtatttacatgtactgtttacaaagaactgtaccctagtgaatattcaagcactggaaaatgcctatgagcattatctgatcgtgttaacatttggatcttctagaaagattaacagcactgcatataatcagtatttgtataaagcctactatgtgaagcttattaatattaattttatttgcaatattgactcacccttggcggcagacaggacatcgaactcacgcttagaacatgggaacagctacaaggaagactgagtgattggattggggctcttctcttctgcacactcctgtctcagttctcggaaatgttggccttaacctttacctctgcaggacggcatttcctgtgcttgctttggacttctcagtggacttgatgttgattgctaagcaagcaagaaaattataatactgtttttgctgtttctcatctgatttttctagggattctgcaaaacctataaatttccaactaaattctggaaaggagttactacacagaaacactgttctcatttcactccagacaaacttctcagttgttgctgcgtctgtgcgggcctacggggtctctctgatcttacctctgatgattgttcccttggctcattgtgctccattcactctggcctccttgctctcctgagatacacctggcacatgttcctgtggtacacctgtttccgctttccctggaatgtgcttcccctgacatgtttgctcactccccttcctctaggacatgctcacatgtcccctttggaatgaggcctttggtgaccactctagacaaaataacccagcccccaagcactctctggccctctgcctgctttctgtttcctccatggcacttagcacttgtctgacactactgtggggtggtcctgagggcagtggttgtgtatactgctttatcttcagtgctgcaacactgcctgttgcatagtagaggctctgtagttatttgttaaatgaatgaatgaggttactcttacagttttgtatggaacagctaggagacaggtaagattggtgaccgagagttgtattaggaggctgttgtcatggaccccctgggatttggtaagaatccaaaccaaagggttggagaagtgaaacagtcaagagacagggtgggtaggtgtggtggtgatgcatctcctttgggaatggaggagaggggaaaatgagagcattctggaatattccctgtttttagcctggcaattagatggtctttccgttgagctaagataaagaatactggaaaaagactaagcatttcttttacaaagcaaattgtgtgtattagtagagaacaacatatttctgaaattggtgtttttatgaaatatagtttctcaaaggctctaagtaacccttgctgaaatgctgattttagtttgaggtcaagtttcctaaaatgttttaaaagctagccatgcaggaaggctttggcctccagggagtttatatctttagatagagagatttttctatatttgggagctaaactggagttgctgaaggtctgaatacttagttagcttctcagtaccttgagtcactaacaaaattaacattttaaataggaagtttacagttcttccctcttttaataaatgtttccttgtataagaatgatctttgaagcagaggcctcaaccgcattccttattacactgctgcagctctggatgtacccatgaagccctgtaattggaatcttctggctggctcagataagcagcttatttgtgagccaggtcctgccctgtttctttaaggcctcaaagcaggaagatggtgaactttatgcaattctgagttgactccaatccagatgtattttggaactaggtagaatatgactggtaagtgaattttaatattttaattgagttacttggatgaatttagagtgattctagatatttgctaataaaaaatacagagttcatgtttgtgaggcttttcactgattacaattcattactttgttccaagataattttgtctcccttgcttctcacctgccacgtgggaagccttggcctctttcttgctgaggctcaggctcctttgaatagcagagatgagggcatgatgctggtgacacctgctggcgtgaccccatttggggaggctctggcttctttcctatatggttagaggtgtccaggacctctaggaaccctgtctgttaaatggaaagagttggcctagagcctctcaggcatctcccagcattgaaattctgtgctctaactgcttttggtaaaaagaatgcagtagatctgaatgtactgatgtggaaggatgtccacgacatattgttgagtgaaaaaagcaacttgtagaacattttgtgtgtctagaaaaagaatacatagtgatgtaatctgttagcaattgggggagtagaagggaaggacttttacttcttaatttatatcccttggaactaaatttattcacccatatgacttttataattttaaaagaatagcaactagaaagccaatcattttagatgagctgtggtggggccagcccctgaaccttctcggtgcctgcattgggtggctgcagcctgctcctgcatgccatactccctctagcagcagctggcttgggctgagaggccgcttcccacttgcactagcagggaacctttgttttttcatacctgccagctggaactgtcttccctgcctggctccattgacatttggatttacaactcatattttaaagttaaaatatataggttgtgcttcttaaaaatcactaacgtttaaatttttcatttgcttaggcttgcttttctgaaattagtaggccttaatgaggttttggtgagttccaggatagtctttccctgactgacagaccggaacgggtttttgtgtgtatttactgacaatgagtactgcagtatgtaactaataaagaattaaaatactacttttttctagggatgtttcagttttaatagaaggctcttaaagtttttaggaatcaaagctctgagtctcaagcacctcttgactaatggtgatcccatatttttaattaggcatgatgtatggttactcccaagtcacctgtgtaggctggagatgctgtgggatgtggcagtaggtgacggttaggtggtgattgtaggtgcagagtgagttgggtgacatgctgggaagactttcatatattgtaccaagaccctatgtgtcccttctgttttcaggtgccttgtgcctttcctttattgggtcttatctgaataatttcatctgttgctttgagtataactaaatattaagataaaaactatctagtggagcatcagtagcttataatttagcaaatgggcctttgttggcactttgatttaactaatgtagatgacctatgcaagaagagtaactttaggcttttcagtgagtgacgtgaatttagcacatcacatgaagcacatgtcttggagctattagctgtcatagtttattgagtcagatacctaaaagcagtggttcagagacgcaggcatgaacttttccacctgccttaccttgctgaggtcattttaaatgccccaagctagaaattgggtaaagatttataatttgtcaaactgaaaatagaagaatatgatgagatgtagcttggggtgaaagtagatttttttgtcttaaaaatcagtaatactataatgtaataatagttttcttttattgagttttcatttatttactgtaaagtcaggaaatatactaagtactttttgtgcatggtctcattaaacccacagagcaactctatgaatatcatcccatcttacagacgaagtagctgagtaacaaagaggctaaacaccttgaccaaggtggtatatttaactaataaatgttaaagctgggatttgaaccccaggggttaaatccaggtccagagtgttaaccactgaattatactctttcccttaagtggatgataaaaccttgctaactaaggctaattgtgagcttattgtggacaacattaacgtgacttcatttaagaatatttagtgtcggcatagatcacaacaccatggctgtgattggcaccgtggttgttttcatttctgtagctgctgtaacaaatgaccacaaatgtggtgacttaatcaaggcattggcagggctgtgctccctctgcaggttctaggagagaatctgatctttgcctctaccagtttatggtgcctgtcagcctcccttgatttgtggctgccctactcccatctttgctctggtgttcacactgccttcttctcttctctttggtgtcaggtcactgtctacctccctcttacaaggaaggatacctttgattgcatttagagcccaccaggataatccccccatctcaaggtcattaacctaatcacacctgtaaagtcctttttgccatgtaagataacattcacagattccagggattaggacatggatatcttttggcgggggacggggcactatttagcctactacagtggcaaatattaatagaactttcagtccgccttgtaggagtatgcttaacgtcaacaatttcctaactgttttgcaggacacagatgttaaaaatgtgaaagaattctgttgtcaaacagacttgagagtcattgtgtaatatatccctctttaaggagattcccaatgcacaatgaaggctttgagaattcctgtggcaatgaaagctgcttaaccttgtcaaacccaggattcctcagacttagttgattacaaaacacttctttttaaagggtatgtctacttacatatcaaaaaatacttgaagatgccttaggaagcatgagttgagttacttgttgcctgttagtcttttgaaggcatagagtgtgttttaactgactttttgttacttaatatcttaaacatgcttggaattgattggacagaataaaaccaagataaatatacaaaattaaatgattcagggataatgtgggttatgccttgcgtgcctgtctgaggagtttggacttgattctctagaccaaggattggcacactgtaacttgtgggccaaatccagccttctgcctgtttttataaataaagttttattggaacacagccacatcaatttgtttgcatattgcgtgtgactgttttggtgctataatagcagagtaggggataggcttgcagggcttaaaaaatctgagcttttacacaaaaagtttgccaaccctgatataagtagtgggaagccatgaaagggttttgatcagggaggtggtatcttcagatttgtgtgtcagaaagcttactccagcagctgtgtggaggatggatcggagaatacaatgaacagggggatggcagagggaatgggagggaagggaacagcagaaagacattttggacatagaatctactataagcctgggtatggggtatgggagggagaggagccaaagacagttttgtaaaataagcttttaattttagaatacttttagatttacagaaaagttgcaaagatagtacagagttctcatattcccagatccagtttcccctactgctaatatcttatatcgatatgaaacattcctcataactaatgatccaatattgatatcttattattaactcaagtcataatttttaaatattttcttagtttttacctagtgtcccttttctcttccatgatcccattcagtattccacattacatctagttgccatgtctcttttgagccctagacggtgactgtttctcaggccttgctggtttttcatgaccttgacagtcttgaggagtaccagtcaggtgtttcatagaatatcccttaattgggatttgtctgatgcttttctaatgattagattggggttatgggtttttgtgaggaagatcacagaaatgaagtgccattttcatcgtattatatctagagtacatagtaccaacatgactgctcacgttgatattgagcttgatcacctgatcaagctgagctagtgtttggcaggtttctccactgtcaagttacttttgttcaccctttccatactgtgccctttggaaggaagtcactatatgtagcccacacaaaaggagtagggagaagttacgcttctccttgtggttggaatgtctacataaattactttgaattcttctgcacagaaggtttgcatattcgctcccatttatttaatcaatgatttattttttagtatggattcatggatatttaatttatgcttcaggttataatgcaatactacattatttatttggttggtcaagttgttccagctttggccttcgggagttcttacagtgtgtgtatgttttagtacgtccttattttctggcattccaggatgctcaggctcatcttgaatatttgcttgccccagacctagaatcagccagttttccaaggagttcaagggtttaagcagaggtaaaagttgtcaaaggaggttgacgaggaggggtcagagaagcaggtgtattagtacaatctcagggcatgccagggtagcagattggtgagtgtgcctttttaagtcaaggttccgggatagatagtataggagtctggctgctggagagggctgggaggaagggcagtagaagataaggctggagccagaggtgttggccttgaaaaccagtccaaggcatgttaactctctttggcaggaagggtgtattgtagggctgataaaagctgtgcttcaggatagctagtccgcagcttcatgcaaattagatagagggattagaacttgcagttgcttcattgggaaatttggaaatgggtgcttggtgaggtaatgaaaagaggcaggaagcagtggcctattatttgctaccaaggatttttgcatagattagattccttcttagggaaaagaaagttagtgattaagcagtctgtttgcttacaagcaaatgtatacaatttaaaaaagtagattgtcttaaaatatctactctgcctgttgtatttactaatgtgtgcagtctccttttcttggaaaagactgaaaggtggacttaaactccacccagtttggaaagtcacagaatccaagttaatggagtctgcatttttaatttgatttttatgtggtgtctccagtcaatttcaaaattatttcccgttgaactttctgctttatcttttttagatggtggtttatgtagcttttaataactgtggtgtttctgagataattgatggcagagaggaattctggctgagcctcggttgtatggaattaataatcctgggaatacttatttgtttttgattggctcctggcatttaaaatttttcatttcttttgcataaacctgggagaacacatgtgactacactttaatctgcatgtcttataaagagaaaagcagagtcaccaaattagtgcaatgatctgaattttttttacctttttttcttcaagttcagggatagatgtgcaggatgtgcagatttgttacataggtaaacgggtgccatggtggtttgctgcatggatcatcccaacacctaggtattaagtccagcatccattagctatgcttcctgatgctctccctcccccaccatccctctctggcaggccccaatatgtgttgttcccctcctgtgtccatgtgtcctcatcattcagctcccacttataagtgagaacatgtggtgtttcattttctattcctgtgttagtttgctgaggataatggcttccaatgccatgtgtgtccctgcaaagggcatgatctcattcctttttatggcttcgtagtattccatggtgtatatgtacattttctttatccagtctatcactgatgggcatctgggttgatttcgtgtctctactattatgaatagtgctgcaatgaatgtacgtgtgcatgtatctttataatagaatgatttatattcctttgggtgtatacccagtaatgggattgctgggtcaaatggtatttctgcctcttggtctttgaggaatcaccacactgtcttccacaatggttggactaatttaccttcccaccaacagtatataagcgttcctttttctctgcagccttgccaggatctgttgttttttgactttttagtaacagtcattctgactggcatgagttggtatctcattgtggttttgatttgcatttctctaatgatcagtgatgaagctttttttcctgttagttggccatatgtatgtcttcttttgagaattgtctgcccatgtcctttacccactttttaatggtttttttttcttgtaaatttaagttccttgtagactctggatattagacatttgtcagttggatagattgcaaaaattttctcccattctgtaggttgtctgttcactctgatgatagtttcttttgctgtgtagaagttctttggtttaattagatccatgtgtcagtttttgcttttgttgcaatggcttttggcatttcgtcatgaaatctttgcctgggcctatgtcctgagtggtattgcctagactttcttctagggattttatagttttgggttttacactaagtttttaatccatcctgagttaacttttgtatatggtgtaaggaaggggtccagtttcagttttctgcatatggctagccagttattccagcaccatttattaaatagggaatcatttccccattgcttgtttttgtcaggtttgtcaaagatgagatggctgtagatgtgtactcttatttctgagttctgtattctgttctattagtttatgtgtctgtttttgtaccagtaccatgctgttttggttattgtagcctggtagtatagtttgaagttgggtagcatgatgcctccagccttgttctttctgcttaggattgccttggctatttgggctcatttttggttccatatgaattttaaaatagttttttctagttctatgaagaatatcaatggtagtctcaggtatatccttatagcagtgtgagaatggactaatacacttgtcttgtgccatttttcaagaggaatgcttccagcttttgcccattcagtatgatattggctgtgggtttgtcatgttattttgaggtatgttcctttagtacctagtttgttgagagtttttaacatgaagagatgttgaattttatcaaaggcctttcctgtatctgttgaaataattatgtggtttttgtcttcagttctgtttatgtgatgaattgcatttattgatttgcatatgttgaaccaaacttgcatcccaggaatgaaactgacttgattatcatggataagctttttgatgtgttgctggatttggtttgccggtattttcttgaggatttttgcatcaatgttcatcaaggattttggcctgaaggtttctttttttgttgtatctctgccaggtgttggtatcaggatgatgttgacctcatagaatgagttagggaggcgtccctccttttcagtttttggaatagtttcagtagaaatagtaccagctcttctttgtatatctggtagaattcagctgtgaatctatatggtactgggctttttttggttgctaggctatttattactgcctcaatttcagaactcattattggtctattcagggattcaatttcttcctggttaagttttgggagagtatatgtatctaggaatttatccatttattctagattttctagtttatatgcacagaggtggtttttagtattccccgatggttgtttgtatttttgtggggtcagtggtgatatcccccttatctgattgtgtttatttgcttttactctcttttatcttcttttttatgctagctagtggtctatatggtctgaatttttaaaataatccctttactcttgaaattattttggacacaaaaccactgattctggagtggagtccttttttgttatttaattcctcaaatgttgtgatttgtacgtttggttcaatagaaacaactcttctgtgcctcctctagacatctgtcttctttaagcaaattaatttagtgatatagagtatactcctttgtcaggccatgggcatgttcctgtaaaccaggagtctctgttaggctcatttctgaacagtaatacctattttgggatggaaacagcatttgattaaagagaaattccaagttttaaaaatctgtaaaatgaggattaaaatatttaggtataagggaggaaaagcaagtgccacaagttctaagcagggtctttttttttattattatattttaagttttagggtacatgtgcacaacgtgaaggtttgttacatatgtatacatgcgccatgttggtgtgctgcacccattaactcataatttacattgggtatatctcctaatgctatccctcccctctcccccgaccccacaacaggccctggtgtgtgatggtccccttcctgtgtccaagtgttctcattgttcaaattccacctatgagtgagaacatgcggtgtttggttttttgtccttgtgatagtttgctgagaatgatggtttccagcttcatccatgtccctacaaaggacatgaactcatcatttgttatggctgcatagtattccatggtgtatatgtgccacattttcttaatccagtctatcattgttggacatttggattgattccaagtctttgctattgtgaatagtgtcacaataaacatacatgtgcatgtgtctttatagcagcatgatttataatcctttgggtatatacccagtaatgggatggctgggtcaaatggtatttctagttctagagccctaagcagggtcttttgttacaatcctcttttaaaaactccatcttgtggttttactgcagtggctgagccttgtgtttgttgctacagggtgctattatttagcaggaaaactttctaaagcagaaccaggagaaagattgcactcctcccacattgtccaaccaacagaatcaccaaatcaccaagcaggagtgaggagagcagaggtcacctggtggccatcaagcagtctatccgaggcagaactccttatctgaggaatttagaagtatttagacttccctgttatctaaagctggcctgtggttccaggcttctttccccaaaatgtataagtaactagagtttttgtatatctccagaatgcatgcatgtcaaaactcactgtgcaacctttgcacagaatgtctatgaatataatcatttattatgacctatgaggctgatatggtctaaattacccttaagctctgctttaagctccataaataccccaagagaaaaatccaccatgaacagtcctctcttgccgagtcactctgctgtactcttctaccgcattctttctttctaataaaacttacctggctgggcatcatggctcacgtctgtaatcccagcattttggaggctaaggtgggcagatcacctgaggtcaggagtttgagaccaacctggccaacatggtgaaaccctgtctcgactaaaaaactacaaaaattagccaggcgaggtggtgggttcctgtaatcccagctactcaggaggctgaggcaggagaatcgcttgaacccaggggtggaggttgcagtgagccgagatcacaccactgcactctagcctgggtgacagagcgagactctgtctcaaaaacaaacaaaacaaaacaaacagcaacaacaacaaaaccctttccttttcagacctgtactgttgttgggaacttcttcttaccaacccatgagtcgactactttccaatgccttggctctgacacctcgcccagcacaggggacacacaaatacttctttttaaattcactgcctctagaaacctgaaaggagaagacatttttaaaggatggtcacttgttctatgcttctgtgacactaggaaccttaaggcactggggcagaggggccctgccattcccattcatattataaagcttccccctttgaagtaggttactgatgttctctgtgtgcttccgggaaatagctgccttgtcatcctcaaagctactgtgtcctcatttcttgcttttattgtacacgtgctaccattttcacctcagagcaacagtggccaccaatgctgtgttcatttcacttcccttgtgctccttcataaagaagctatgaataatttaaccaaattatttaccaaccacaaataaagatggaggtagtatcaatagttggaacacataaatggaaatacgcggcacacgtttcttcttggggcaaatgaaaaggggtagttgtagcatgtcccacctctgggcttcatggcatgttgggaccgagtttctgagaccaatgctgtgtgcttcaggaacttcctagcatccacctggctcctgtttatactgtactttctgtttttccttgtttatctcatatcttcaaaatatttcaccctgtaaaactgcaaggttgcattttagtttattgtacaaagaacctacttcagttttacttcttctggaatttgcagttagtcagatctgatacattgtcttaccttttcaataaaagcttttgattttaatttattaaggaaaaagtagaatgtgatcgaaaaaactctcagttgcagctgaaaatctgagtgagagagaggcatatgcaaatgaagtaaagaaggctcttaaacttgtttgccttcaccgaagcaagataatgtcctggttaatgtagcattaaatatatacatgcaggaatgccttgtttagagctctggattcctgtatttgtcatggtgtctgtaagaggttcatatcctccgtgtctccctgtgtgacttagtcaccttactttacctttctgggcttcagtttcctcatctgtgaaatggggacataactacctcagagttgttgggaggattaagtgagttaattcatgaagcacttcagacagttcctggcattcagtagctgtcacctgatatggtttttattgttgtcattaccttcctataagctatgtcagcatgtgtgagaaataaatgtttaagaaataaatgtatcagaacctacacatccaagggagtttttcttcctcagaatgttctgacttggaaaataagctttgattttggtagtgctgcccatgccggacattttggggatggctcttggaggaatgccttctggggctgtagcactacgttcttcgtatggctcctgtagtgaccaattttctgtcccctgagtgaatgtggctttgaattttttcttttctttaaaaaatttttctaaacatagaagacatttggaaccaagtaaaaaaaaatcttttggtttaaaaacttacctagaaagtttattcacaagaatggtcattgggccaaattaagctgagtttttagttttaacaagaagattattagtttgggtctttggcttttgggattcgtaaggaagttcctgtctacttcctgcagaagcaactgctcccaatctgattattttgacctcaaaaccccattattcctcctgtctcctctataagtggaacatcagccacactttgtttcagggttcccttggcctgcaggccccagttcctacagaaacttcttttcctgacaatcagtatgatttttttacctctaccacatatttgtttcttagcctacgctcttgttctaatgattactaattttttacaacttgatatatgtaatgttaactatgtaatgtgtatatctactcaccttggctttttgaaataacttgattgagggccagctcttgggcctcctgtgtggatgtgttaaagtgccctgccttatgtctctgctgtcctctttcctttccataattccaagtgattagaaaagcagccacatattttatagtcatttgtaagtcaagttgccagccttgccacatactcatttttttttccagctgagcatattgtaatggaaattctaagtttgccttgacatgttcattgctctgcacaaagtcaacacttggtctccaagacagtttgggtgctaactttatttccctgtactgtctggattgtggaagatcagatgtggatgcctaatgtcccttgttaaaattgtcccaagagctatcatatagacactgtgtgtgtttgaaggaagcaggtccaagtctaaacagtgatggcatcctgttggtctgagaagcaggtaacttgtgttttaaaaacaaaacaaactgagaagacttcctttttctttcttttttttttttttttgcacttggcattacattacaataaccaaaaaaaccctgcaggaatggttgctgaaaaacaaatgaaaaaattaaacaataattgagactttttgaataatatttaatatatatcattgttatatataatataatatatataatatttataggttatatatatctctctcccctctctctataagtgcatttctgtatatgtgtgtgtgtgtgcatgtgtgtgtgtgtataccttctctgttttctctgttttcctatacacttttctttatggtagtttgctttttgctttttaaccattttatttggacttatgttattcataaattctctcttaaccacttttttttaagagcaaatatacatattttctgctctaagcccaggttggtgacatcatagaaattttagtgtttcttctttgtctcaatctttcaagtatctcataatctgttcttaaacaaatgtctaagaataatatgagtggcaacacttcaaaacagtgattttttttaaatcactgtaaacacatatgtgtgtaagatcttttttgaatttttaaaaataatcttaaggagaataataaacatgcttccggccattttttgagacatagaacctggaaaattttgtttccatgtattttatgccgtagaagtctttgaagaacgaaaagtgggagtcacagagtgtgactgtgttcagtttcttttcccccatgagaaggtctaatttggttgctgtagcttcaaagctgtgtgtcatgagaatctgatgctagtggtggtggctttggtggaggattttaagaaaagataatggttcctgccacggtgattttaggcaaaagagtgggacatgcagcctcttccccttctagacaccagcatactcatctattccattaaaacttgttggcaggaaaaaaatcaaacatgctcctcgaagtggaagtaactggtagaggttttagtgccttcttcctaggaggttgtattttaacagaaaagaaaactttggctccaggaataaaaatcctttttttaaaagtgtatgaaccctgcaatttggtgctaattgtaacttctggaggctccaccctggttctcttgattaaactcaaaacaaccccttttccttcccaaacatctcccagagtgggtggctcagccaggggccagcatttttattccattttcgaggatcttggccccatccctggtcttgtctccaagtggggcagcttaacaaccactctctgtgggctttgagtatggcaagatgacctggcaagctgagctaggtgtttgccattcacacaggaagggggccttcagggaagagctcgagtcatcatgaagacagagcctggatggtaaaattaatgcccctcatacagatgttgagtcacatgatgtattagatagtcaatgaaagatgaaattatgttggtataccatacaaggcagtaatgtacagtactccttaagaaacattttcaataggagttttatggttgcttgaattaagttgctttgagaggtaaaaagttgcagtaagtgctataatttagaaaaccagagacttacatggtaacatctctactggattaagtcttcatgagtataacagcataagtattataaaacttaactagaatcggaaaatagaagataaagaattagtgttttgtttggatcttacctttttctgtgcctgaaacccccacattttcaaaagtcctttcccaaggtctccaacgctggttggtcctgttgccttgtggagtttctaattgaatgtatctgaagcacttcaatcagagctgaatcttggtcttccatgctgtcatcccctgtattctttcccaaaccaagtttctgttgattctgcctccaaaaagtatctcaaatccaccctcctggtccagtcacctgggtgactgcagttgctattcatactcactgtgactcttttccaccctctttatgaaatggaaatctggtaattcacctccttcccctaaaagccaaaacaaaaaacaaacaaacctgcaggactcaacttttccatgacttcccatgatcttaagttgaaatcataatttcataaccttagtgactcgcatgacctggcagttgcccactaatccccagccctccgtgttccccctcttcaatccagtcatggtggcttagttttggtttctctgagatagcattcacttccactttcctctctcttttttcaaattgttgactttaattatttctttagttcccccttaaatctcattttgtcagagaaagccttaggttagaaaccaccttattgcatgacattgacccccttgatagcagtctgttggtatatgtctagtggctggcatatagtggatgcttattcatatttgttgagtgaaagaatgagagtagtggtaattgtgagtattttaagtgctgctaaatactctgagagttggcatatctagcatgaggtgtggcacagatgccaccatttttttttacctgccagacgagccagtctatttattactaatttatcaccacatccttcccctgggctggctttcttagtactctactggtctgtgtgaattggcatgtggcatgaaacctatttgacatttctaatctagcagaaaatgtcatcaccttctggatgtttaggtccttgtattgacctttaaacatgttgcataaacttttcatgccttaattttcatgccagtctaatacaggtcatcagattgtaagataagataattctttcatgaagattaagtaagaaatactgaaaaattagtagagcatattcaaatataaggttgtataattacattcagtatgctttgacataaataatcattttctgtttagccactctcttatgcagactaaaatgtaaattttatatacacataaattaaactttcagttgcataggcttatcatgtctatatatgagccttacagcagggactctaattttctttcataattaagttgatttcttgtttccattggacttttacttaatgtttattttgctagtgaaagatccatttcaaggagatagaatataaaacatcaagaagaagatgctcattttaaattcagtttactatcattctgtggcagtgtttcacaaagcatacccatggatcacctgtatcagaaacatgtggggatggttaatttgcaggttcatgcccccacaacttactgaatcagaatttgagaggcccagaaaactgcattttaaagtgatcactttgtactttaaataagctccataagtttgagaatcaggtcccatataatacttagtgtatactgtgtcattaataaatttcgaacaggatccataaaagatggctcattcaccgaccttttcagtctcacctgagcatatagatgttatcagaaaacatatcaatgccaacactatacaataaaaggtgatgatattgattgtgactaaggttgaaaacagtctatgaccttattcaactggagcacagaggatcaacaaggggcattgttcctagatggctaaaacacactggccttccgggaacaatggccctttgaccacagctgacacaggcgggaaggaactagacaggggtcagatctcctcagtccagcagtgaatgggtggggcctatggttgagtcctctggagaagcccggcaggggaaggccagcagtgcccttcatgctcaccagggctgtcactgttcttccctccctggatgcccacatggcaagaacgcttgccctgagcaggaggacaggaacaatacctgtgttttaaaagttggcattgccaagtgtgtaggatgtgctgctcaccgagttcggtggtttccttgtattagttcatgtaatcagcttaagtaggggaaatccagggtgttgatgagaaggcatttcatggcagactttaaccctggactggattctggggaaggttacaagtctccatctcctgttcttatcaaaacttgctctactcttttggatcgcctttgaccacttaatgatacttacagcttttatctcacagttccacctccagatcagtattgttttctgtcatttcctgaatgtgaattccatcccactaagtagacacagaagttgtcagtggggaatggtgtcatccctctcctctggtgttttgaaatgtgtgggaacattttcagtggtcatgatgatgaggggtgtgtatatcaggatttaatgtcctgagggtgtgggatgctaaatacctttcagtagttgggagtgggagggtcccacttaatgaaggattgtcctgtccagaatgctgaaggcacccctgataagctatctctttttttttttttttttttgagatggagtctcactcagtagcccaggctgtagtacagtggcatgatcttggctcactgcaagctccgcctcccgggttcatgccattgtcctgcctcagcctcctgagtagctgggactacaggcacccaccaccacgcccggctaatttttttgtatttttagtagagacggggtttcaccatgttagccatgatggtctcgatctcctgagctcatgatctgcctgcctcggcctcccaaagtgctgggattacaggtgtgagcccacccacccacccctgataagctctttggttttatctgcatcttatccagcaccttattattatttgtttaatctctgtatttccagagcaggatctcactctgttgcccaggctggagtgccgtggcataatcatagctcactgtaactttgaatagctgggctcaagcaagcctcctgccccagcctcctgagtagcagtgccttcttgagaactgaccaaacatttaatatgtaatgggattcatatggcttaatagatgcagtttgagcttagttacttgtagggtaaataagcaaatggttgaagccatcttcttggatggcttttgtgctctcacagtgaaggtgtcactcttcttgaattctgctttgtaacctcattcttcctgacggtacaatgtagacaagctctatgacctagggaataatcctaagcagctactgttccactcaggcaacattcctatttcaaaaactaccagcatgtagtcccactgaaaccttggtttcacaaaaagaaacaggatggggaacatcacacaccggggcctgttgtggaatgggggcgggcagggggtggcggggagggatagcattaagagatatacctaatgtaaatgacgagttaatgggtgcagcacaccaacatggcacatgtatacatatgtaacaaacctgcacgttgtgcacatgtaccctagaacttaaagtataataaaatatatatctatatatatatataaagaaaaaaaagaaaagaaacaggatgatgctaagtaaattgttagcatcatgaaatggggtagaggactgagtaccccaacattttatctctgacaccatcccaggtgagtagtcttagcagtaggagggtttgagatttggaggtacaggctccatactccaaactttctggagaaaaggttactttgtccgttgatcagaaagctactgtgtggaaaaaacaaaggtttgaactaaggatcaaacaagatcagtagagggtcctgggatatgcattgatatgtatcagtcattcagttagacatgttagagatgcagactgggaaaattcagccaaaggagcttgagagaaatgcaaatgctaagatgactcagtgggctgttttccctggaaggcctggggaccaaacaagaagcaatgtgtcaaccctttgtctctctgttactctacttctaagagtaacttctaaggaaatgattagtgatgtattcagagatttcactctgaggatgcctaaatgctgaacattggaagcaacccagatgatgtccaaaaggggattgaataaatataattcacctatatgatagactattgcataatcttgacaatgattatagcatgtttttaatgatgacaatgattatagcatgtttttcatatttttcatgtatgaagaaaagtatgacatgggacaaaatgtatgaaaaacatgctataataaacagattaagatttcaataaggaaactttgtaaacatggaggagagacctggaagggcattaatcaaaatattcacttggattatctttgagaagtgaaattctaggtagtttttcctcttagagctttagtgctgtacataaaatgttttctgtgagcatgtagaattatttttgtaattaagcagtttaatacagcaataaaaacatgattattaacaggtgccttgttgaccctttactccaaatattcctggtagttctaatcatttaaaatctcaataattatatattctatcattttaaatctaaatatttctgacaggtttattcctcaaaaggaaatgggttttttttgtttgtttgtttgtttctttgttcatttttttgagacagggtcttgactgtttatgcagtggcacaatcacagctcactgcagccttgatctcctgggttcaagggatcctcccacctcattctcctgagtagctgagactatacgcgtgcaccaccatttttgactaatttttgatttttggtagagatggggtcttggtgtgttgcccaggctggtctcaaactcctgggctcaagagatctttcgacttcagcctcccaaagtgttaggattacaggcatgagcactgtgcccagctggaaatgaggattttgattacaaggagtggatatgtgtgggggaagaactgaaggatgtgaagcaagaagggatatcaatatagtaaagaagaagaatgtataaaaatgaaatctaatacagtaatactaactacatttgtctagtttgaagctctgcctaggaaattcccactgagacgtaatacattcatgtctgagtggggttgggtagcagccataaaggccaagcttggcccctctcccccaaaagtggctgaatcagaggtgtgagagcatctcagactctagagctgatgttcagaagagtcaagtttccatcttaacacctagatcctgtggtcatagagtggtatctgtgaatcagcccattaagaatttaagcttggcctggcgtggtggctcatgcctgtaatcccagcactttgggaggccgaggcgggtggatcacgaagtcaagagatcgagaccatcctagccaacatggtgaaaccccatctctactcaaaatacaaaaattagctaggtgtggtggtgcacctgtacctgtaatcccagctacttgagaagctgaggcaggagaatcgcttgaacccgggaggcggaggttgcagtgagctgagattgcaccactgcactccagcctggtgacagagtgagactccatctcaaagaaaaaaaaaataagcttgctttaaggaaatacttgcagcagcatttctcagaataaattctgtgcataggcatgcttcatatgaacagctagggtacaattaaaaagactagacactttttaagatgatagttgttgttgttgttgttgttttgagatggactctcactttctcaccatgctggagtgcagtggtgtgatcttggctcactgcaacctctccctcccaggttcaagtgattctcctccctcaggctcccgagtagctgggactacaggcacctgccaccatgccgggctaatttttgtatttttagtagagacggtttcaccatgttggccaggctggtcttgaactcctgacctcaggtgattcaaccgcctcggcctcccagagtgctgggattacaggcatgagtcaccacatctggccaatagctattgtttttaatggaaaagttattcacttagcaatgtctgcatgtctgatgccataagctggaaactgtttgagttgctgtggatacaaaactaaacaagaaaggtgtgagaacacagctatcattttgttaacctatttggtgtattttgcctattctttttctatgtgtatatattttatatttttaagactatttttgcatcctgctgtcctcatttaatatctgaagcatttctgcatgaatataatttttaatggctgcatactattcaactatgtgaatatctcagttttgtaaatcgcttccctgttgttgaacgattgggtaattttgcatcttagtagtgaaaacagtaatacaaattttatcctcatttctaattatttccttaagatagattcaaactggaactgtgtcaaacagcatgggcatatttaaggctcctgatggataatggttccctgtgtagggaagcattcatctcattttactatcagtagcattgaatattttaaagtgccaatttaatacaaaatattgcgttggttcaatttacattcctttgaataataggtgacattgagccaatgtccacaatgtctatttgttacattatttttaatgtgcccagtactatattttaacttctttttagttatgcaaatgatagatgaatacatctcaaaaattttaacactatacagagccctctttgactgtctcctctctctttccctttccatccctataagtacccacttttatcagttgaatgtatctttgtagaccttttgctatacttaaatgtgtgtgtgcagataggtaaatacatagatgcatagtttattgggctttaaaaacttacattctatatattttggggataaatttatggtttttaactttccttattttttctccttgagatatggtcttactgtgtagacaaggctagacttgaactcctgggctcaagtgatccttctgccttagcctcccaagtagctgggactatagggatgtgccaccatacccaacttccttttttggttttaaccggagcagaggatgtcatattatatgtaacatggttcatttaaccatgtgttcattagccatttctgtttttcttatgtaatttacatatgcatgtatataaactttatatatttttatctgttttttcctatttaaggcttagtgttttccttatagatttatatatgttctctttcataataataaattattatttattatttcctgaacataattaagaaaaatgtgtgtgttcacttacaaataacctttaaaaggttctgaagagataaagcaaaacatcgtatgtaaacaattgatgattcaaataatgttagagaaagaaggtctgaaacttcctatttcttattttcaagttcctatgttaaagctgatctgattaccaaacatttgttcactgatctttcagagtttcaagctgtatttctcaacttaccaatattcatgagtgcttttgattcactgtgctgaaaaccagaacaaaggaaggactgttatattaaagtcaaaaaagaaaaattcatcttaacagtattttgaattaaggggaaaaaaaccctttaatcctgacctttgccagttccatcacaattaaaacaaaaaaagtaaacctaaaataaaagaatttcttggggaaaaagctctctctacttatttttcatcatctttgtcaaagatttcggtgagattgcaatacttgtataatagtgtttctgtttttagaaaagttatatggaaacattagtccactcaaaatagaagagtatttaaaaatattctatgtttactctacattagctcagcattttttttcatgaagatcaatatctcatcctttggatttatgcggtacctgtctcatttatttgtgagtttgttgtgtatgccccaccagactcagagctcttagaattcatgccttactattactgttcctggcacctaactcagcacttggtaccgagtaactgcacttggtggattgcttacgtgaattgaagtaatcacacattcaaagaaatcagctatcagtctattctgcagtcacagaaagtctgggaaatccaaacctgatccatgtagcaataaaaaaagatggaccactttagcctacggctaaagacctaaaaactaccttccaaatcatgaattttgcggaggattgtataggcaactcataaaccaaagtcttttagcaattttagggctttaagaaaaataatttgacttgatgcaaggttaacaacagtaagtcctcacttaatgtcatcgataggttcttggaaactgtcattcttaagagaaacaacatgttaagaaaccagttttctcatgggctaattgatataaacaagagttaagttcctatggcatatttctgatgacaaaaacaccaccaaacttctaaataaggaccaaaacacttctaatattaaaaattgagatggatatgagctatacttatacttaagaaaaattgatgcaaacaagtaagataattatttatccagttattctagttcagggtcttggatgagagagcttatcctagcatctcagggcataaggtgggaacccattgtggacaggacaccatcccatcacaggacacacacacacacacacacacacacacacacacacacacacacacacacacagtctcattcagactgggaccgtggagacatgccaaggaacctaagggacatatctctgggaactgaataagaaaccagagtacctgagaaaacccatgcagacatgggaagaacttgcggactccacatggatggtgaccctgaccaggaaccaatttttcttctcatcagtgttataacaaaacaaagttgaattaaacagtgttattcaagggccttctgtgtgcatatgaatgtaaataattcagtcccaagccagaatttggtctcagaatctgggttgcaatcctggcttgaccacttgcatgctggttactgaccattctctctgaactttatctgtaagtctctttatctgtaagatgagattagtgcctgccttatcatgctattgcttggattaaagctatctggcatatcccaaatttttagtaggtggagatggtggtactggtatatgtagtataccttccaagcacacattcaggcagtgggcaggtagggaaggtgggcaacttgccgcagcagagaggaggaagaagttcagaccgttgggtaggataagtggatccaacccctttgtagggcaggtggtggagtgggcagataaagaaccaagccctagtttgagtgacactgtggggattcaagaagacttttgtcacgtgtgtagtgcagtgactagctcttacctctggttcagtactaaccatgctaacagacctgcagagtaccagcttgtgggtgattatgtaccaaacacgtgtatcacgtttattgaacagtatgctctaagtcactttgaaatgaataggatgaataaaggtaagggaatttataaaaaaaaaaataagtaaacatgtatggcacttcctcgaacagatagaatagctttttactattaaggaaagtaaaagttgagcagagagtaaggtactaacaggtagtctacacatgtatgttccatttaaaatatgaaacccatgagcacacatgggtgatagcaagattttcactgataacaagcttcagatcaatcaggtggtggcactgaggtataaatggtgcctgccctagctaagtgaggtgacgactttctgaatagtgaagtagttgttgaattttcagaaaatcttttatttctgtttttttttctgggattgtcctgtataaaagaccacatccaaatggttttcctagaaggtcctgtgttagggaccatcctgtttgtgaaacctccctgctcaatatgttttcagtcatcttatctagtactttttaacttgaaataagaaaaaggtgtttatttctacattttcagtgcctccccttcaggtatccttttccctaaggcacactttagtattatcctcatagatttttagtgaaaatagaagaaaccacactgcatttgcatgtattatataaactattgttaaaaaagaggacgcagtggttcatgcctgcaatcccagtgcttcgagaggccgaggcgggagcattgcttgaggccaggagtttgagaccagcttgggtaacacagcaagaccctgtcagcacagaaaaaaaaaaaattagccagatgtggtggcacatacgtgtagtcttagctacttgggaggctgaggcgggaggatcgcttggagcccaggaattcaagtctacagtgagctataattgcgctaactgcactcaagcctgggcgacacagtgagaccctgtctctaaaaaaagaagattctgcttctcagtacttcggtggaaagcccttttatatgttttcccttgattagaattatgtggcttgcccatttccctttctgtcccattagaaatttagaaataattttaatgttcagtcacactgacagcattatcaagttaatttttaatcatgtaatgaaatgagctgctaatgatggtgttagaaaattttagaaaaatatccatttggctgtgtctttaagatttttggacagaaaagcacatacagtttaattgactataagaaggccaggaattttggaggaaacactagggccaaaaaaattctgatgaagctcatctaaaataattaagttatgtgttaacagggtggctgatcattagtttgtggaaacttcttattttaggcaatgtgcaggttttcaggagatgggatgatgattgagaaagacggtggctatttaggagtatttagtatacagagggcctgtgctgctttttcactttaaaggaaatagtgaagattggacgaggaaattgcaaagaatattggaggaaagaaaactccttttttatggtgtgggattttttatgtaagcagtgttagtcatccctcctctgggtcctccagtacatggttctcctttgccaaaagcaccaattgtatggtacggtatagtaattaattgtttagagtctgtccctccattcaaccattgttggcccagccttgttcttctttatttctgctgtgtcaagcacaatgctacgataaatttttgcatatatgattcatatttctgaaatagtcgattagatggcatttttagacctgtaagtatttaataatattggcaaatattttgaatagtcaaagggaatagggaggcatttttcacccccaaagtgtaagatgtactcattcaaaaaaagttcagaaaatcgaacctcctgtaattccacgttttctgactattaagtttcaaagagcagtttaataataagtaatcctcctcgggcagcccctcacacctttttcctctacattttgtagtatggctgagtgtgaacatccatccatgtttattgaaggcctaagtttacctagcattgtattgtggtaaggatacagtggtctccaaaatatggactttgccgtttcagggatggcaattacagtctggaagtattagaggcagagttgagtcttagaatttacatagtgaactttcttgctgccttcttttttcttaaggacaggtgacacatagaaaaccataaacaaaaatgtttacaagtaattgattcgaatattggtggtaagcatgttctgctattaacaaaatcagaaatggatctttggctttatcttttcctgctgtatccacacctacctgaaacacatacacataccctgtctaatgccattgatgttcctttgttttccccatgttccagctgtaggaaccaatgtattgctgtggaaatatagtcacttttgaatagctatagcaatttgtaaattgcccatctctgacagtgtttccaagggacattctgactgaactggatgatggaatgagatttctagtagtatgtcactttgaccagtggcatatcacaacctcccagtcagtgatttaggcttcttcttctctttttggaagaagggtcttgctctgttgcaatcatggctcattgcagcctcagcctcctgggctcaagctattctctcacctcagcctgactaggttttatttttttgtagaaacagaggtctccctattttgcccaggctgttctagggctcctggactcaagcgatcctttcaccttggcttcccaaagtgctgggattacaggtgtgagctaccacccagcctaggcttctttaaagcacaatatgtgcagtggggatttagacattgataatattggaatgtttcttgatgaaattctgattggtgccaaggaaatgctttgtggaatggctatgtttctgactgcctcactggtaagtcttttggttttaagaatagtccctgctgtgtattgatagtgtgacctggagtcaatcatttaacctctgagaggctcagaatcctcatatgtaaaatcagtaccatttgacaaacccccgagtggtttttgaagattgagtaaaatctgtgttgtacctgttacaggactgaggacagagtcgtccctcaatacacagctgctcttacctcataagatgaaagaattttttattctctagcattttgaaacacagatttatcatactttttgggctctaataattcatacttattgatatcataaatgaatccacaatgtatttcaaatcctgtaagttgcatactttttggtttatagactgatattgtgtacttggtactcttaaatattgcttaggaatgaatcttgaagcaaaatagcagcaacaatttatttatttagtatttgtattattttatttatttagtacttagagccatgtcctacaactaaactctttcataaattttctcatttaatccttaatatgaggatattgaagagagaggtcaagtaatttatttgttgaagaccacagagctgccgttggaggacctgccaatcaaatccaggcatgtctgacttctaagcccatattcttagccctcttctttccctgcagcatgtgttaaataactgagaagatggctcttcaaggtgacagacacaagtgttttttggatgactttcagtctgggttgctacggagtgcttaaacacatcattttgtagttaaaggccttttcttcttcctgttatgtgtcaagatagcacaagtaacccacaaacgccacactttatttatgttcctactgggcccttatcatagtctgttctcactctagttcttagcggacacgtctagggagaggcagcgtatcaagtggctaggtgcctaagactctgaaactagatagccaggagctgaatctcagctctgccaattacaggctgtgcaaccgagagcaagttatattttctctctgtgcctcagtttctcatctgtaaattagggataataagtaatactttaaagggttgtcttgaggtttaaaagagtaaatatatatgtttacaagtgtgtgcatgaacacatacacacatgttgcttgcagcactgcctggcatatggggaatattccacaagtgttggtgattaacaataaggtgatgatgtcctttgagcaatgctatgggctgcaccattttcattttgactttccccacagaggcctaccccagtgctccatgcttgatgggcacaccgtcaatgtctacttacggagtggatggctgtggatgagctgcatggttgaatacatggccagttctttttcttttctttctttctttttttttttttgagacagagtctcactctgtcacccagctggagtgcagtggcgatatctcggctcactgcaacctccacctcacaggttcaagcgattctcctgcctcagcctcccaagtagctgggactacaggcacatgccaccatgcccagctaatttttgtatttttagtagagacagggtttcaccatgttggccaggatggtctcgatctcttgacctcgtgatccacctgccatggcctcccagagtgctatgattacaggcgtgagccaccgtgcccggccagccagttctttttcatcttgaagttatattactctcattgacctaaacaccctctcttgcctttaacagaatcagggattgaataacaggaagaagttgacccaagtaaagttaaaattatttggcagtaataatagctaacatttatgaagtgcttgctacatgataggcacagggtaaataagattaactaaactgaatcctttctcaaacctcataaagcagttattatcctattttgtaagtgtaagtttaatttgcattggtcttatccctgtagtcaagaggttgtgcattgaaacagggagattgtgtgtctgtatggtttagctctgtgtccacacccaaatctcgtgttgatttgtaatccccatgtgtcaggggagggacctggtgggagatgattggatcatgggggcagatatcccccatgctgttctcatgatagtgagttctcatgacatctgatggtttgaaaagtgtggcacttcccccaccgaccaccccctcctgctgccattagaagaaggtgcttgcttccctttcgccttctgccgtgattgtaagtttcctgaggccttccagtcatgcttcctgttaagcttgtggaactgtgagtcagttaaacctcttttcttcataaattacctagtctcaggtagttttcttagcactttgagaacagactaatacacacgtgaatcccacagcactagcagagctgggcttcccctcaggcctccctgagtgacttttggcctgtagcgaagcactcaataaatggttgtattattgattattatcgcaacttctgaggcaaaaatcacatattctacaggaataccaatttgagagttctacgttttaataattaacatagcaacctttgtcatgggtatacaaactatagactccttagttaaaatgtcttgctttggagaaagtcattgtcttaaagctgaaattcttatgctttaggctaaagttgttttcactgctctgtctttggtggaaatggaaaaatgctatccactgctcatagcagagtagtgcttaaaatgatggtaagtggtagagtctcccttgttttccctagacaaaactttctctgggaatttcgtacctcaaattatgtttcagtgatttttacttttctacttttgattcttttctgtttttcaattttcccaagaagtgtagagcccagcattgataactttgactttgcttgatttttattttgaagtgaggttaacatcttccagtcaaggtccaagagaccaagcatcttggtctctaccagtgaagaagggtaacctgcttgagtgatgcctgtactgaaatattgatcctctctgccttgctcttcatgaggctgtctgggtggcatttggaaggagcacatcatcagcattcctgttcatgcctcctttacacccaccttcacaatctagagccagaaacgggcatattggatctgcggcacacagggcttagatggggtacaacagaatttttcctattcactaatcttcactcattcaatttgtgtaggagccaacatgtaactccaatagaggatgctatttgttacccagtataagaacttcttgaggatggaattgatttaattattcaaatattccagattctttcctctgagagctcttcttaatctttgatttaatgctttttctctaatccctagtaagaaaattctttcctatttccaccgcttcttttaaacattattttgcttgagccatgtgtatattacttgattcttagaaattgctgatcaccctgtcttggtaaaatattttggtctttattatgggcatatcgttgatgttagtttataggtctctttttgcaccctcttctgaaggattctgatgagttactctcatcttatttttaccctttcagtgttgtcatagggtcaccattgacattctgggccttttgcctggaagtacctattatgctgttaatttttcaactaactatgtttcatgctgtttgtaatgaaaagcctatgagctctgtggctccagcactccccagctgcgtgacattgggacgctgtgtagtctttcttcatgtttgctcatctgtaaatgggctgataataataaatatcacctactttacagacttagtagtagcactaaataagatcatacatgttaagtgcccatccatgcttagcatatcaaaagcactcagtgaagtttatttattataaaggtgagcatagggctggggcactaacccagctttgaatggttagcatgaaaaaattttcacagtcaagagaagaaaggaggaaaagggtatttcatgaaggggaatagctacaagtttttcactagtgatggagcataaagtgttaggagacgaaatggtaagggggactgggagcagttcatggaggtcttgttttatcaagcccagaggctcagactgcatttctgggaaatgggttgcacagaagaatttgtacctcattagggtgctggacacatgcagacttgaggaaacagaattcaacaagatctacaggagacattgtgatctgtgaaaagactgttctaagagccccaagaatattaggaatgcctggacagtgaggggtacaaaaggacaataaagcattttgtttacatcagatgctcacttttaagatctaggggacctgaagtagaaccaaagaaaggtataacttgtcatgcattgattccttttgagaaaatgaattagatgagctgaaatgtggatttctaatatgaagaaattctgcccaagaagtagcaagagggtgtcccacatttcagtctgcaaactgtgtttggaatgctgcgtgtgtgtgtgcgcatgtgcacacgtgtgccttgagcacaaatctactggcttgtgcagggaaagacttgttctccattttcctgtgattacaaaatcatcttttctcacagtatttgataaaatattattcttctttgctaatattgattagctttgtatctggggttgcaagttttatttttgactgtttattttctaattattttctcaacagtggttataagtagacatggaaatacaccagaaaatgatttatatgaaaaggattcttttctccatccctaagaatatgcacataaacaagagaaattaagaagagcaactaactttcattacttagggtaggctctactgttttgttatgccagtaggaggaagagttatggaaataaatgtaaatgcatgttagggtgatagccagctggctatctgaagtgagctttttggaagaaacagggacatttccttgtcatttgtttgcaattgccccactaatagagaacatttttcttgctacagtgttgtgcttaaggtaagcacatacatttgtaagaaacagattgttagaaagtgagtttctttgaaatgtttaagtaaagagcatttattatacattgaaagtatttgagtcttaacccttcccagtagagcagacctgtcttcctcaatcatcatttactattaaaggcataaagagaaaaagagagaagtaatgggtgctggtcttgcctcctaaggtaaacaactagaaaaaaggactactatctatgaggctgtggttttcaggcagtgaacagcaggcatccggaactgtgatccttgagagaagagaatcacaagagggggactcacatttgccctggtttcctgcttgaacactttccccgctgtgatatagggaggtgaaccctagcagagcatggtggtctcatagcattgagaaagcagagactggagtttaaggctgctgaagtggctgagatttgtatggcagggtactggagaggagggagctacttgaggggtgaggccctgcagagagcagctgctactaggctaagaacagaatggcggtaccagaggtcatgtattactgagaaagattgggtttctggcctagccaaggtgaagagaccttgctgaataccttagccattctaccgagacatcacatagccattctgttgagacatcacatcctaggaataaagaccatccataccttacagtaagggccataagcttggactaaggacataagtgaaatagactcatcttaaccaagtgtaaaatgaagcttggcaggatcaagaggacccaccagtaatttagctgccaccagagccaaactgaacaccctccaattgtttaccttataatggaaagaagcatgcaaagtaacaggggattgtgactcatattcaaaataataatcaataggtatgaacaatgactataaaagtgggtaataccagattttggtctctaacagcattctccttggaaaggaaccagtgctttttggagaattgacaggatccaggttagagacagggtagatacaagatgagcccataacattttttttttaatatcagaaagtaagggaataaaagtaagaaaatatttttaaaagatggagtatgtcacagggataaaggagccagcttgaagggcttcccactggctaagtctgagacagctggagcaccaaaatacttaagtacaaggataaattataagtcactgaaaaaataggacttcatgtatctcaggtgatcataaatagatatattggtaaacaatgtataatgctgagtaatgaatggtaatatggagggattgctggagttggaaaagtcagcatgttgcagccatcacagtataaagtttttatcaggcagacatcactaatggatactaaatctagggggaaattttgatgagggacaagatatttacatggtcttaaagtgtcttcccacagattacttgttagctgcaagggaaaaagtagtaatttttcattggaaaagttggacaacaccttggctgggtgatcaaaattagcataaccaagctggggcagatagactttttgtgcctttagatgtgatatccagagaagaaaatatcacttttgtagttttctgagaatgcagaaaactacacgattattctgaactgaatcctcaggaatcacctgaggaaatgtcatgaaagtcaaaatagagatgttctattaatataaaaagggggagaggctatattcttctaaagtgtcagtatcataaaagacaaaggaaagctggtgtggttcaggtgaaaggaagctgaaaagtaatggcagctaaatgcagtatctgaccctggactggatctgaattggaggaaagagaaatactataaaggacattattaggttaactgaatatggcagtagattaaactattatataacttttaaatttactaaggctgatagctatattgtggttatgtaagagaatattcttattcttaggaaataaattctgaagtatttagaggtaaaatgctgtgttgtattgcacttatctccttaaggctcagaaaaaaagtcaaatgaatgaatggacagtgagtgaatggttaaataaatgttgataataagtgaatctgggtaaaaagtacctggatacttttgtactattattattctacaactcttctgtaagcttgaaattatttccaaatacaaaaatttaaaggccagttatggtagttcatacctgtaatcccagcactttggaaggctgaggtgggaagatcacttgagtccaagatttcgagacccagcacatagcaagaccccatctctactaaaaaaaaaatcaactgggcatggtggcatgcaccagaaggcctagctgtttgggaggctgaggtgggaggattgcttcagcccatgggctgcagtgagccatgattatgccactgcactcagcctgagactctgtctcaaagaaaaaaaaaaagaaaataaaacaaaaaatcccagcaagtataactatgatttaaagagaaaagtagagtatgcagaaaagataaggtgtttcttaactacctttgtgtggattttctaccctttgggttgtctgtgctaaatacattaatcctatcgcagtgtcagtcacttagcatgcaaagccattctatctctgttggcgtatctatgagtatctatgcaggaagaaagaataaatattgctgttcaagttgaaactattttgttatatggtgtcatggaagagtttggagcaagggttggtagagctgggcactgatttcttctttgacacttgctggctgagtgattgggggaaagttccccaacctttgggaatttcagctgctgcattttaaaatggtgctagtctgttctcaagatcttatggctccaatgagaaaatgcatgtgaaagctctttgtaaataataatgatttcttctgcaaatattaagttactgttaataagacattaatagttttttttttgagatggggtcttgctgtgttgcccaggctagagtgcaatcacggcgcactgcagcctccacctcccattcttaagtgatccttttacctgagcctaccgagtagctggtaccacaggtaaataccaccatatctggctattttaaaaattatttgtagagaaaaggtcttgctatattgcccaggctggtctcaaactcctgggctcaagtgatcctcccacctcagcctcccaaagtgctgagattacaggtgtgagccactgtgccctgcccctgttaatagttttagttaaaatggcttagactgaggtagagtttccttaatccaggtggcccttatttctctcacaaatcaagtttttaattgatttgattatatgagagagttgcttttccaagtgggcccttttgttccttctggttgcttccttcctcattttctgcccttattattccaggtaaagcttcagcgactgaaggagtgtggactttttgaatttcaagaacagtaaagttggaacacagcagagggtgtgtaataaaatacaggtaagtcagaatcagcatttcacccattctcaaagaactcatggttctgaagttccttgtaatcactcttgctttgttctgagattgtgtgtgaggctctgatggcataaggggatcttccaggcctttgtggtgcccaagggcaaaattagccaacaaaagtcctgtgtggtttggaaaaagtaggaaacacacttaaagaggccagctcccccactggagaaggcaagcaatctgggccggggtggtagaaatgcataaagcaaaggccacaggaaagagtgtcagcctgagtctctggaaatgacagaaaaggatgctgctgaatttgaagtcacataaaccaggtaggaaaggttctaggataatgttagttgggggcatgccttttcccttaatctggaattgcttttgatggaggctttcgtcctggaagatcacggttaccaggtctgccttcttctctggagttgaacaggtaagtccagtgctgctcagagtgctaacctgagatgaaataaagagcttgacctagaacgtaaaagttagatgaacgaaacagtgtctctagtgttatcgttgattctatgtctgtttctatgttctatttctgtgtctgtgtatatgttgattactatgtctgtatatataatctccaaacaatatattgcttagctttaattttaagcttgaacagaatagtatattgcatgtagtgttctgcagcttgcatttttttttgccctgttatgttgtaagatttacttgttgcatgtaacggtagtaaattaatttttctggttaagttaaattctatggtgagaattgatcacagtttatctgttgtctcccttccctccaatctttggtattttgttgccccgctagtgggtttaaaatagtatatcattgtcatctttatttgcattttcctgattaatagtgcaattgaacatctttgatatcctttggagaacagagtgcatacttttaatttagacaaaaatttcagtctcttcttgtatagtgaatgaaacttgtttcttctttgttttttgaaagatagtctaaaaattttgaaactgtttatatggcacaaatattttcattgtggcggggtgcgatggctcatgcctgtaatcccagaactttgggaggctgaggcaggcagatcacctaaggtcaggagttctagaccagcctggccaacatggtgtctttactaaaaatataaaaattagccgggaatggtggcacgtgcctgtaatctcagctactagggaggctgaagcacgagaatcacttgaacccgggaggcggaggttgcaatgagccaagatcatgccattgcactccagcctgggcaacaagagcgaaacaccatctcaaaaacaaacaaacaaacaaactaaaaacatttttattgctaatctttgtttttccttttcttttgagttgaacttcttgttggtttatattcttattcaatttttctttctctgctgatttggaaattataacttgtatttctgttcttctaatgattatcctgaaaatatactgtgcacacatagaagttttaaagtcagtcagtatttaaggtattctaatccccttctggaataatacaaaactcatagtatacctaatgaagactccctccttctgtacatagatgttcttttcagcatatctgttttattatttgtttcaccatacaaattagtcaattttattgtatagagatggtatttgtttaactgtacatgcttatcatttcttattcctcttcctttcttctatccttacgtttcccctgatgagatttagcttcttcagaattttttcttttcctgagaatcttttggtggtaacttctctcaattttggtttctgaaatgtctttatttcactcttacagctcttagttgatagttattttttttcccagtgttgtgaacatactgttccattgtccatagctttcatttttgccgtcaggacatctgtttatctttcatttgctattttttttagtagatgatttgacttactctaagtttgtttatttgtctttggtgttcagcagtttcattacaatgtgtctatttagagctttcttttaagaattctgtttatatttttcgtatttcatgtatctatccatttatttcatttatccaccctaaacatttttcagctctcaatgcttgaatgctgccttttcttcattctctctgtcatcttctggttttgattaaatggaggttagaacttctctttttatcctttatgtctcttaatttctgttcagtattttctttcttgtttttccctgctttattctgtaatttaagatttagcttttagttcaatacttctctctttagctgtgttggctcttctgtttagcctatccattgactttttaattcaaatgggtatgttttttaaatttctaaaatctttatttctgtcttaaatctgcctgagtattttttgatggtttcattttgcttgctcattttttggcctcatcattaaacagttatttcatatcctatatttgataatgccagtatctgaaatccttggtggtctaaatggttttgggcttctttcctagtgtgcagggtgagtatggattacatgctaatatttgcttgataattatgtcttggaatcttgaagtattacttcttgagattttgtttgtgctaggagccaggaggatgctacagacccaggaccacttctcttccctttgaatacctattccctttggtttaaagctgggctttctccaccatgctgaaacttggatgtctagttgccccaccccattgctggtattcatagttacctccagggcaactccaactttcttttttgcccaatcctgagtgttctttgctcaggaacagtagatgttcccactatattctcacgggatttgtttctctacctggagctaaccaatgcattaaaaagtatttttaaatgtaatttattcagactctaattatagtatagcagaagggccttgcaaatatctaatccaccagaattcctgaattaggaatgctcaaatgatttttaaaaatcagttgtctctaagtactctttatcaatttattactttcctttatttcacctaaggataaagaaaatagtgcaagagtgatctttttgaaagctagctaaacatatgacatactatatccttacacttttgccggggttctttttgtagttaatctattgaatatttactcccttggaaactgaaattaccactcttggaataactcattagaacagagtacttattcagcaccaatttgttatgcctcccaatctattttctgtcacaatgccatttttctttctatgcagagtcttagatataaacgagtcagttgtgggtctctgcctgtggatgtgtttcttcttcacatggaatgcagaaaattgatgtttgctgttgtgaattagaggcatcatctctgtaagctccatgttcttacattctgcatccccttaataggcatagaaagcagcatgaaatttttggtctgtagaatgctaagttgccttgggctttggcacatgaaaaaagtatttcaaagtggatgtcaagtgaggttgctgatttaacagtttttttttaattattattccttctgcagcagaataattaccaatagacaaccatatgtttttagaggctacacagatctgacaagtgtgtgtgtggattttgtgatgaaagtaatacattaggcatgtctctaatttgcagtctctttgctttgtagattacaggtaggatatttgtaatactagtctaattataggaaagacaggcactgaaaacatttctaggaaatgccgagctctgcgatgagagattctttgaggaattgcctggtattggctctatactttcatttgaaaaataaaaatatcagaaaattgtgtagcttttccttgctttgatagcaaattctaatgggtagtaacttccaactgtgtccttgtattcttgggtttttcttggcggtcagttcagtcactgctgctagtttttgctttccaaatggttggaaagctgagcactccagaagcttcacctggggagctggggaggtgatggagtagtactggagatgcttgtcagggatggccagtgcttcctgagtgagctttgcctagccttctgtgccagtggagccatcaggctctatggcacactgctcaggcaaagggaaagacatctcattgccactgctccagttctgttgtcctgggccggggacttgatttggcaaagcagtaactggccctttgaacttgtcagttctctgtaaatgggtccctttgaaggttatgagttgcatgattagcatgatttttaacagaattcacctgagtgctgtttcttttccacagtgaagttggattctggtcgtatcaaaacaatgcagagacacagcccaagagtgctgtctttcataggtttatgtcagttagggtgctaaaaggtgaggcttgacagtcattgtcaagacaagtgaccaggctctgatgtatgacccagagcagtgttcctgtgtctccagtactttagtcacaatcgtgttcctctgcagtgagcagggttactcatctctctttgacttggcactgggacacttggccatttgtaacattttgctccattctcacaaaagataatgagttagtctgtttctaaataaggttttgaaaagttaggattattttaatcaccttcctctccaacctgttcttcctcctgctcaccagattcatatgtgagtgcttgttgtatcttctgtttgatgcgtgcaaaaaattcctacagaataacttttttggcccttgccacagtctgggagttcagagactggtgcatgggacagagggagctataacaggttcatcagtagccagactgcctgggttcaagttgaagatctactgatagtctgtaggactttggttaatcacttagctttgctgagttttgcttttccccacctaataactaccttaatctgtttatatgctacagcagtggttcttaagcattttggttttaggacccctctatacttttaaaaattattgaggaccttaaagaactttgtttatgatatctagcatattgtggtagcagaataatggtctaatggcccccaaagatgtggcatgacctagttcccagtagctgtgaatatattaccttacatggcaaaagactatagatgtgattaagctcaggatcttgagatagggagcacatcctgaattgtccaggtgggccctatgtaatcataagagccatatgagacttttagcactgctgggttagagcatagccacgtagccactcctagctgcaaaagagtccgggaactatggttctttttctgggtatcagttaaaagaactgggggttttgttataaggaagaaagggagaatggatattaagggatatttaacaatctcaaagacttatcgtgtcaaggtttggtatacatggtaggtagacaatcaccagaatgttagtttttcttctcctcgcccttttatgagtttggaaaaatggacatttcattcagactgcatcatttagaaatacctatgacaaaacacaacgacatgttggcacaggcgtaattgccatgaactgcatttttggtatttgcagataaattatatgaaatatcttttttttggtgctcacaggcaactttttgatatcttgtttgggtcttttgaacttaacaatatgcctcctttcctttggtaggaggaaagttggaattgaaatgagatttaagactcagctttgattcataactattcttcatgggtttgaaaatacatgaagtgtgacgttttcttcggggtcattttgtgaacagtctctgctggtccctggcagtgtcctgttgttgaagaataacccagttctagtttctgatgtgaaacagccattaggaatatttgtgctaaagtaccttatatttttaaaaaatgtttataaatactatgaaacagtctgggtctaaatggcttaattttgagcttaatataaacctgaatgctgattttattaattgatgaatatgcatttaatgcatttttagtgctatcctcatctttagatacattattgtaatagcttttgagtgaatgagggcttggagatattaacatcctatctggtctggagctattatttcagtctctggattagaagaagtctttgtgtcattcacacctgggagtgtccatttcctagctaaactggttgggaagggcagttttggcttgggatgggggtggagaggaagtgttgaaggtagttttgaagcctcaaagactcctagggggaaggggcacttgtttgggagctacaactggtccttggggtggccagagggctgcaccagtgtctggtgacctttccaaactggagctgaaaggggcacttctacctacttcgctgtttttcccagggaccattgaaaaccatcttgcggttgccagtttctgttttactttgtggttcactgtgttaccaggaagcaaggttcttcttggttgaaaccttagtgaggacagagagagtataagcaattggtgtaactgaaacttgagtgactggggacctactggtacttaacaccttgcatccaagaagctcagtgtttttggaaaatagcattgtaatggtagcatttgttacccacatgaggcatactacaaaaattacaagtgaaacttgtggaaggatgtccctacttcattttgtggtgtatttcagccctctatctgggagctctcagggctagctgtcttcaagacttgtagtgggtaagtgtggctggctgcagggtcccccatctcctttccatagtccatgtgttaccccgggtactgcaaggtggcaaaggccaaggtgctggttaagaggaagtcctgctgaaaaaccagtggttttggaaatatgagctggaataattttctgatagttttaaatttatgttgtaaaacagtgtttgatttgggagttcttgcgtttactaatcactaaaccatttctacatgtggaagctcaattaatgcagggccaagaacagtgtctttttttcccataaactcttgggcagcctgcgaacttcctcatagctggatcagaaggcattgcaggataggacccagccctcatggactggcaaacccaggtcattgccttgtgcacagagggactccagagggttttggaactggtatgtgagttgacgtccttgatctcatttcttattaatttcctagctgacttccatagcagctgttgcaaatacttgcttctttttgagctcctggtctcccatagccctgctcttggcaaatgtccatataaacaaagtcatgaagacagagagagagccctttctctctctcctttctgcttcagggtatgtctggttttttttctctgacaggtgctagcttggttctgagtgctatcatgtatggagaagtcttgtttcctactccctcacaccatctccttctgtcctgcgtctgccctctctcaggtgcccaagtaccctgttgccatattcagctactctgtggtatgcttcttgaaccggatagccttccccatgcctttgattggtatctttcctattatgacccatctgtttcacaatccactccctcaaagccctactatggacattgtaatctgaaatcataccttgtatgtgaacattcactgaatgtttattgacatctactgtgtgcgtgggagctgagggtacagatgccaggagatacggagatgagtcagacttctgagattattagtatagaatggagagagagacatgggacaaatagcattagagattaatgacaaaattatgtacaggttagaagggaagaggggcagtttaccttgaagaattttataagtgtggatccctcagacaagaggagagggtcatgccagagccaaaagccagtgatggattactgtgtccccactttctgataagatttcattgtgactcatctagagcagagggagacctctgtaactacaagatctctagtagtagcgtttggctcactgtggcaggtggttgcaaagaaccttttagggcagaaataggcctatgggtgtcctaaggtaacatcacatggataattgccaactctgtatatcttttgggctggactctgacttaaggagaagataagaagtcttcagtgaatttcttaagccctgagcatctttgtattctgctttaagaacttgttggtttctgtgtttcatactcaatggctctggcacttggatgacctggtcccacagaaggccttgaatactgagtctgaggatggggcttgcttacaaggaccttcctcactgtcttaaccagattgtgttttaacctttcatctcactttttacttttcattcatggatagtgtctgtcactgtgtgtgtgtgtgtgtgtgtgtgtgtgtgtgtgtgtgtgtgtatgaatgagtgaatgaatatttctcacactctaaattcttttaaaggcaggaagtactgttctcttgtttgctattttatccactctgcctctactgggtctggcatataataaacaaagagtgaacaggacaaacacccattctgaaaagtgaacttctctggcaattgtggtttgtacataccagctggagcatagacaattggctttttaatgtggtaagggaaaaggtcaaaagaaagtcctcatcatttaccaaagtgcttccagcagatgatgtttataatcccaaaagggtcttttcaatacataatgtgctttgatggaacagatttatatcccgattgtggaaattgttatataaatctatatatgagataaagttttatagaattgtatgtaaaaaaacccaaacaaacaacaaagaacatgtaaaaactagtgaaatctgaacgtgggctgtagtttattaatagtaatagtattgtacccagtgtcaagtttgtgctttgataattgtatagttattacgtaagatatggggagaagctgggtgaaggatacacaggaacattctacaatgtttgtatcttctatgtgagtctagagttatttcaaaatcaaaagtaaaaaaaaaaaacacagagataccactacacatctattaaaataagtaagaagcaaacaaacaaaacaaaaacagataataccaagtactgacaaagatacagagcaactagaactctcctacattgctggtgagagtctgagaagatatagccactttggaaaataggtggtgtttacaaagttaaacatataccatataagcgagtagtttcactcttaagtatttatccaagagaattgaaaacctctattcacacaaaaacctgtaggctaatacttctaacagctttattcataactgctaaaactggaaaaaatgtaattgtccttcaactagtgaatggataaacaaactggtatgcctattaatggaatactgttcatcaataagaaagaacaacacaactatttggctgaatctcaaacgcattatgttatgtgaaaggagccaaactcaaaagaatccgtactttatgattcaatttaaatgacattctggaaaaggcaagagtatagggttagaaaatagatcatgactgccaggagcatgtgatgggggagaagattgactacaaagggcatagggaaatttttgagataaatgaaatgttctatatcttgattgtggtggtgattacatgactgtgtgtgtttgtcaaaactcattgaactgtacacttaaaagattggattactgcatgcaaattataccttattaagtctgactttaaaataaaaacaccaccaacaaaaataaataattgatgatgcactttggcttaaataccatcaaaggatcattttgttagctacttggataaggatttgttaagtcattagttatacagaatgcctcattcaaatacaaaggtgcagccctttcagtactctggcttctaattgggtgatggaaatagctattactatagaggtggatgctctaatgatctttgttaaacagaatgctgctggaaggttaaaacaaaagctgctgattctagcgttagtggagatagtgtttagtatacaatgtgcagtcaaatttcactctatcacctctcctgattcctttgccattaaaatattcatcactagagaagagttgacttttcagatcctttttaatctcagccataacaaatgcactgtgatatatatatgtgtatgtatattttcctagaatggcttatcaaatgtcttactggaaaaaccaacatgtttgatttggtgggaggaggaatggctaatttaatcactctctaaaatacaattcacaaatgtttacagcaagaattggagggttctaactggaaatttgaagctgtagagctcttaaactgtgtttcttgataatcaacatcctttataaatcaaagtaaagatatgattttgaaagaaggcttaaattccaaactcttggctgtgattcgtggggttgaaggatataacttctatccttttgggacagatatctcaacaatatgtataagattacacagtctttccccaacaggaaatttcttgtttatttaaaactgggatttactaaattggtttgaatttaatgctgttcagtagtcaactcagttgagcaagcacttaccaataatcattaactagatgccacatctgtgatgaggtgctgagtttacacaggcaaatgagccccaagccctgtttttaaggaaattaccatccatcagggtggaccaaaccatgtacagccagctaaacttcagcaacaggggagatctctaaggaggaagctattacataggagatgacatttgaattcagccttaatgtgttagcagaatttggtctagtgtggaagacagaaagcccaaggttttatggcagaggcttaagaacttcaccgacaacttcttatattctccttaggtcagagcctggtccaaaaggtatagagaattggcagttacccacaagtctgccccaaagaggttctttccaaccacctgccacagtgagtcaaacaaactccgctgttggagatcctttacttaaagaggtctccctgcggtctagactagtcacagtgaaatcccatcagaaagggggccatagtaatctattgctggcttttggctaatgactgacatgacttcctttttgtcacttgatatttcactgtcataccaagagagatgttaaccgcagttaactgatgagaaacgtgagctgaagcagcttgtgtcacttgccctaggatgcagctctaggattcagtcaatgtctgactgtgctggttttccactacagcccatgtggcctactatgaggacatggagaccccataaacttatggcccctgagtctcagccctcaagtgtggttagcatgccaaaatggtaaatctttgaatactcttggattgtttagctctttaaatgtttgaggtgctcttatatacattatcatttgatttttactttaaaaacaactcacagaataaacgactgtagttttaaatagagcattgttgtcacacagcacctttggggagcccatacattgcttgaggtggtcaaagactggctgagttgctggggccagtagtagggagtgggtacatctttagcagatcccatgaattgtccctcatgggatctgttgtgggggattaaatggttctcttcctgtctccaactaagctgaggcttactgtaaccagaggagccactggcttggaacccctggttggaacataagttctcttgggcattgccattccagggtattagggtattggggcctgaggcccctgaggatagcatgaagccatctggggacttctccatgagaacttcttgtcactaagtgcgtgtaattgctgatttagtctagcctggcaggcccagtggttctggtaagtggtgttattataccaggctattggctggtagttggctaatttgaggaaaaaaagaggtggttggattctatggtaaattcagttggatgcaagtgataggatttgccacagggatcataaaaatcagggtgctgttcagggtgcacaggtgaattccatggctcaggcctgatttcactccactgtaggtacagagtgtgatcatgtgtgcaaaattgtgctttctgcccctccagagtgtttgataaaggaatgtccaagccgcctgtattttagcctgtttcgctcagcttgggctggcctgagcccaggaccttggtgttcctgggcttctgtcgctcagaagagctgcatgggagctcagagacaaaggggcttgttgtgtgaactcagatcagtggcagctgcaagaaagaagagataaagtccttctgttttgcttttgctcaactctaaatggtactttaggctttttataacattgcagtgttccttaggaaagcttgacttgacacacttattctcagggttttagggaccctctgtgaggaatggtttgatctgtcagaaggatggcctgacagggatagagcttttggccagacctagctaccaatgggctgtgtgatcttgtgccagttgcttcccctctctgggcctataagcctgggggagtttggactagagcagctgtgtgtttcccattcggtaccagcattctgggtgcatttggtactagaacaatgggttgtaatggacatgctttgcaggggttttggggcccgacagtattgcttcctattcctgggttgaagcacttattcatttggatcatggtgtggctgcaaagactgggttcagttaagtgaggtcatgtgcgtgaagcacctagcagggtacctggcacctgggaagggtgcagctaatggtggccactattaacatttaaattaggaggtatgtgcttgctgcactgcctttttacttcctgtcacagagtaagtggctcccattatctttaatttaaaaaaattctgataattgtggacaagcagcacatccctttaatttgctcctggaggagtgacctgtgtgatcttaggagtgagtgggcagctctgctttgctgccttcccttttagtgtaggattctgtaatatgaaatgaaactgagcagacacgtggtctgaatggctcacttagggacttcattatctatgtatggatttttcatagctcctaacttttttttttattaggaaggaaatctgtgtggcatagatgatgccatggaaaaatgcaactgtaaattttctttgagcaagaacacggaagcatgagaaggaaggcttaattccttctccaatatttattgaactcggctatttttcaggcactagagatgcaaaaatgagtacaatcaatatggtctttgccttcatggagattagtttattgaggcagagcagacattaaattacagaaataatgatttaattatagttgtgactagtgctgggagaagtacagagtgtagtaagtttaataagtgtgtaatgtaggatctacatgtaatggggagatcagaaaattcactctgggggaatgacttctagtgagaagtctgaagggtaagaggagagtattccaggacaagggagatggggaaggcaattctccaggaagaaggatgggaagatagagtaatcaggagggagaggaaggatcacagctcagtttcaggcctgagcaactgggagaaggctggtgccatgtctgcaggtagaaaatgttggtggattgtggtttgggtgggagtggggtcagccgggcaccctcctttctctttagaggatgctctccccccgcagatatagtgtgctttgctccccattcctcgggcctctgctcagatggccctgttagggagactttccctgaccacttcaggtacatcaccccctcccatccctgcacccttgggctcagcagcacctttcactgcctgatgagctgttggctgcatgtgaactccttgagggcagaggtctttgttttattccctgctgtatctatagcacctagaacagtgcctggcatattagaagccctcaataagtacttgttgaaagaatcatgagtttgcctttggttatagtttttgtgtccttttcaaacttgagtgactttttaaattaacctgaggctggagaggagaagggtgtagaagtactgttcacttgacatatcaggtcttttttaaggcaggaagaatggaaaagatggattttcttcttttaaaaaatttcagtgttaggcatgatagaacagagcagctagaaaaatgtttgaatatgacttttgttcgttataaattggtataaaaatctacccctctatctggtattgactagattttggggctaaattataacctattgtaattcctctgattgtttctatgggaggagctgttgactttttaatttaattttctaaatttatttttgagacagggtctcactctgttgcccagggtggagtgcagtggcacaatcatagcacacttcagcctctacctcccaggctcaagccatcctcccacctcaccctcccaagtagctgggactacaggcacacaccaacacacccagctaatttttgtatttttttctttttatagagatggggttttgccgtgttacctgcactggtctcgaattcctggcctcctgccttggcctcccaaagtactggggttacaggcgtgagctactgcacttggccaagctgttgacttttttattgtatctttttactactggggagaggtatggaggctaggatcaaaacttcatcaaaagggaaatttgagagcagcagtcgataaaaacaatttgttaagagatatttttggatctttgggtctctgtatagccagaaaggaataataactcagaaatgtttttctaaacctttttgacttttagaaataagtcaaccgccattactttaaaaaaaaaatgaacaggattgatgtttgtataggaggctgtgtatatagtggttacaagtatagctgttagagttagatctctgtttaaatccctgcctctccctccctattaccccatcttcccatccttcttcctggagaattgccttttgtcacttactacctgtatgagcttgcacaattacttaacttctttctttaaaatggatattatcaaaattatgttatttgggggattaagataaaataaaattcatttattgttaccatttataagctaacataactgatgacagtgctaaatgggatttaaaggtaggaactatcttgagaaagctaagtgttacaaagtataattagtccaatccagtgtttcccaaacttacctaagcttaagaatttcctcagggcacttattaaaaatatagattctcaggcaccacccggacttactgaatcagctctccaggggaggggcctgggagcctagtgaggtaggtagggtgatgacacaccctgcattttctgagcctgtcctggtttcaggtaccctgcatgatgaattccagatgtctgtttatacttgtcagactgtgtctcaattttcagacaggagctatgggcactgtttatgtaggccatctcattcagaatcctctctcatatcgatgcaggtagaacatgcttataaaacacgagaggatgtgtagccacaaagttgcatagtgtcagtcagcgtaaatcactcagctagcctggccttcattttttctctgtacaaaacttctacgatcttgataatctgctctgttaagtgcagacagtgacgtggtcaacatatgttgacagccctctgtcttgcccagtctctcaggccctagtgatatcaggctgtcagagtgacagtgcctgtggactgtgtctgcacggggcagtgaaccctagcctttgtcgtctaaggccaaacccacagaactgctcttctctcctccacgagctgggaactttcactcatatccgtgtgaagagaccaccaaacaggctgtgtgtgagcaacaaggctgtttatttcacctgggtgcaggcgggctgagtccgaaaagagagtcagcgaagggagataggggtggggccgttttataagatgtgggtaggtaaaggaaaattacagtcaaagggggttgttctctggcaggcaggagtgggggtcacaaggtgctcagtaggggagctttagagcctggatgagccaggagaaggaatttcacaagataatgtcatcagttaaggcaggaaccggctatctggatgtgtacatgcgggtcacaggggatatgatggcttagcttgggctcagaggcctgacaggaactagggagcaaggtctcactccgctacacttaggacaattagcgtgttcctaatcagctcttctagaaaaacagcattttgctgttttcacataagcctgcaagttcattttccctctctggcccaggtagtaagtaatcatttccccatcagtgacaagggaagatgaacatctaaaattttactcccagggctgagctttctgtagacattacaaatagagttcacatgtctttaaggaataaaggattctcacattcagttaaggtggttcttcccatgctaggtagggttggagaaaatgattctttggagatttaaggaattttctctggcagccattttttgtatcggtcatggtttcatatgatattttatttcactacattttgggttgtgcttaactgtatctttctttctgtttgcatcatgggagagattggatctgtgctgagaattttttttgggtgatacgttcattttctgaccagtaacaaatcagtccacttttggggactatttttaaaatggaaaagttgatgtacatttataaagttgcaaatttttacttcctttagaaaaaggctgtgaggtcttgagggcatccacataaatacatttgatgttagagacctggggactgaaaaggaaagtatttcttcttcttcttttttccctaatattttcctgtgacaaaattttgtatctgcacaattttaaagagtagaatactaaaattttggtgaatttaagaacaaactcattaggaaaatgtgaaatgtgggcagatatttgctgctctgtgggtatgcctaaaagactaaactttccagatagagagaagggtagggtcagcatgctggtaagtttgttttcttcccttccatgggcaggtagaaggaactgggctctcagtgggatggcacctctcctctcccttacttccctcggaagctcagttagggaggagcctggaccagtagtgttctttactgacttctcctgctgtgctggttttttttttttttttttctttcctcatttgtaaatcatctttgtgtggggagaggctggaggtggaaattcaagagtcatctttttgcaggcagtagagatgattacctaggtaagcagttttgatcagttatagctacagatagctatcttgtcaggtgagaggcctctgggggaggagggactttgtggcagaacagccaggggcctgggcactcagttcctgttgacagccagcaggcaaggccaaccccacatatttctaaattgcaaacacagtacattgtggaaacatagtctctgtccacaagggaggccctctgctcaaagaaacaaatgaaaaaaaacccaactcctccctttccccagcaaacatacaacaatgatggacagtgaagcaagatgtgcagtttggctgaatacccatacttaaaattttaattgtttttataatcatgtcttattatctaaaaagtaatttaagaatttttcttagggtttcaatgataccatgaattttaacatcttaccacattgtctaacctctttgaaagtagggccctaatcttgaggtttctggaaactcctgtggcaccaaacataggacagaacgccctatcaggactcagagacaacttgttgaattaaagtatgactcactagatttatgtaggtggaattcttcactacttgccttgtgggtgttcacattttgtccatattcatgatgtttatttacaagctgttttagctcaagaattgcctgctaattttttttggtctgcgtgtgaatcatatagaattatctctgcaaattaatttccttaatgaactcagaaaagaggaaaaaatcaaacgtatttcaccaagcattctacctacttaaaaatgtaacagagtacttttgtatataatataaagttttatataaaatgtagaaaatacataatggaaatagttgcctttttaagttttagataattgtgaacccctttcattcgctgttaggatgatagagtttgtggacttgtccttctctcctttctctgttcctcagaattgaaggacttcacaagggagatgctggtgtgctggaaaagaatgagaatttactccaagtaggattagggggcatgagtgagggtaccacagaagggcacatttgggggaagtatagatattattgccagagcataaattgcaggagaggatgacatgggatgagagggaaggaggccattccttctggctggcccccataatcactgagacccagggttgatagatactcataatgtgaccctgtgtcttcccagcattggttaattggttctttggaaaatcagatgagatcccttattactcttgaactaccatagaaatatttaagattacatgcccatataccttagttactgaaattaaagagtaattttaaagaattttaatggaacaatgattgcaacagaaagaatttcctgagctaataaacctaaactaatgccattatcaaggcatcctgatgttttgaaccatgtctctgggtggatggaagaaaaaagttagtatggacttacgttagccaaggtggtagtcctgaagccagtaacataattaaggttttggagtgctatttcacatgaatatttctcagtggagtatatgaataaagttaatgtgtcacaactttaagggtcaatttaaagtgccttgtaatattaatggaacccaaatcagaatccttatgtagaaattaaaggtgtcaatgtaagtgcttagaaaaatgcgtggcacacacactcatagagggtctggaagtgttttgatggtgaattagtacccttttggtttaacctttattttaaaaccgattttcatttatttgatttctttaaatgagaagtaagcatatatcttctttcacaattgcttcaggttcccaattgttttatattttactgtaatttattagtaaatttctataaacagaacagcagctatttgatggcagtttgggttaagtgatttctgagactttcccatagattctttgaatttaaatgagaagcctgataaaaattccaagttaaagatacccaggaaatctacaacagatcaagcttgtttttttgtttgtttgtttgttagtttgtttttgagatggagtcccgctctgtcacccaggctgaagtgcagtggtgcaatcttggctcactgcaacctccacctcccgggttcaagcgatcctcttgcctcagcctcctgactagctggaattacaggcacatgctaccacacctggctaatttttgtatttttcagtagagacgggatttcaccatgttggtcaggctggtctcgaactccagacctcatgatccgcccgcctttgcctcccaaagtgttgggattacaggcgtgagccactgcgccaggctgatcaagcttgttttttagatacaatatgtgaatttagcctaagccatacgtttaaaatatagccatttggcattaactttttaattaactaatcaagagaagagggaaaaccaatcttgtctcacaatgtgcactctacctttttgctgtaactaaattaagtataacttaaaatatatgacaagttcttgttaccactttttcaaactgaaaaaaggtataattttgtgatatgctaccactgtttattgtcctacctgaatatcctgcctttgggaaaagaatatttatgtttataatttgtatataagaaaatactatcttgtctacagtgacaatcttgaggtttggtgagtatatatatgaattgtaaaacagggtcatctgggagtagttgaggaaaggatatgtatatttcaatgctaaagagacctttttgtgacttaacttttagtggtataccagcaataatgagactttcctcctccttatcatcatctgtctttctttaagtgcttcttaggagccagagagcatgctaagtgctttgtacaatttcgtaagtgaattctcccaagaactttaagaaatggatattcatagctccatttcaccaatgagaaaaccaaggcttagggaaggtactttgcttcagaagtagctgtttcatatttgaatacaggatggttttgtgtccaaagctttatttttaaaatttaatctcagctgctattattaaaattacctctcagaaagtgaatagtagcatactcatgaaaatcaggttttctaatattcttagccaattgcatagatgggacaaaagtttaattctattagccagtttaaaaataaaaatacttaaagaattaccagtaggatggctactattaaaaaacccagaaaataacaaatgttggccaggatatgaagaaattggaacactcatgcactattggtgggaatgtaaaatggtacagatgctatggaaaacaatatgacagttcctgaaaaaaattaaaaatagaactaccatataatccagcaattccacttctgggtttagacctgaaagtgttgaaagcaggttcttgaagatatgtttgtacaccccggtttatagcagcattattcataataaccaaggagaggaaacaacctaaatacccattgatggatgaatgggtaaacaaaataggatgtttgcatacaatggaatattattcagccctaaaaaggaaggaaattctgacacttgctacaacatggatgaaccttgaggacattatagtaagtgaaatcagctagtcacaaaaggaaaaatactatatgcttctacatatatgaggtacctagtgtattcataaagacagaaagtagaatggtggtttccaggggctgagaggggagttactgtttaataggtacagaatttctctttgggatgttgaaaacactctggaaatggatggtggtgatggttacacaacaatgtgaatgtacttaaagccataaaactatatacttaaaaatgattaaggtgataaattatgttatgtatattttaccacaataaaaataatgctttaaaaagaaaataaggattgaagtgattggttgtgaattcctcttccctctgaatgataaaagagattttatccgatcacatctttcccatgttaagttaccatgatcccctcccccaaacagcattgctgaaaaagcaggggtggtgggcaagtcattgagaccttgagttatatttccctaactcccaacttgcttgaagtctgtgttctcttcatcttgtcttttaaaaatgagtgggcttttcttagaaaccaaattccctggagtgtgatatcagcatacttttactctgagagtttttagcagcagctttctcagcctgagaggaaaagcaaaatataaaaataacttagggctcacattcaaataggtaaacagatatgtccaaagtgaaacctctaactgaaagtcatgcatttcagttaggcacagtgttagatggtaggtggatgaatcatctggtctgacctgtcaactgaaggatctggaatttttttttttttagatgagttttgctgttgttgcccaggctggagtgcaatggtgcgatcttggctcactgcaacctccgcctcccaggttcaaatgattctcctgcctcagccttctgagtagctgggattacaggcatgcaccaccacgtccggctaattttttgtatttttagtagagacagggtttcactatgttggccaggctggtcttaaactcctgaactcaggcgatccatctgcctcggcctcccaaagtgctgggattataggcgtgagccaccgcgcccggccaggatctggtatttaatactcacttaccttttggcttctcttgcataatctcactggttctgttcagctccatatggacaagtttaatatgatagaacactgaagcttgtttgtcatgtcttccagctttaacactattatgggttgtatagattgtaattcttgaaaagatgagtcctcaacatttcttgttagttgatagctatgtgagcagtatagtggtgaatggagctcacactgaagtgcataatgatccttattagacaactttgtaagtttgaaaatgtcatcaaaggagaattaggatcatctgtcaaggctaccctattgtggggaagagaggtgtgggtggaggcagagttctcatcgttaatcgttgacacttggagaggtttgcatcgagccttctggacttcattctaatgacagtagagctgtctctacatttcagtgttggaagaagggtggaggatgactttaccatatcccccttttaagatcacttttaccagtgggtggaagctagagtggaattagggagaccaaacaggaggctgctgtgggtttgtgtctaaagatgttggtagtgacattagttgacatgcatggaggactacttggatgccaaaagctttatccttactgtagctctgtgagctatatagatgggtgacattactggcaccattttgcggatgaggacatccaggattagagaggctaagcagtttgcctaagatcacacagctcataatgaatttgagatggtagccaggcctaggtactggtagagaggagctgtttttattctcccaaagccatgggatcacctggaatgtgatataggaaggcctagggttgtctttaaactgggatctgggagccattaggcagctctggccatgtctgttcctacttggaatatataacagcttctggacattattaagtgggctggcttgtgttttgttgaggaacaggacaaatggggcatttactagtgctgtgtgcctcgttgcttttctgggtagtgtttggtgatgggcatagtgtggagtggtggtagagtacacagtgtgattctgtctggtaaggaagctgtacgttgatgttcactgatgtgaataggttcatacagtcccttaggcatttggctggaggataaagaacagccattgaccagcagagtactttttttgaagtttatgcaagacagcgtgctaggtactactgccagcttgacaataaaggcagaaagacatttagagccattaaagaattatttataccagaatacaaaaacacacttttcaaatgttttgtaggcccttttcctgcacagcatgtgcctcatctactcaaatttaggaaaggtggttggtggttttgcagagaagcaaggaactgtaatatctgtctgcattggtcatgcttatcatgtaacacactggattcagtataaaggaaaaccgacaggtatggagtgtctgctgttttatttttaaaaaattgttcattttttaattaaaaaaaggaaatacgtgcacatgactttaaaaagctctgtaaacaacatagaaggatgccgaaagtgaaaatcctccctttcatctcagttctcccttgccttccccagagataggccaaattttcttatgtatttttccatatatgttctatgtagatacaaacatgttctgtgtatgatatgcatactattccaaactttgctctttttttttttataattcttggtgacaattccatatcagccagagaaatctattcaatttattttaatgtagttggacaatttcaatatatgaaattaacaaaatgtttttagccagccccctacttaaaccttagagcttttataaataatattgagaagtatatccttatattcgttattttacacattcttcagtacatctgtagaataaacttctatgtttatatgtacatttaaatattgggagcctaactgttggtctgtgtaaagctagattttgaacatctattgtatgaatgaccagtctttttacagaatttaacttgattaacatggtttctatcctgcttgcatttgtgaaaaagtgcagatcaaatagatcacattctatttaaacattttctcctaaaattaaggcattttagccaaattttatttcagagaagtacagtttaatcattaattaagcctcttccacactttgacagatacagcacatccttttttttttttcttaacttttttttttttttttttgagacggaatcttcactctgctgcccagactagagtgcagtggtgcgatctcagctcactgcaagtcccgcctcctgggttcacgccattctcctgcctcagcctcccaagtagctgggactacaggcgcctgcaatcacgtccggctaatttttttttttttttgtattttttgtatttttttttattttatttttttttttgagacggagtctcgctctgtcgcccaggctggagtgcagtggcgggatctctgctcactgcaagctccgcctcccgggttcacgccattctcctgcctcagcctcccaagtagctgggactacaggtgcccgccactatgcccggctaattttttgtatttttagtagagacggggtttcaccgttttagccgggatggtctcgatctcccgacctcgtgatccgcccgcctcggcctcccaaagtgctgggattacaggtgtgagccaccgcgcccggcctttttcttaatgtaggtaaactggtgtcatgggagtttgttgaacagattatttcatcccacagatattaagcctactatccattagttatttttcctaatcttttccctcctcctaccctctaccctctgaaaggctccagtgtgtgctgttcccctctacgtgtccatgtgttcttatcatttagctcccacttacaagtgagaacatgtggtattttgttttctgtacctgtgttaatttgctaaggataatggcctccagctccatccatgttccttcaaaggacatgatcttgttcttttttatggctgcatagtatacaacgttgtatgtatcacgtttcctttatccagtctaccactgatgggcatttaggttgattccatgtctttgctattgtgaatagtcctgtaatgaacataaggcatgcatgtatctttataatagaatgatttttattttttgaatgtatacccagtattggaatggctgggtcaaatggtatttctgtgttcaggtctttgaggagtcaacacactttcttccacaatggttgaactaatttacactcccaccaacagtgtataacattcttttttctctagaacctcgccagcatttgttattttttgactttttaataatagccattctggccaggtgccaggcgctcatgcctgtaatcccagcactttgggaggccaaggcgggtggatcacgaggccaggagtttgagaccagcctggccaacatggtgaaaccccatctctactaaagatacaaaaaattagccgggcgtggtggcacacaactgtaattccagttacacgggacgctgaggcaggagaatcacttgaacccaggaggtggaggctacagtgagtcaagattgtgccatcgcactccagcctgggcaatagggcaagactctgtctcaaaaaaacaaaatggaaaataatagccattctgactggtgtgagttggtatctcattgtggtttttatgtgcacttctctaatgatcagtgatgttgagtttttttttttcatatgattgttggctgcatgtatctcttttgaaaagggtctgtttgtgtcccttgcccactttttaatggggttgtttttttcttgtaaatttgtttaagttccttgtagactctggatattagacctttgtcagatgcatagtttgcaaaaaatttctcctatactgtaggttgtctgtttattgatagtttcttttgctatgtagaagctctttagtttaattagatcacatttgtcaatttttgcttatgttgtaattgcttttggcatcttcatcttcatcatgaaatctttgcctgtgcctgtgtcctgaatggtattgcctaggttgtcttccagggcttttctagttttgggttttacatttaagtctttaatccatcttgagttaatttttgtatatggcgtaaggaaggggtccggtttcaatcttctgcatatggctagccagttatcccagcaccatttattgaatagggaatcctttccccattgcttgtttttgtcaggtttgttgaagatcagatagctgtaggtatgcagtcttatttctgggttctctattctgtttcttttgtttatgtgtctctttttgtaacagtaccatgatgttttggttactgtagccctgtagtatagttttgaagcagcattgttgtctggggtaatacccgaggttcgttgcctcatgacaaagaaatcaaggacacagatacaggtaaagtgaggttaagagaggaggtttaaaaggccaaagaaggagaagagaagagctctctttcctacagatagagagataggtgtttaagtgggtcttttggcccatagtggagttcttgttctttttcattaggattgccttggctgctggggctcttttttggttccatatgaattttaaaagagttttctctagttctgtgaagaatatcaatggtggtttaataggaaagcattgaatcagattggtttgggcagtatggccattataacaatattgattcttcctatccatgagtacagaatatttttccatttgtttgtttcatctctgactttctttgagcagtggtttgtagttctctttgtagaggtctttcacctccccggttacctgtattcctaggtattttattctttttgtggctattgtgaatgagagtttgttcctgatttggctcttggtttgactattgttggtgtgtaggaatgctagtgatttttgcacattgattttgtattttgagactttgctgaagttgtttatcagcttaagcttttgggctgagacgatggggttttctagatataggatcatgtcatctgcaaacaaggatagtttgactgactctcttctcattatttctttctcttgcctgattgccatggccagaacttccaatactatgttgaataggagtggtgagacagggcatctttgccttgtggcagttttcaagaagaatgcttccagcttttgcccattcagtacaatgttggctgtgggtttgttgtagatggctcttattattctgaggtatgttccttcaatacctagtttattgccagtttttaacatgaatggatgttgaattttatcaaaacccttttctgcgtctattgagataatcatgttggttttgtttttagttctttttatgtgatgaatcacatttactgatttgcgtatgttgaaccaaccttgcatcccagggatgaagtatacttgaccgtgatggataagcttcttgatgtgctgctggatttggtttgtcagtattttgttgaggatttttgtatcaatgtttgtcagggatactggcctgaagttttcttttttgttttatctctgccaggttttggtatcaggatgatgctggcctcatagaatgagtttgggaggagtacctccccatcagttttggggaatagttttaacaggaatggtaccagcttttctttgtatctctggtagaattcagctgtgaatctgtctggtttggggcttttccttggttggtagggtatttgttactgcttcaatctcagagttcgttattggtctgttcagggattcaatttcttcccaactcaatcttgggagggtgtatgtgtccaggaatttatccatttcttctagattttctagtttatgacagcacaatcttaattctgacctatcagtgtcctattaaaactcaggaactgtaggcaaccatgatgagcatgggagccattcactttgctggatgaagaattttctgatacttaaatatgaggaatgtgctgagtatctattagtggaaggtctttattttttatttgcttattcttatttatttatttttaagagaaaaggtttcactctgtcacccaggctagagtacagtgatactgtcatagctcactatagcctcaatctgtggggctcgaggatcctccttcctcagcctcccaattagctaggactataggcccgtactgccatgcccagctgtattctttttaaatttcctttttgtaaagatggggcctccctgcattccccagctgctcttgaactcctgggctcagctgattctcttgcctcagcctcccaaattgctggaattacaggcatgagccactgtacctggctgctgctgctttttttttctttaaatagcagtttacagatttgttttgaaagacagtttgctaaaatatcaattaatatcactaatgaataagcactactcttttttactaattattcttgtcaagggtggtctgagctgggtgtagttattgagatttggaacatgtgtatctaggttccataacatggtcttgagaggccatggagtgggagcacccactgagcacttatcaataattacgtctacactgatattaataatagctaacatgtgttcagtcactacttgtcaaattcctgcaatttttttgcctgttttatggatgaggaaattggagaagttgagcccacagatagtaagtggtagagcaaggatttgctccgaacccacaccatgaagttacacattggcctccacaagaattctttgagatcgataatactgtttccattttacctttgaggaatttgagacttagaattaaatgacttcagcttaggtcattaaaggtcacagagctaacgagaaaccatatgatgtgaaatcgagattcttcagtgttgctgctatgtaggcttgtcccacacatttcaggacatttagctaccttggacccacccactaaatgccagtagggactctgatgactgggccgtctaaaaatgcccccacatagttctaatgccttctcctaggcgtcatatttacattcttaaattcaaagcttgtcttttacccttatactatatcacctctcatggcaattttttaatcaacactaatcaaacttgactctagctcataatttagaatattaggaataattataaatgcaaatcattttaatacagaatcacacataagagtagcatttcatccaactccctgtttagtagattaaaactcactttctctaagacccagagatgacaaagaccttcttaaagtcaaaaagcaaattgatagctgactggacttaagtcatatctctgaacttgagactagggccatttcttcacattaccagtttgcttcaggcaaatgtatttgactaagccgtttttatttttattttttatttttattttttgagatggagtctcattctctcacccaggctggagtgcagtggcaccatctcagctcactgcaacctccacctcctgggttcaagccattctcttgcctcagcctcccaagtaggtgggattacaggcacctgccaccacgcccagctaatttttgtatttttagtagagatgaggtttcatcatgttggccaggctggtcttgaactcctgacctcatgatctacccaccttagcctcccaaagtgctgggattacaggcgtgagccaccgtgcccagccaccatgtttattttttaatgagtgattttgacctttcaaagggaaacgtttggagggttgatgtaattgagttgaaacagcacaccatggaactgcagaacaagttcgtggctattttggaaaagctatttcaaacatggtctttcccttaagcagttttatactgctgacagaactggatgcttacatgagacttgtcactttcaccctagcaggtgtttgtgaatcaggcttcccccaaatttaagtaggttaagaagcaggtcgaataatatcacatatattaatcctgaaggttcccatggagggaaagaatttatggtgaatgaaaaatgttatcatttgaaagcatccacatgtttcggataatttgttgagtgtctctgtcatgtggaagatgcagttgtaagttctgtgggtgaatttggtatatattttgcctattgcttatggtgctgatggtctccaaacgctttgtgtattttcaatgaaagataacttaaaagattactccttatgcccacttcaataattaaatgattatagtgtccactctgtagaatcagggctagaggttagtattggcaaatacatcctctctctttgtctgacacttccagtctcatttgtttaatagtatgcctgtagaatatgaaattttttggaacatatttaatgaagaagtttattcattattcagggaagatcaccaaatgattatagctttttaaaaagcatctttaatctcatagagttgcttgggcctgaaatttggatcataatcagtgagccacggagcttgaggaaactatgaccaatgcagaaaggtctcctgatgaatgataggagagcattggcaggtgttggaaaaacctcaattatcctggtacaaattgagaggtgttgagggatttgcatttcttactgactatgggaaaaagaagttaattgaagctgttgacaaagattttccattagtgattcagaaatcatagaggttgttttgaaattacccaagcatagtaatgggaaaataatttttctttctttttcctctttattcttatatggagaatgagaatgttacttgggaaaagtctggaatattgactcattttgtagacacctatactgatgttatgtttctttgacttttatgaaagagagaccactgattaaaaagcccgatattaatttcttcaaaagaataaaacagatttagggtatatgctggtgttgtttattctgatttatatgcatatcgtctgtacccatagctatggcatattactgtaatcagtgttctaatgatgaccttgtctcaagaagactatgtgaaattgggttctggaggctcttgttttaagaatcaggaaataggccgagtgcagtggctcacaactgtaatcccagccagtttgggtggctgaggtggatggatcatttgaagtcaggaattcgagaccagcctggccaacaagatgaaaacccgtctctaccaaaaatacaaaaattagctgggcatggtggcgggcgcttataatcccagctacctggaaggctgaggcaggagtgtcgctagaacccaggaggcagaggttgcagtgagccaagatcgcaccactgttttccagcctgggcaatagagtgagactcagtctcaataaataaataaataaataaataaataaataaataaataaataaaataaaaacaaaataaaaatcaggaaatatcctcaaaaacatgtttaaggagatgagaaaattttcagaaaacactgtagtgaaaatacttgtaaaatagtatgggtattaggccttcaattggataaaacccaattatgttttctaaaatttggcagtgaaacctgagtaactcttctattataaggaaaaaacacctcagctctccacaaagcactgaattagccatctctcaaaaaatggaagtgaggacaggtacataaatgtggaagaatatttaatagtttaatgacctagaagtacattcatgtgttctgaaatgaaaaagattatgaggtagtatatatagttgtaaacttataaaatgaatgaatttataagataagaaacatacaaaagatataaggcataaaaaacgtgtacaaaatatgcaaaagtatttaaaataatatataaaaattatacagaaagtaagcatttatttatttagtttttattttaagttccatggtacacgtgcaggatgtgcatgtttgttacataggcaaacatgtgccatggtggtttgctgctccagcaacccatcacctaggtattaagcccagcatgcattagctattttccatctgctctctctccctccacccccttcccctgacagaccctgtgtgtgctgttcccctccctgtgtccatgtgttctcattgttcagctcccacttatcaatgagagcatgcagtgtttggttttctgttcctgcattagtttgctgaggataatggcttccagctccaaccatgtccctctccctccttccaccctctaccctttgataggccctggtgtctgttgttccccactatgcatccacatgttctcatcatttagctcccaattataagtgagaacatgcggtatttgggtttctgtttctacattagatggctaaggataatggcctccaactccatccatgtccctgcaaaggacatgatctcattcctttctatgactgcatagtattacatagtatatgtgtaccacattttctttatccagtcatcattgatgggcatttaggttgattctgtgtctttactattgtgaatagtgctgcaatgaacatatgcatgcatgtatctttataatagaatgatttatattcctttgggtatatatccagtaatgggattgttggtcaaatggtatttctggttctagatctttgaggaatcaccacattgtcttccacaatggttgaatgaatttacattcccatcaacagtgtaaaagcacttctatctctctgtagcctgaccagcatctgttgtttcttgactttttgataattgccattctgactggtgtgagatggcatctagtggttttgatttgcatctctctaatgatcagtgatgttgagctttttttcatgtttgttggctgcataaatatcttcttttgagaagtgtttattcatgtcctttgcctactttttaatggggtcatttgttttttcttgtgaatttgtttaagttccttgtggactctggttattagatctttgtcagatggatagattgcacaaattctctcccgttccgtaggttgtctgtttgctctgatgatactttcttttgctgtgcaggagctctttagttgaattagattccattagtcaatttttgcttttattgcaattggttttgatgttttcattatgaaatctttgcttgaacctatgtcctgaatggtgttgccttcttctagggtttttatagttttgggttttacatttatgtctttaatccatcttgagttagtttttgtattaagtgtaaggaaaggatctagtttcaattttctatatatggctatctcagttatcccagcatcatttattaaatagggaatcctttccccattgcttgtttttgtcaggtttgtcaaaaatgaggtggttgtagaggtttgctcttatttctaagtactctattctgttccattggtctatgtgcctgtttttgagtttgaagttgggcagtgtgatgcctctagctttgttcttttgcttgttttttgtttttgagacagagtcttgctctgttgcccaggctggaatgcagtagtgggatcttggctcattgcaaccttcgcctcctgggctcaagtgattctcatgcctcagcctaccaagtagttgggactacaggtgtgcaccaccccacctggctaatttttgtatttttagtagagacagggtttcaccacattggccaggctgctctcgaactcctggcctcaagcgatccacctgccttggcctcccaaagtgctgggattatgggtgtgagccaccgcacccggaaatgctttgttctttttgcttagggttgtcttggctatatgggctctttttttgttctatatgaattttaaaatagtttttcctaattctgtgaagaatgtcaatggtagtttaataggaatagcatcgaatctgtaaattactttgggcagtatggccattttaatgatattagttcttcctatccatgagcatggaatgattttccatttgtttgtgtcctctctgatttccttgagcagtggtttgtagttctccttgaagaggtctttcacttcccttgttagctgtattcctaggtattttattctctttgtagcaattgtgaataagagctcattcatgatttggctctctgcttgtctgctgttggtgtataggaatgctagcgacttttagacattgattttgtatcctgagattttgctgaagttgcttatcagcttaagaagcttttgggctgagacgatggggttttcttgatataggatcatgtcatctgcaaacaaagacaatttgacttcctctttttaaaatttgaataccctttatttctttctcttgccctattgccctgccagaacttccaatactatgttgaatacgagtggtgagagagggcatccttgtcttgtgctggttttcaaggagaatgcttccagcttttgcccattcagtataatgttggctgtgggtttgtcatagacagcttttattattttgaggtatgttcttttaatacctagtttattgagagtttttaacatgaagggatgttgaattttgttgaaggcttgttctgtgtctattgatataatcatgtggtttttgtctttagtttagtttatgtgatgaattatctttattgatttgtatatgttgaaccagccttgcattccagggatgaagccagctcgatcatggtgggtaagcttttgatgtgcttctggattcagtttgccagtattttgttggggacttttgcatagatgttcatcaaggatattggcctgaaggtttctttttttgtattttctctgccaggttttggtatcaagatgatgctggcctcataaaatgagttagggaggagtttctcctctttgattgtttggaatagtttcagaagaaatactaccagctcctctttgtacctctggtaggattcagctgtgaatccgtctggtcctgggtttgtttgattgctaggctattaattattgcctcaatttcagaacttgttattggtctattaagggagtcaatttctttctggtttagtcttgggagggtgtatatgtccaggaatttatccatttcttctagattttctaaattttttttgcatagaggtgtttatggtattctctgatggttgtttgtatttctttggggtcagtggtgatattccctttatcattttttattttgtctagttgattcttctctttttcttctttattagtctagctagtggtgtatctattttattaatattttcaaaaaaagccagctcctgtatttgttgattttttgaagggtttttttgcatctctatctccttcagttctgctctgatcttggttatttttgtctcctgctagctttggggtttgtttgctctttcttctctagttcttttacttatgatgttagcatgtcaatttgggatctttctagatttttgatgtggtcatttaatgctataaatttccctcttaacactgctttagctgtgtcccagaggttctggtatgttgtctctttgttctcactagtttcaaagaacttcttggtttcttccttgatttcattatttactcaggagtcattcaggagcaggttgatcaatttccatatagttgtgtggttttgagtgagtttcttaatcttgagttctaatttgattttgctgtggtctgagagactgtttgttatgatttcagctctttttcatttgctgaggagtgttttacttctaattatgtaatcaattttagagtaagttgccatgtggcaccgagaagaatgtatattcttttgttttggggaggagagttctatagatatctatcaggtccacttgattcagagctgagttcaagtcctgaatatctttgttaattttctctctcagtgatctgtctaatattgacagtggagtgttaaagtcacccactgttatcatgagggagtctaagtctctttataggtctttaagaacttgttttatgaatctggccaggcacgctggctcatgcttgtaatcccagcaccttgtggggctgaggtgggtggatcacttgaggtcaggagttcaagaccagcctggacaacatggtgaaaccctgcctctactaaaaatacaaaaattagccaagtatggtggtgcatgcctctaatcccagccactcaggaggctgaggcaggagaatcgcttgaacccaggaggcagaggttgtagtgagccgagatcatgccactgcactccagcctgggcgatagagcgagactgtgtctcaaaaaacacaaaaaacaaaaaacccctcaaaacttgtttttttatgaattcgggtgctcctgtattgggtgcatatatatgtttaggataattagctcttcttgtggaattgaaccctttaccattatgtaatgcctttcttgtcttggttgatctttgttggtttgaagcctgtttgtcagaaactaggattgcaacccctgcctttttctgccttccatttgcttggtaaattttccttcatccctttattttgagcctatgtgtatctttgcacgtgagatgtgtctcttgaatacagtgcacagatgggtcatgactctttatccagcttgccattctgtgtcttttaattggggcatttagtccatttacatttaaggatagtagtgttatgtgtgaatttgatcctgtcaaatgatcctagcctcatgatgctagctggttattttgcagacttgttaatgtagttgcttcatagtgtcattggtttgtgtacttcagtgtgattttgtagtgactggtaatgctttttcctttctgtatttcatgcttccttcaggaattctcgcaaggcaggcctggtgatgacaaattccctcagtgtttcgaaaaggattttattttcctttgcttatgcctgaaaaggattttattttcctttgcttatgaagcttagtttggccgtatatgaaattctgggttggaaattcttttctttaagaatgttgaataatggcccccaatctcttctggcttgtagggtttccactgagagttctgctgttagtctgattggcttccctttgtaggttacctggcctttctctctggcttcccttaacattttttccttcactttgaccttggagaatctgatgattatgtgtcttggggttgatcttctcctggaacatcttagtagtgttctctgtatttcctgagtttgaatgttggcctgtcttgctaggttgggggagttctcctgaatgatatcctgaagtatgtttccaacttggttccattctttccatctcttttaggtaccccaatcagttataggtttggtctttttacataatcttatagttctctaaggttttgttcattcctttttattcttctctaatcttgtctgcctgtcttatttcagcaaaatagtcttcaagctctgacattgtttcttctgctggtctattcggctcttgatacttgtagttgtgctatgaagttctcatgttgtgtttttcagctccatcaggtcatatatgttcctctctaaactgattattctggttaacagctcctgtaatgttttatcattgttcttagcctttttgcattgggttagaacatactcttttagctcagtgaagtttgttattactccccttctgaagcctacttctgttacttcatccatctcagcctcagcccagttctgtgcccttgctggagagttgttgtgatcatttggaagagaagagacactctgactttttcagttttcagagtttttgagttgattctttctctatctaccttcaatctttgaggctgctgacctttggatagggttttgtggggtcttttttgttgatgttgttgttgttgctttctgttggtttgtttttaacagtcaggcccttcttctgtaggcctgctgtggtttgctaggggtccactccagaatatttgcctcagtccctcccacacctggatgtgttactagtggaagctgcagaatagcaaagatgggtgcctggtttttcctctgggagctctgtcgcagaagggcactgacctgatgccagctggaacactcctgtataaggtgtgtgatgacccctgttgaggcgtctcaccccatcaggaggcacaagatgagggatcctcttaatgaagcactctggctgcctcttggcgaagtgggtgtgctgggctgtgaggaatccccttggtccagactgctcggactccatccagactgccaacaatctttagagccagcaggcaggaaagattgagtctgctgagctgcagagactgtggccacccctccccatgggggctccttcccagggagatcagagttttgtttgtaaatccctggctggggttgctgaaattcccacagggatgccctgcccagtaagaagggatggatctgggtctcacctaaagaagcagtctggccatgatctgccacagccactgtgcggtgctgtggggaattcctcttggtccaaactgcccagtctctttagcactggcaggggaaaacagctgactagggcctcagtgatggtggctgcccccgccccccgacaggaactcagtcatcttaggtagccttcagcctgctgccactggccacaaaccaagaggccactgaaagtctgcacagctctgtgtttgggactcaaggccttggtgatatgggctcacgagggtatctccagatccacggttgcacagatctatggaaagagcatggtttcctgggcagggtagcacaatcacttaatgcctcccctggctggggttgggagttccccttgccctgtgcagctcctgggtgtgccatggctccaccctgcttttcctcactctccatggtacaccaactacctagtcagtcccagtgagagaatctggatacctcagttgaaggtgcaggattcattcgccgttttcattctgcttggtgggagctgctgaccacagctgcttctaagcaaccaagtaagcatttatttagcactaactgccaggatattcttggtgcttaagatatacatcagtgactgcttaatactctcgttttctttaagacctagctcaatgtcatgtggaccatgtggaccaaaaccagaaagcttttgctgaactaccagtgtgggtgtgggtgaggtactctcctgtgaggtatcctctcatgtagtactcactgcatgagttatgttcctgtatactatagacgttcatccttctttctttgttttaggttgaaaatgtcataaataagtctgtttgatgagaaagaagaactaatagaatgtaaaaggctggagggatataaaagaaagataattaatgaaatgagttttacaaaaatattcctaattagagccctttaaatggcatactcctcatgggcccataaattattatatgattttagaaaagaaatagattccttctaagatgtacttcagttgtagaaatcaagaaatacttgtggtgttgctcttttatctatgagaaatatccatacatccattaaaggatgtatccatataatgatgtatatataaaaaatatatatacatcagtgaatcaaagattttcccttggtggtgtgctaaaagagaccagtaagaaatgtttcaaaatgtaagtgcttttgaccaagggcaaattacaaattatttgtaatttttgttgcctgtgtgtgtctttattttctaaatatttgtcaatgaaatctattacttttgcaaacatgggaaaagtaagaaaaaaatataatgcggttcagaaagattttcacttactaaaggagaatataaaaaatttagctcagaaagtcacttttctgttaactcgacagttaatctccaatatattgttcaatatccaagagttttgctagatttctgttttgccttgggactcctaagggacacaatgcttggtagcccatagttgttactactttaatcatgcaaatctaggacattagggcagtgagttagtgcatgaatgattcttgggcaccttagatcatacttgctagtaaggtcctctttgtctctgcatattgctggcctggatggacacttatcttttggctgaagaatacatccaatggagagaacccaagagccaagctaagtgaatcagtttcactaggacattaatttctaagatgtagtccttggagttctggagagcaaaagatggtgcattactggaaattcactatactcattaacatatttaaggctggagaaattctggagcaaagaaccaaaggtaactgcagacaaagaagggtttttaatggaatgtgactggcatctaggaactggttggggggtggatggcccctgaaaagaaaggttggaaactgaatgggagaaagaggggactgatcttactgatcaaggtggttcctgtaccttgtatgggagtaacatgaaatctttaattccccaaatctaagtacactatgtggttacaacaggggcaattttacatttgtgtgaagcttgaaatggtttcctaattgaatcgattgttgtagctttgaaaaattgtgtttaaatgacatttttgtaaaatacaaaaataaattcctatttttaatctcagtaggagacttttacttgcaagaatctttatgatttctgctgtgtaaatcctttgtgtaaatgtatttttatgcatcaggttacttatattaaaaaactcctctgttgattttcagttgataggttttcttataacatttacaaaaatggatggtacaattaacctcctactcactgaccctgtaaagagaaatcatttggctctattttttttgttaatgtctacaatatgtcctttaaagaagtcttatcaagggatagataggtagagaatcctaagcccctattctggggagttgaaaggttttaaggatttagaaatttttgcttacaaatacatgtgttactttgctaatttagaggtatagctatttagttcagaaaactaaggataaggccattatattggggacaaaaatattttatttcttagtagatgggatccctttactttcttggttatgtgttccagctgtcttcattgtgtggatctgactgtgtttttagctatgtttttacacacatgtaccatcttctacatgcatttacttggattttatttatattatatctgttaagaagcagattcatgacatacatctatgcagttggaattcaaggctgtccatcagttgttacccactgatgtacgtaacagactgggaatgtaacttgctttacaagtgaaattgttatgtcattgccatttgttcattaccatctgtatcactctgtctgatttgcatgatctatgtattagcctgccctcacactgctgtaaagaactactggagactaatttataaagaaaagaggtttaatcagctcacagttttgttggatgtacaggcttctgcttctggggaggccttaggaaacttacaatcgtggcagaaggaaagggatcaggcacatcttcacatggctgggaagggaaagagagagtgggaggaggtactacacatgttttagcaagcagatcttgtgagaactctatcatgagacagcactagggagatggtgctaaaccattagaaaccacacccatgatccaaccacttcccaccaggccccacctccaacactgggaattaaaattcagcatgagatttgggtggggacacatagccaaagcatatcattctgcccctggctcctcccgaatctcatgtccttctcacatttcaaaacacgatcatgccctcccaaccatcccccaaagtcctaactaattccagcattaaccaaaagtccaggtccaaagtctcatctgagacaaggcaagtccctttcacctatgagcctgtaaaataaaaaacaagttagttaattccaacatacaatgggagtacaggcattgggtatatgcccccattccaaaaggaagaaattggccaaaacagagggcctataggccccatgcaagtctgaaacccagcagggtagtcattaaatcttaaagctgcaaaataatctcctttgcctctgtatctcacatccaggccacactgatgccaggcatggacttccaagctttgggcagctccactcttgtggctctgcagggctcagccctcatggctgctttcatagactggcatagagtgcctgcaacttttccaggtgcatgatgcaagctgttggtggatctactattctggggtctggaggaaggcagccctcctcttgcagctccactaggcagtaccccagtagggactctgtgtgggggctccaaccctacatttcccctctgcactaccctagtagaggttctccatgagggctttgcccctgcagcagacttctgtctggacatccagatgtttccatataatgtctgaaatctaggtggaagccctcaagcctcaacttttgacctttgtgcacctgcaggtttaacaccacatggaagccttgttggcttctggcttgcaccctctggagcagtggcctgagacttatctggacctttttagtcatggctagagctggagtggctgggatgcaaggagccatgacctgatgctgcccagcgcagtggtgtcctaggcctggcccacaaaagtatttttccctcctagacctcctggcctgtgatgggagagactgccacaaaggtctctgaagtgcattggaggcattttccctgttgtgttggctattaacgttcagctcctctttacttacacaaatttctgcagctggcttgaatttctcctcagaaaatgggtttttcttttctaccatgtctttcctgtcttcttatgagccctgcaaactgttctaacctctgcctgttacccagtttcaaagttgcttccacatttttgggtatctttatagcagtgccctgcttctcttataacagttcccttcccttccctcccctcccctcctctctccctccccctcccctcccctcccttcccttcccttttttattttgagacagagtcttgctctgttgcccagactggagtgcagtggcacgatcttggctcactgcgacctatgcctcctgagttcaaatgactctcctgcctcaccctcctaagtagctcagattataggcacacgccaccatgcctggctaatttttttttttttttttttttttttttgtatttttagtaaagacaagattttacagtgttggccaggctggtctcggactcctgacctcaggtgatccgactgcctcggctacccaaaatgctgggattacaaggtgtgagccactgcacccatcccctactttctgtattagtctgttcttgtactgctataaagaactacctgagactgagtaatttatacagaaatgaggttcaattggctcaaagttatgcaggctgtacaggcttctgcttctggggaggcctaaggaaatttaacaatcatggtggaaggtgaaggggtagcaggcacatctttacatggttgacaggagaatggttggggagatgctacacactttttaacaagcagatctggtaagaactctgtcatgagattgcactagggggacgttgctaaactattagaaactactcccatgatccagtcacctaccaccaggccccacgtccaaaattgtacaattcaacatgagatttgggtagggacacagagccaaactatatcaacctggcttccaaataacatggaccagttattcatagcctgatgagttatatatttaccatttattgtgaacaacaaatacctttctagatgttgtaatggactaatttttaaaatggactgttactgctaaagagtaatttttgaaaagttaaaagcatattgcatgcagacataaaatgaacgtatatcaaaggttcattcagttcagttaatgagggaattaactgagatgaattaaaggcaaatttgagaaactgaaaccacccccaggaatgctgaaataaatgtatcaatatgtaacaaaattggttaatatccatagagcaataaaatgtaatgtttggggttatcttttcttccaggtagatatcaatcatatctctaccggacaacatttatttacattgctatggacaagaattatttgtaattactgacagtgaaatggaaagttagtcaaaagtgcatagccttattgacttggatattctggaaacatacccaggaatctctttttcccatttctcagtcttggacagtttttctgatatttaaaaaaatgcttttggagcagttttattcattgaatactcacagtttcagactctgagataaatgctcttttaatttatgttaaagcctgaataataagaatatttatatatccaatatcttattttgttatcatgccccctgctccccaaagtgcagtattgaaaatgtatggttaaggttgtagcatcatttctgatctaagtatttcctctaatgactaaatggatagcactctctctgcttcttagtttttgttttgttttgttttgttttgttctgttttgtttttaagggagaggcagggcattgagtataagtaaatattttaaatgaaaaatagaacaatcaacagtatgaaaaattctaatattctgtgtacctatgcctaaaatgagatagcctatgaactgactcatcttaagaatttttatagaaaaatttgttagttctaattatgaatttaatagaatgagaattcatcatgtgacagccaaggtaatgaagaatgttttccaccactgtccaaacactgcccacagagaggcttcctttgtctcagggtgcctgtactgagattataaaccatgcaagagaacttagagagagggtctaataaacagacctcaccttataggtgaagaaccagaattccagaggagacaagttgaaaataataaaactcctttaaaaacaaaacaaacaaaaaacctgacttcagatttcttactaagtgatgtaagctgtttcctctaattatctaaaagaaggtggttttatccttactaaatatgtcagtggtaggtcttgatataagattttaacttaggttgctatcataagctctgtcttttggttgcaaaaaccaggtcactctcactcaacaaaagggttcaagatatagatctcctgagacctcaggttgggaactggcttcagtccagtacttgctttctgtggcagacttggcccatgatgattgtcctgagcttaagtgttcctcttgacctttcaccatgacatctaactggcaagttcctttagggtttcttgattctagttcctgcagcagcaaaactgattggctgagttcatcattttagcaagtaatcaaacccaagccctaggcttctggccagcttctgaatggctctctttgggtcaagtgttctttcgggtccaatcagctatggctgtgtgcttgtggagttgtgtcaggtgatataagatggcaatcgaaagacaactgggcctgagaatatggcagagtcccccagaaatgggagtgggtgaacagattccctgaaatatgtctactacaaatctggtttgaatatattagtttattcttggttaaaaacatttcctgttatctgcattgtaatttggttttatattttagtctgtttctatattggagtaaactcgaagttttttattagtccattttattcttatttgcttgctaaattttgcttcttttagaaacacagagacaggttttgagacttggaaagtttattatgatagcttggttttgacaattcatgttgacttttcttttgaagccataatgttccttcaaagtattttaaaaggaaattaagaaagtctcattgttctatgaattcctttaattttcaatagatatttattctccatatctaaaaagaatccaggttcaaaaggcaaggcatttagttttaaaaatatttattaaattgctggattatatactgtatatttgagatatgacataacccatgcttgtgggactttctgactattagggagagagtattactgttccagacagaggctgcttggactacagtagattaaacacagtgtagagaactatttttttttaagcattaacagttttagttagttaaactaaacatgttagtactactttagttaaacatgttggtagtggaataagactgtgtgaagacagttttaatggaaattgtattatgttctaatatagtgtggtggtaattacctaattcctaattcagattttactggatcatatttccattgttctttctaagccaggtgatgggaatggattaacagtgtggggagcaggatagaggaagggcattacagggaactgcaggagcaaatacctagcaatgaataactcttctgaggatgggtagtagtctagtcttgaaaataatgactagtgtggagaaaagggaacccctgtgcacttttggtgggaatgaaaattaatacaatcatcatggaaaccagtatggagatttgtcagaaaaccgaaaatagaattagcatacagttcagtaatctcacttctaaaaatgtatccaaagaaatttgatctgaatgtagaagagatatgtgcactcccatgtttattgtgtccttattcacaatagctcagatatggaaacaacctaggagtccattatcagatgaatggataaagaaaatatggcatatacacactatgcaatactattcaccctttaaaaagtaggggcaggatagagataattctgtcatttgcaacaacatggatgaacctggaggacattatgttactgcatgatctcacatatatgtagattcttgaaaagtcaaactcatagaagtagagggtagaatggtggttaccagaggctgggatgtttaaaggggagaaggggatggagagataaattggaggaataagttcaagaaatctactgtaaggaatgatgactgtaatattaataaataatgcatcatagatttcaaaattgctataagaataggttttacatgttttcactataaaaaataagtatgtgaggtgatagatgtgttagcctgatttaatctttccacattgtaaacatatatcaaaatacatcacattatactccataaatatatacaattatctgtcaaataaaaagaaaattaaaaaagaaaataatgaataaatatagaaagtaaaggtggtcttgacaataactgagaagaatgatttgatttaattggtaacacaaatataatatgattttactgggtgctaaccaatgtctgtcttatgtactgagaactcattaagcacagagataatgtggctcttgcccgcgaagaagctaggattaaataatgtagaagattattttggtatatctgtgggtaaggatttaaaaacaaacaaaactgctctcattttgtttggttttagtaatgctctactggaggcagggcattactgatgtggcccttgataacaagtcctgtgatgttaggaaattatttcttcaatttgtgaatttctcagtgagagttctaggaacctcagatactgctgggcaacctgcaaaggctaaaacagggattgagatttgtatttggggagggaggcataatttgaagatttaatttgaataaagtctttgtgtttaaaagatccttttttatatctcatacacactaattccaccagtaaaccaggaaaagtgtttgcgtctcatagacttgtttcaaagattcaaatgagttacctaaaaatttagaattgtgtctggcccctaccatggaagtggttgtgttggttgatgttgtgctttagctcggtgttatgactccctggtaccacatagaaatgtaaatactgatttacgtggtttttttctccttgctaaactgagctccttcagggaagctgctctttcatctctatataatcccaccttcatgctcaataaatgtttgccgaatgaagggataaagtacctcttcttttctgcagcattaagcaaaggcacttggtcactctttctgggaaggtgagaggagatgttgtttgttttgaggtcatgcttaaaactggtttagtttccagtcttttaccagttttgctttgttcccatgaacctatctcaccattgcctggagcatagttgctttcactctttatcatctttttttagtaactacttccttaagggcatgtggtatatttcttgggaatttttatgcctcattaaatccctgattcagctcccacatttttagtagattgcaatgtgtaagtctgttctttccttctaggtgaacctgttattctaaactcctctatgcaaatgcgttttacaggaaaagggaaaccggtttgagaggccagtttggaagttgctgaactcccagggtagttaatggatggtcttttttattttttgttttctcttacatctcagccagcagttttgagagaggagctctgtaacttgcccaagacaatcatgcttggctgtaaattgaggcaaaatttgaggaagggctttaccctttgcattactcttttaatctagaaaaggtaagaatatagtgtagtgaagggaagattaagtctttccttaagtgtagtggaaagtcctcccttgtgaagagagctaccagtgataccagctgctggcaggaagaagctttgagggtgactgcagcaagagacttgcaaccttcagtcaccaaagctagagaccatgcctggggctttttgacagcagcaggatcctgtgtgagagagagtaaaggttctcctccaagcagaagaaaggaagaaaaggttcagttaaactctgtttattgaaagttagatattaaaggaagaaaacactaacattgtataaaggaagaaaacacaaactttctactttagattttgtattctcttaagccaggctctaatttgcaaaacatgctgtttacaagtaagaatgagaaagttttcagtactttttactactctaataaaatgcagttttaatggagtgctcttcctggtctctctatattatttatttcttattacacaccatctttcccctgagaattgactactgaactctaataatagggtgtgggacagggctgccaaaaacgaagcatgcctgctgcaatttccacatcgtgtgtccatagcagacaatggcagttgatttgggcactgtctttcggtgttgcttcaggaaaccactgcctgttgatcaatcagattggccccagaatgaaaccactgccccccacaatctaagaggaagtaataagttttaaaagggttggccctataaatgtaaacttgtaaagtgggagcttgccaatgccttgcagaattttgtgaactttaatcttttctttccacaaccttggttcatatgcccattcctttttaccctctgaaccttctcttactccagtgtgttttccttgagaggaagtcaccagtagtaaacacataggagttcgagtattgctataccagaattattgaataggggaagagtaccttattctgtaccacactccccccaccaccagtattctgaatgtcattaggttaatgtctacaaagactcatgccgtactttgctccatcctaaattgaaagtttagagccacagccttttaagtataatttgggtaatttttttccttagatgatttgctgtgtatggcatgcattgttaacttgcttactcatagagtcccagaaagaactttttgcattgtatcttcatggcatatgtccactgaaaaatcaagcctgcagcttttactatgcattccatgtgctagatcccataaaaggaagatcaccagggtgctctcagaggctttagcagctatcctaaaaagagtccctctagaccttctcaagccactcactgacagaatacttactccatctcacaggaggaaggagtgtcaagatcctttacttgggaagatagcaaaagcaatttgaaactggaaaatagtgaatgaatcactagatgattttgattgaaaaacaaattcaagtatgttcatcattaaggcagagctgttatggtcaacacaatagcctaaaggtatccgacacgtaatttggaaccctttcccatttcctcaaagtttgaccttggacaaatttgcaaccttggacaagttacaacataacctctgttatgagcctaatgtcttcatctggttaagttggggattctaagcccttcaccctccaccctttacccaacacacacacatagggttcttgtggggttaagtgtaaaggcatatcatgatgtctgatgatcatttattgtcactgagatactactttgtgttcaccagtgaggatgtaggaagatctttttagctacatgtctttgatatattacatattgccttaaaaggtagatattttattttcttcctgtcaaatgccagaatggaaagtgccctttttcaactatgttcctattttggcccctgctttttgaaagtacttgtgatagaaattaaatattcatgcaggtgtggcatgccatttgaagatgacactgtcatgggttcttcaataattatctggtggtaatttgccctttgcatctgtggctatctctgagggacactgttcttctgagttctcccgttacagtgggaaagcacacagtgccataaaaccagttaacgtgtcagaaaattatcccttatgaaatttagtttcttttgaaacttctttgatgtacaaaaagataacgtgggcttactttacaagtgacaaaactatttcactttctggtaattcagaagacttctcaggtcctgaataacttgattcttttcctttaaatgatttatgggcagggacaaaacagcatattctgtatctaattataaggcttcattttcatgaatctctctctttttgttgatggcaaatctagccctgcattcaagctgtaaagaggaatagctttatttcacccactaactgtttacatcagacaccatattggtgatttgagactcagtattggtatctgtcaactggggatagcaaaacaggcttcataggaattggaagattaagcgagatcatgcattagtaatttcatctagcttctagcacagactagcttgtttactatctttataggtatttctgtacctatagaaagaaggccaccgtccctccccactcccttctctcccctctgctcctgccttctcccatcttattcccagaagtccattcctcctggacaacaggaaggcccttccccttctgtttctatcataaactgcttctctgtcctttggtctctggagaactggcagattgacctcatacaatcaactaatcagccaaaactttttcctcagacatgttaacatctttctgaaataataccactttgcagtcagccactacttgctcccctttccttaaagcattttatttttgtccagatacagggattcttagactcccagacagatccctaaataattatacctagcccaacaggcaaaactaatgtgtgctatttgaaggcagggcagtgttgactttttgggagagtggtgttcactttaagaaaatttattaagccacccaagatttctgggcttactaattttttaaaaaataggctttttcccctttctgcatgtaccctaattcatgtgtatattttacttacaaagggtcatatttcatttttagctgagaaagtctttcatgaaataaaacatggaagcatttttaagcctttagggtgatgtgggttagagttatttataagctgtttgatcatacacttatgtatgtggtctgtggttgttccacttaacttgctattgattgcattttggtaaaaatgaaaatttatcccagggtggtaattattatggtttgaaaaatacgctttcttgcttctttatcttttttatattgtcagttagcagttatttacctaaattgagaggagataatttataaaggtccatggttttaaaactcatgttataccatcagatgcatttggtgtgcagtttttttattggcattggatttgcatgcttgtttctgcttggcgttgtctaatagaagtgtactctgaataccatgacagccagaaattagttgggaattggtgaaataatgctttttttttcctatgtatacgtaacaagaagtgaataatagttaacttggattttagttttttttcttataagcagctcattgcacaaagaatgcactttaatttacttattacttcttctagattggaaagaagactgatgaagaaaaataacagcatgattcaggtaaactgatttttaaattatttaccttttatgcttaatttgtattttctgtgttctcccaatgagaggatctaaacaaacaatttttgtgggcaattggaatatataaggaatatcttggggatatagatgaaatagtcaaatacatattaccatttaattaatttagttatgtacatattttgaacaagtatgtatttatacaaaatgggatattataactaatgcttttttcctaccccagaataattttcttccaactctttacatacatatctgacatcagtgtcttcattatttgagtcacattttttaagcattcaatattattttccacagcctgttatcattttaggtgtttgcagtacagcacttttggagtctatgtatggcactctatttggaaattttatcccaagccacaagtaatcatttgcataatgttaggacagttgctgttttcattctttctgtgtagatgaacattgaagatctctactgtgtaacaatttgtagaactgctttcttaagtctttctcccttcctccctcctttccttccttccttctttcctttcatttatttattttatttgtttagaggtaattgcatgtatattgtttaagaattcaaatagtactctaatagccattctttgttctttttatactcttattgcccctttgcctaaagatagcccttttcaatccttttagttgtattttccagtatttgtctacctatttctaaacaacacatcatatgctctaagtgccatttactgattccttttaaaatcttagacttatgcattgatttcctgccggggagttctctctcatagaccaccctttacccttactacatacctacttttcctgtctctttattttcttgatgcagtcattgttacagtctatatttagataagtattaatgtctactttattattttttttgtggctgagctctgtgatataagttgagatgtctcaagtcattctgcctccaagttggttgtttgtgaactgttttttttttgtctctggaaaatgtttcatgcttttctttatgcccagaattctgcagtttcatattgggacactttttgttgtttttgtcctctcagcttggaaactgatgtctctcaatttgtaaattttcttgtactatttctttgataatttcccccccattctctcttttcttagtctgttagttgggtattttcacctactagtttgatctctaattttcttaagtcttactcttagctattttccatctttctgtgtttttcttcaactttctgagaggttttcttagtatcaattgaatttttaatttctgctagcaggtttgtaattttgaacttaatttttgagggtctatggatattttgtttttaaaattaggatcctgtttttgtttgatagatgcaatattttctcatttttttttgagaatatgaattgaattattttgctgttttttgctgttctttgcacattttcctgtgtgttccctttatcttcttgttttgatccctgattttaatgttaaaggctcttcccaaatgagtgctggggatttagttgtctgttcatacttaagagtgagacaatacaaaatggaccgcaaatttgttacgtggttggcttcactctaaggtctttgggcagagaccttactggccatttcagtgggtgattatcatgtatcaaaatctgcagatttttttccttggacctttcagtttctccaaaatggaattctttgtttactttttttgtggagtgtaagcctacctatgaggattaaggggcaccacagaggagtgaggaggaagggagccagagatctcaccatccaagcctgagaatgcctagatccaatgctttcgtttcagccttatctggagtctaggtttgaagtgttgctgtatcattttctccagagggcaaactgccccttcttataggagtagggatggtttgtttggctctaccaggtgagggagaggatctggggttctaactccctccctctctcccttcttccctccctcctccccttctttgttccacacaaatttatcatcttacagttttgtgggtcagaagactgatgcaggtctcactgggctaaaatcaacgggccaggcgcagtggctcatgcctgtaaacacagcactttgggaggccaaggcgggcaaatcacttgaagtcaggagttcaagaccagcctggccaacatggcgaaaccccgtctctaccaaaaaatacaaaaattagccagatgtggtggtggatgcctgtagtcccagctactcaggaggctgaggcatgagaatcatttgaaccctggaggcagaggttgcagtgagcagggattgtgccactgcactccagcctgggcgacagagagaccctgtagcaaaacaaaacaggtgtccacaggctgcactcttttccagaggctctgggggagagtacctttccttgttcttattttttagcttctagctgctggctgcatttcttggctcctggcccttttccatctttaaagtcagcagtggtcaaatggtctcacattgcattactctgacttccttttctgtctaccacttccacttttaaggaccctggtaattacattaggcccattcagataatccaggataatctcttgtttgtttttattgtggtaaaaaacacataatataaaatataaccattttaagtgtacagtagtgttaactatgtacacattgttgtgcaaaagctctctagaacattttatgttgcaaaactgaaactctatacccattgaacagcaacactcctttatcctgcctgcccagcctctggcaactacgaaccaccttacgaaccaccttctgtttctgtaaatgtggctactttaaatacctcatataagtggaatcatgtaatatttgtctttttgtgactgacttgttttactttgcataatgtcctcagggttcatccatgttgcagtatataagaagatttccttctttttaaggttgaataatattccattgtatgtatataccatgttttctttattcatctgccattggatgtgtgggttgcgtccacctcttaactattgtgagtagtgcttaagtgaacaggggtctgcaaatatcttttcaagaccctgctttcaattctttcagatgcataccagaagtgagcttactggatcatatagtagttctattcttaatgttttcaggaactgccagactttattccatagtggatgtacgatttgacattcccaccaacagtgtaccaatattccgatcaacttctccacatctttgccaacacttgctattttctatttttgtttttgatagtggtcattctaatgggtgtgagatgatatctcattgtggttttgatttgcattttcctgatgattagggatgttaagcatcttttcatgtacttattgaccatttgtatatcttctttggagaaatgtccattcaagtcctttgccaatttttaattattatttagctttttgttgttgaattgtgggcattctttatatattctggatattaacactttgtcagatatatggtttacaaatattttctgtgggttgccctttcacttggttgattacttcctttagtttttaagtttgatgtagtcccatttgcttattttgtgtttcctttttacctgtgtttttgatgtaatatccaaaaaatcattgccaactccaatgtcatgaagcatttcctctatgtatttttttttctttttgctaggaattttatagtttcaggtcttaattttaggtgtttagtccatcttgagttaactttaatttatggtgtggggtaagggtctttttttttaatacacacttcaccacccccatcttttcagtcttccccactccccttctgaggaaccagaagctccatcatttcctaagcatttctgtcacagtcagctggctttttgcttcacaggcagggaggttcccaccggctctgctcgactccacagtcatctccgctttccagacatcagtgatgcctattgtttgctctaatatagttttctattctttttgtccttatggatttatatcttttttcgtttttactaacattttgatgggcatttagaaggaagcagagataaataggcctattccattggccatctataacccccaaatctgtattgctctttaaaataatatttaaaaggactttataaaatggtttctcatatttcctattgtgacatccaacctctagaaataattgtttctatttctttgcttccttcttgttagccagtttctgtcaagtgacccataagcatcgaaagctagcattaagtgtacttgttacattatttcattattcaaaatagactgagattattgtctgtaatatgagacctggtaaggttttgaatttaagatgatactctctttcctgaggtataatcttttttaagcttttgactttatctttgggtttataaaccatatgttggtattaggagatggtgcccttttatataaatatattttacttcaaagctttattaattttctttttgagacagggtctcactctggcacccaggctggagtgcagtgacacaatcagctcactgcagcctcaacctcctgggctcaagtgattctcctgcctcatcctcccaagtagctgagaatacaggcacacaccactgtgcattgttatttttttttctttttgtagatatgaggtctcgttttgttgcctaggctagtgctgcaattataggcatgagccaccatgcccggcctgaaactttaattgaatacttttaagctaatgtaatggcaaaagagtcctagtttttgtttgttttattttattgctgtttcagttgataactgctttctttgtacctatgtttgattatttacagatgtagcaccatttcttacagatagaataaagtatgattaaaagttgggagggtacggagggatgcctggtcctaagtaagtccttgggactattgagagtagtggattgttttgttctataagaattgtttctttatagaattaagcctgttagttggctcaaggtatcagctctccggcttgacagctggagagcacctatgatttttatcctggggtccagggatagctttaaggagttaacgattgtcctgagatttaagtggggagggatagaacaggcttagttttcatcagatactcaatactgcagggcttatatgatcctgaaaagggttgagagcctacttcttatagattatcacaggaaaaaaaagaaaatgttactgatgaaattaaatatgatcgaactaaaatatactacctttctgactaccattagattctatattctttcacatataagtacaaattactacaaatgaggcactaaatgaacagccctctttgttctttaatacaagacattatctctagcttcctgattatgctaccaggaaatgtgtaccatttacacatatataactataaaagctgttacttatgagggtaatgttttggccccagagagatcatgacacttttataaatcagcttgtaaaaatgataactcagtagttacctttgttttcagtttgaagctgaaacttcaaacttatacttaatttatgataatcagttatttgttggcaactaaaaatagtagataaatatataaaaggagaaacaccttttatagttataggcctaagacttaacttttaattagaaaagatggagtaagctttatattatatgtatatattatactactgtaaaaaatacaacaattaaaaagctagaaaagaaagaaaaaatgggaggaggtaaggaaggttcattgtgaattctttgtttccaagtttataagtactttaatccttttatttatagtgagctggactgaatttacacaatctctctcagctttagaattttgtgattccgttttgaagtgcttaaactgaaactgcttctctgtcccaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtatgtattgacggagaacttggattgaacctgatgtggcccactctgctctactcagtcaagtggagtcattctctgggaatgagctcttgtcttgaatcccactgttcataggacagaactctcaggcctgaaatacctggtgtctgtctttctgtaaccttgactgtgtggtgggatatcactcgtcactctttgatgaactctgattcagacccttgagtgtccttcccaatgcctcaaggacattagactcttgtcacatgaaagtgatagcaaatttctagctaaagacctcattgccttctttcctgggagtagagcagtcaatgtcaaagctcagcaaatgtgtctcataaaccagctgttactggctttacttttccctgaacatcatcaaggccatttctgattggatgtggttgtatcagattgaccagttccctcttagtcatttactttgacctgcttgtctctttgacccctattaaatgtttacctcattttcttgtttttttagcctttaatttttatctcctcaacaatgtatcatcaagatcaggggcacccattatttcatatcctgtgacctttggtggatgtctggctttggatgcactggctctctttgtaaggcacagcctgtgttattgtcatatgtcaccgtgatcctttaggatttttgtagtctttttttttttccatctaccaatgaagaacactacaaatgtaccttgtgctgagtaatttatgtgtctttgtcacaccatcatgaaagcattaagcaagtcccattttgcagatgaggaaataaggttccaagtggttaaacaacttgcctgctattcccagagagtaagtggcaggaatgggattcagcactgagtctgtcttgaattgtgtaccatagaaatagtatgccctgctgtattccctttttgaagcagagttttaaaaatattcttattcagctgggcgtggtggctcacgcctgtaatcccagcactttgggagaccaaggcgggcagatcacctgaggtcaggagtttgagaccagcctggccaacatggtgaaaccccctctctactaaaaatacaaaaattagccgggcatggtggcgggtgcctgtagtcccagctacttgggaggctgaggcaggagaatcacttgaacccgggaggcggaggttgcagtgagctgagatcttgccactgcactccagcctgggcaacaagagtgaaactccgtctaaaaaaaaaattcttattcttgtggaattttagtcttctctacttttttcagcttttgctactttccccccattttgtggcattttatttggtttataattataacacttaatttgaaccattaaaaataagtattttcaacttttattatttttataatatcactgagaatatattattggtatgagacattattaaaatatgccctctttctcacataggctctgatgtcttcactgattctgttttctgagttgattatgagtctagcatgggagacgggagtggacttttatatttctaatatggtcctactagtacagagttattgaagatgacatagaagaatgataagattttgccagaaatattcttccatagttcacaaagttgttttagaacctgaattctttaaaatatagaacatctattcaagtacttagttttggctcagtgaccactttcaatgtgtatagccaggaagttgcactatatagaaggatataggttttaagtttaagtaagtttaagagtatatgttatctgatttttttcaataaggggctaaataatttgaaatttctatatatttaggcttctagaatgttctcattaaattagtagatgtacatactgaaaaatattttaaatcaccgtaaaaatcctgagagatagatgtggtcaacctcactgaaagatgaatacactgaggtttataatattgtgaaacttacccaagctcatgtgattacagaatagagccggccggaagcggtggctcatgcctgcaatcccagcactttgggaggctgagacgggcagatcacgaggtcaggagattgagaccatcatggctaacacggtgaaaccccgtctctactaaaaatacaaaaaaaaaattagccggtcatggtggcaggcgcctgtagtcccagctactcgggaggctgaggcaggagaatggcgtgaacccgggaggcggagcttgcagtgagccgagattgtgccactgcactccagcctgggcgacggagcgagactccacctcaaacaaaaaaaaaaaaaaaaaaaaaaaaaaaaaagagagaaaaagaaaatagcagagccagaattgaacttagatctatttttcaccagcaatgtttctaacaattacattgccttgctgattatacacagtgatgacatttagatcataaacatgtctaagaattttcttatgtttagcattcaaacaagggccgtcctaaacagctaaataagcctcatcctcacagaagcgaaagcttctagatgggcttggtgttgttcatcaacgaggttttatcaggatagtggcaattctggtgaatgacggactgagcccctcttgagaactggatgtgtctgcttgggctgcatgccatttcccacccagtgcttaccatgctgctagcagcaattagggtcgactcaccttagcagttgcatgagcagctgtttcttccaaagcaagttgggactggaatttggccatataatcacacagttaaggacagctctggcatttatatatgaatctcagaattttaggtacaccatttcttttccgtaaataaaatttctttctgcttttaagtgtcttttcctgattctacatagaaaatttgatgaatatttacagccataaaaaagaatgaaatcatgtcctttgcagtaacatggatgcacctggagaccattattttaagcgaactaatacaggaacagaaaaccaaaaagcacacgttctcacttatacgtggtagctaaacattgactacataaagatgggaacgatagacagtggggaatgcttgagagagagggtgggggaggcatggattggaagactaactgttgggtactgtgcttactaccttggtgatgggatccttcgtacaccaagcctcagcaacacacaacctacccgtgtaacaaacctgcacatatatctcctgaacctaagataaaagtagaaaagaagaaaaatgtaaaaaacatttgcttaagtaagaacaaaaaggaaaaaaagaaaatttggtaaatattgaaaagtttaaacaacaaaataaagattaccacttagatatagccattgataatattttggtaaagatgcttccagtttttattcctatgaagatgtatgccttttttaaaatgcaaacttaaaatcttagtgttttatatccatttttacttagcataattgcaacatttttcctatgtgcttaaatgttcttttgcaacatacttttagtggctataagtattccctttgggtaatagcgtcagtgaatccattctattagtgaacctaatcctcattcaatttagttaaaacctctctaaaaaacaagaacataattgccactagttttcataatgatatcctaatgatgctttcagatatgatgagaaaatccagtttcagtcacttcccctgtcacatcatgcaatgaacctgacttgaagtttcccagtacaagcgctgtgcatgactgtagcatgggaaaattctcttttgactgggaaactttgaaaacccatttttctttctttgaggtggcttgtctgtgacaagtaacttcagtgttttcatacttagatgaaacttctcaaatcctgatttgcaggtgatttggctctcctagttggctttactacttaactaaaccttttttcttctcctaaatatttcacatgggccaaaccctgggtcagcagctactacctgaggaaaccccaggtgtcatgaatgaggttggagagacatgcataatgtagtattaatgtgacttttcctgaaaccaaagagttctgtgctcctaggtattaaagttatcaaactgagaagttgattacagctgaaatgggtgaacatgtaacagaagcactctactcagaaaaggctcctgtgaagctaggactatgacttattattacttcttgttctcttaaagactatattaagttaaatcactatgatcctcaccaaaccattacttttcagacatggttccttatttcccttgggattccatagtgtcatgtgagtaggtaaggggtgagggaggacaaagcctccttattatcaataattgtccttattgacaataaggaggacctccttattgtcccatcaaccagcagctctgcctttatatgttttatgtattgaatttccacaaatttttgctgaaagaaaggactactgcttaagggagtaaagactgtgaaaatcactggggcattgtagatcctatgggtggatgtaaaagagatggaaaatggacacccagacagtattacttccaagtttccattatgcttgtaattctcctgcagtgacacagtccttcttgggtttgatatttaccataggtcctctggttggacttcccatagattagcctgcttttatgatagtggtttccatagaggcacctcagaaatgttagggttaggagagatgaaagagtgatagccttacaagcattggtggtagaaagtaaccttctagtgatcagagcagtgagtggtggaaggtataacctgttaaaggccaacaggagactggtttctatattctcgttcatgtggattacccagtaggaagatgctctttccatcagagtgatgtggtgtatgaaattcagccagacagtctgtgaaatcttcattatctatttctagactcatttaaaacattttcggtgggctctcttaaattgaagatttatattggtgaatcacagaaccagctactccgaataaaagattttagtggtttttgttccacagctcagttgactgactagagaattttctccaaagatatttttaaccagcaaagaatgaggaactaactaaagagtttgcaatggctaatttacaattggtgcccagaatccttaaccacagttaaaaatcttagctttatttaccagacagttggtgcaggggtatcaatgtatgaagaccttaatgttaatatacatttagttattcagagaatgagcttagtcttgaggtgaaaactggagagaaaattcttgctttctccatcaggaaaggggtaaattatgaccaatttgcaaacataacaggatatattggtgtcaaatagggcctgagctgtttgtatatgaactgtgtatatggctacaactgttggggtgacattcaacaagatgtgagtaaatgacacccctggaattgtgcagtgctgcagccctgggtatagccattcattctgttagtcatttatctagtgaatatctctacctcatgcctggcactttcctagatactagaacacaatagtgagcagggcaaacaaacaagatcatttctctcatggaacttacagtccaaaaggggttgggcagggtcttcagggagacaagtaataaagagggaggtaaacaatatttcaaatatgctaaaaagaaaatagagcatgagtgtttttgggtaggaaagactattttagatcaagtctaaaatgcatgacctatgttcttgttggctgtttacttcttgtactgcatataagttggtgaatttttatattcaccagctctcattaaataattcagagaaaaggtaggatttcctccatcaaaattgtgttttctatagcaattaagctttatcaagtgccacatttcagtggtaaaaactaagacagcttcatttcttaggtagtttaagtagaattgtaaaataataataaattgctggactgtagcatataaaaagaagtttccagttaattcaggggaaaattgtgatatattgctcataaaagttgaagagagagaagttggactgattaccttaagcatcttagactcattgtgacccatgttgaatggatcactaagcctcactgattcttttttcccccattttttcccctttatatatataatgtcctttttctctgtttctttttgtcccttttcactactctatcaccactctagtgaggtcctttttaccacaggctagtctattttaatagcttttcccttgatatctctgcatctggtctagctgattagttagtttttctgatgctacattcatagttctattcccttcttaaaagcctttactttactctccactcacttgagagtgataaaggccagactctttagctcgacatgtgaggccccccatgatctgtccccattgtgtatttctaaccatatccctgcttttacccagtgcaaactttaggctctacccagactctctattcccctttctgttgtgcttttggtcaagctgctatctggaaaactcatttctttctttctttcttttttttttttttttttttttgcctatgtaaattaatgttgaaagtctagtatgaatagatcatctcttctttctttctggctgctttaaagattttgctttgtttttaggagtctgtgatttgtttatatctaagtggggaaactccttctctcccaacttttccctccctctttttctccctttctcccttccttccttccttcctccctccctccctccctccctccctcctctcccctccctccctcccttcctccctccctccttcctctcccctccctccctcccttcctcccttccttccttccttccttctccctctgtctctccctgagaatctttgggttttctgggcctaaatattgctattaggaatattttatcgttatttcttagaataatgcctcttccccattttctttatcatttctttctggaaatcgaagaacacatgttggactttttcactcattttccacatccttctttcatatttttgatatcatcttctttatgttaaaattctggacagtttctttggatttgtcacttggttccccagttctttcttcagctatttctaatctgctgtttaagccgtccttgatgacagggatttttatatttttaaattttattttattttattttattttttatcctacagttttatccccagagcctagaccaaggtgtaatacttagtacataggtgcttaataaatatatgttgaatgaattcacatgagttttttatcttttaatttttaaataccatttttgccacttttcaagtcaacatggtagttttttcagataaaattttactcccttttaaatttctcttattgaaatatattaaatatacttattttatgctgataattctagtattcgaaatattttcagatctgattcatttgcctgtttctgttggctctcactgatggtctcttatttccctgtatttctgtgatttattgactgtgaactcattttccttggaagttttatctgtgtgagctgttcaaggcctagattgaaggtagatttttccagagagtatttatatttgcttctcccaggtgcctgtagccactatcaatctggacactctttacattatattctctgcctcaggttttttgaagcatatagcataaatttagaccacaaaacaacataaatactggttgttggttatgaattctcaagggagattttccaccccctgaagatgctacggttaaaaaagcagttcctcttttggtgtagcaagtttatttctaatttgcccatatactgagggtatagttttgtgaagttccagttttacgcaggggtctgttaaactcaccagcttgagtggtcctggttttatcttttctctctcttgctctgtacaatcattataatggaaattcagtattactagggttgtggccttggtgcttttctacctcccagcattctcactcttactttgtttggcttctgtgaatgtcctactttattgtcacctcattggcgcatttacagagattttatacttcattatgcttcaattattttcattaagagagaccagtttaaggtatctagtgtatcattcttcaaaaatagacctattttgttgttttgttttagtatgtgcttctaatagatgaggtggatactcatttacgacagaactcaaaaaattattaaaaacttaggtacagcgcagtctcctcttttaatttaaatgtctgctatacacagtcagattaggtgaagagtgaggtggagaataaccccttgtaatgtgctctctaagttggctgagactttgatgtcttggagatattatttatcaaaatgagatttatttttgtccatttgattgtctagcattttattatatgtatttatagattaattttctaatattttactatatgtactatgtatattttacccttctaagtaggatttgattcctaagtaatgctctatgactgagaaataacaaataataaggaaatattatttgttacatgatatctgccatgggtccatttaatgataccctgagagagactctgtagtaccttagtccttttactcagtgttatttcatttgattctgaatgagtgtaatattatttgtaagggcaaatagttgcaattagtagaatatgttagtgatttcaaaaaaagaaactagtctcaagaagatatttttaatgttatggcttaaatgtgcagtgtgcagatctgcagttcagctgactctgtaattcttcagcactaaataggggtatatctagtgagaagcattgccatttgatagaaatatgtaacacatatgtgtgccactcacctgaatgaatcacatgctgttatgaactttagttttttttcttcagaatcccatgttatattaattctgcagaggtgggtctgctgctcgtgttgctgatataatgcaagtagtcctctctgaccaagccctcagtctgcattgccacattagaacctaatttccttgaaccagcaatatattttgtgtgacttaagctgatgaataatttttagcatgtattatggtattaaggaaatattaaatggaataaatgttgatttaaattggtagaatgctcaagttttaatgatcagagtagggataatggttgcctggtacagttatgtgttttgaagtttttgaaagttagtagtgtgttttaaatctctgccatgagaggaaccagaaacataacacggtaaacatgccaactggattcatagcatcacttgtcagccacatgctaacataagactacattatgattagaaattttaaaattaatatttggagggcttagaaagctatatttattatgattgttaagtagctgtgtttggaagttttaattttttaaaatgtgtaagcttgacagatctccacatttagccattaaaaatcattttttaataattataatgtttacttcatattggaaatagtttctaaggaggaaaatagtttgcatctcatgttataaatattttcagacttaaaattacttaatccaaagcatccactatttgttattttttgttcaaattttagaatgtaaatataaattctcctagagttttctttttcttttaacagttgtttgtatttttaatgtaatgagtatatttctgaatattatatcaatgatatttttaataaattgaataaatttaagttgataaggaaagtttatcaaactaataattttaaaaggtttattaggaaattattaaaatgaagaaagctttcttgatgtggataagtctttttctcttttttgtactgggttttttaatcttgggtcacttgataatttttttatatcacatttaaaaatgtgttggatatttttatattaacttcctatatttatttcttcctgaactattttgggaaagaaaccataattgaaacacaaattaggtaactaatagcttatttatggaatctttttcttctaaaatgtttccttggaaaatattaattattagtatactcacttatagactcccatacagtcagaaaagcagttgtcaagaaaaatatttgaaggcatgattattgtcccagcattctcacattctattccctttccctctgttaaagtgagtaaatcaaagaaaaataaaattgactttcttgtctgtttcagttattgggcccagttagggatggctaaccaggggtgaagggcacataaataacatccacttgtaatccttaatctgctttcacactcactcctctcttccactttgtttcctgtaaagtataaatttcttagtctcatcatatagaataacccagaatgatatgatttcactaccatggatttatagaaattatttcttcttccacatttttgttgctgaatcaactgtcttgtgtcatctctgacactgttattctcattattaaaaaaaattctattaatggtttcatatagtcttttctctaaagataatattaactaagtgccttttatattctaaggtctttatttacataatcttgaatgaagccctggaatcttgcagggaccttcattatcttacttcattctgtggatttttagtgacactttcattttctaggccctcctttagacattttaggcagtgagcaaaattgacaagtagaaaaaaaaagaacaaccaacacgtgtattatggagctaatagtctagtgggagaaagatgacaaactagatgaataaggaaaatacatgtatgctaagtggtgatcagggttatcactgataacctgttggatcagaggctatggcaaaaaataaagaagagaagtggatggggagtgtaagtctaattggggcatgtgtgtacacacacacacacacacacacacgtgcacacactatttgtagagaagccaggaaggcctcattgagaaggcaacatctaagtaaggacatgaagaaagtggaggggtgagcctgctgtatcggggcaagaccatcctaggaaagagtagttcagggttaagtacagagcccttgatactttttttattttgcaggaaagtggagctcagccttgtctaagactacatagttcataagcactggacctcttgttcagactcagatctgtcataatcaaagccctgcactccctccaccaccccaggttactctaaaaggaaatcattgttcatcttaggaagctttccaattcctagcagaatgtgttatacattgtgaacactgaggatttaaccatatctgttctcaagcaaaaataatacataggcaggtaggtagatggattagttttctgtgctcaactaacggaacctcaaaattattacctggttttccagagctcttaagtttaagaaataaattttaagagctacactttctgctttttattttctttctctttttaaaacatattgcttgctttaaaaattcctctgttctcattttatatgtgagatttaaagacctaaaaaaatttcaataggtatgtagtggtatgtcatgttgtcttaatttgcgtttccctgatgatatattatgtggagcccttttcatgtgcttatttttatccataagtcttctttggtgatttctccattaaggtcttcagcccatttttaaatcaagttaattgttttcttattgttaagttttaagagttctttgaatattttggataacaagtctttatcagtatgtcttttgcaaatattttctcctagtgtgtatatgtcttttcattcttttattttttttttttttttggcggagtttcactcttgttgctcaggctggagtacaatggcaccatgttggctcaccacaacctccgcctcccgggttcaaatgattctcctgcctcagcctcctgagtagctgagattacaggcatgcgccaccacgcccggctaattttatatttttagtagagatggggtttctccatgttggtcaggctggtctcgaactcccgacctcaggtgattcacccacctcagcctcccaaagtgctgggattacaggagtgagtcaccgtgcctggcctgtctttcattcttatttccctttttcacaatcattctctagtgtgcaatagagttttccagaggctgtatatggtatcacaatagattgactgcagacattaataagggaatttgtgattttctcttaagccagatattaaagaaaaatgttaaaaaatatactcttcttatattgttttagaagataaatttttcattaatttttttttgagacaaggtcttgctctgttgcccaggctcaagtgcagtggagccatcacagctcactacagcctccatccacctcttgggcccaagtgatcctcctgcctcagcttcccaaacagctgaatatacagtggtggggacaaaagtaggctcaggagaaaatgaaagagaaagaatttgtttcacagtttggattcctgagactgtgaattgatccatcccatctcttcattttgagggagtcactacagttcctgactagccttcagattactttgcactggaacctatcccagttgaaccagctgtggaatttgggggtgaagggtgtgaggaagtggtataggacaagttgcctagtctcctttgctgcacatgggattattttctttaaaatgactatggacaagagatctattgtacttcatgatgactccagtaaataaccatgtattatatgcttgaaaattgataaaagagtagatttgaagtattcttaccacaaaacaggatgtgtgaggtaatgcatatgttagttagttccatttagctattccacaatgtatatgtatttcaaaacatgttatacatgataaacatgtacaatttttatttgtcaattaagaataatttaaaaagaagcagaaacaatatgggttatatttttgagctaagaaatatgtttacattgagatagttgataaaataatttttttcttaaaattattgtttccttcagaaggaataactgactttattttgtttacttcttacataatatttatcagtattaagtgttacaattttaaagaggaaagaaatgatacattttccccaagtaaggtttttaccaatttatattcaagaacacttatttatactttaaggtaattatttatgtatatctcttccactagacttagaagtccttaacagcagggtgtaaaatttaattttcatttctctagtgactatcatcttacctggattatagtaggaatttagtattttagaatgaataagacattagaaaatttggatttgtgttttatagtttattttctttttgagtctctctcccttgaattgttaaaagtaacctttaaattgttaatgtggtaagtaaaattaaataaaatctaaatgacagattgcttttaattctccttggttggaacaaatgttcaaagactatttagataggaagcagacaatagtttgttttcctttgctttgattgggtatatatttcaaaaatgacatgtgtaaattaaacacacacaccttctatttttgaggctttagaagttgttccccaagataagaaagaaacacttttgacctgtgagagaccatatctcctccagaactcattcaaataagttattttgtgatttattttaaaatttaggtataatttatacaatgtacaaatttgaagtgaatagtgaaccaacatctctatcatcccaaaaagttctcttgtgtccactttcagtcaggtgtgccatcccagaggcaaacacgtgtgcgagtgtgattctatcagtagattttgcctctttcagaacttcagatatgtagttatactgagtgtgcttatgctcctggtgtcttttgctccacttgctggtggtttatagattcatactcttactgcatgtatcatgctattgagtagtattctattgcatgaagttattcacctattgatagacatttggatggtctacagtttttggctgttatgaatataactactgtgaacattattgtatgtctttttgtgtatcgggggaaaccagcccctgatattcgatatgggtccttttctattttccctaagtgttggcctgtttgagaaatacagggaaagaatacaaaagggagaaattttaaagctgggtgtctgggggagacatcacatgttggcaggttctgtgatgcccagcaagccgcaaaaccagcaagtttttattagtgattttcaaaaagggagggagtgtatgaatagggtgtgggtcacagagatcacatgcttcacaaggtaataaaatgtcacaaggcaaatggaggcagggtgagatcagaggaccggggcaaaattaaaattgctaatgaagtttcgggcacgcattgtcattgataacatcttaccaggaggcagggtttgagagcagacaaccggtctgaccaaaattgattaggtgggaatttcctcatcctaataagcctgggagcactaggggagatgggggcttatctcttcccttatctacaatcgtaaaagacagacattcccaaagcagccatttcagaggcctccccttagaaatgcattctctttctcaggggtgttccttgctgagaaagagaattcagtgatatttctcctatttgcttttgaaagaagagaaatatggctctgttccacccagcccacaggcagccagcctttaaggttatctcccttgttccctgaacatcgctgttatcctgttcttttttcaaggtgcccagatttcatattgtttaaacaatttgtacagttaacacaatcatcacagggtcctgaggtgacattcatcctcagtttacgaagatgacgggattaagagattaaagtaaagacaggcgtaggaaatcactagagtattgattggggaagtgataagtgtccatgaaatcttcacaatttatgttcagagattgcagtaaagacaggcgtaagaaattataaaagtattaatttggggaactaataaatgtccatgaaatcttcataatttatgttcttctgccatggcttcagccagtccctccatttggggtccctgacttcccgcaacatttgtggacacaagttcgcaagttttcatgtcttttgagtgtgttcttagaagtatattattgggtaagtgtatatttaatcttataaaaaatttacttaaaaattgtcaaacatttttctaaagggctttataattcagtatgcccatcagcaacttatgagatgctctgatgtactccaagtctttgccaactcttgcttttttcagtatttttaaaattagcattccagtgcaggtaaagtggtatcttgtagattcctgttgtttccttggtgactaatgatgttgaaaattttttcatgtacttattggccattcatgtgtcctcttttatgaagtatcttgtcaaatcttttactattttaacaattgggttgtgtgacttttcaaaaattaaattatggtggttctttatatattctggatacgtgtctttggtcagatacatgtatggtgaattttttccagttggtggttgccttttcattttcttaactttgtctttcaaaaagcagttttgatattgatgaagtccaactagctagtttttcttttattggtagtattttgtctacctcatcattgcaaagccattgttctacgttttcctaaaatactttatagttttagcttttataattagttgtatgacctctctcaaagtatttttttttaataaatggggtcttcttgtgttgcccaggatggatatgaactcctgggctcaagtgatcctcttacctcggcctcttgagtagttgtgattacaggtgcacgcaaccactctcagctctaagtaatttttgttattagtgtgaggtaggagtcaggattcatttttctttccctatgaatatttatttgtttctgctcaatttgttgaaaaaattatccttacacccactgaattattttgacatcttggtcagaaaatctgttggtcgtatatgtgtgtgtctatttgtgatctctgttttgatccattgttctattcatctgtccttatgccagcactgtattttgttgagaatttctccatgtatgttttatgagggatataagtctgtagtcttcttttattatgtttgtctggtttttgtattgagtttctactggtatatccttttattacatgtttatctgtgactttgtatttaaaatgcatctatttaggtaccatatagttcagtatcattttttaatgtattctggtgatttctgccttttaattaaatgtttagtctatttacatttactgtatattgacatgttagttttagatctaccattttaaaacttgtttcctatatgtcttatcctttagacttttaaaaaattctgtgtctctgtttattgaatatttttagtataacatttacatttctctcaggttttctttgcactactgttttgtagttactctgcagatcacaatattcacccttagtaaaaaattttccttgaattaatatggtattgcttcatgtaaaatataagaaacctacaataatatggtttcatttgcctctccccatctgttgtgctattgtctttgtacattttatatctatatatgtcacaaactatataatacaatattatacttttaatatagtatgtattagtcatatatgttttaaataaattaagaaaaaaagtcttttatgttaacatacaatgtattatttccaaggttcctcattcctttctatgggtttacatctatatctggtatcattttgctttagcttgaagagcttccttcagcatttcttatagtgtgggtttactggcaacaaatctctcattttcatttgtgtgaaaatgtctttattttttaaaagatttttttgttgtatatagaattctaggtgggcattcagtcttttttttctccttctctttagatgttgattattgttttctggatgcctgtttcgaatgagatgtctgccatcattcctcttcttcttctcatatgttgtctttttttctctggctacttagaaacttttttgttgttgttgttatttttggttttcatggttagtgttctagcagacaaaaaccacaaactttggctcaaatagaagaactgtgtttaaaattgagccccgtcacttagtaagtaggttaacttaggcatgtcactgtatttttctgaacttcaggcttttctttggaaaacagggatgccttatctacattagggttgttgcaaaagtcaaagcatctaagtgctagtctagctattatttgttctctccagctgagagagctgattgactgacttttcctatatacatttatggaaaagtaaatattctaaacttatgagataaacatggcttgttttctattttgaaatttttgctcatagaacactaaggaaaccattcttattaagtgcagtttgaatagtaaagcaggaagctcaaattatctgcattaaaataggcacaggcaaagatttcatgaagaagatgccaaaagtagtctcatcaaaagcaaaaattgacaaatgggatctaattaaactaaagagcttctgcacagttaaagaaactatcagcagagtaaacagataacctaaataataggagaaaatttttgcaagctatacatttgacaaaggtctaatatccagaatctataaggaacttatacaaattaaacaaacccagccatctcattactgggtatatacccaaaggaatataaattgttctattacaaagacacatgcacaggtatgttcattgcagcagtattcacaatagcaaagacatggaatccacctaaatgcccatcagtgatagactggataaagaaaatatggtacatacataccatggaacactatgcagccatccaaaagaacaggatcatgtcctttccagggacatggatggagctggaggccgttattcttagcaaactaatgtgggaacagaaaaccaaacactgcatgttctcacttacaagtgggagctgaatgatgagaacacgtggacacatagaggtgaacaacacacactggggcctgtcagaggggggcggtgggggagggagagcatcaggaagaatacctaatggatgctgggcttaatacttgggtgacgaaataatctatgcaacaaacccccatgacacaagtttacctatgtaacaaacctgcacatgtacccctgaactcaaaagtaaaaaaaaaaaaaaatctacagcagaaaaagtcagtattattgaatgaacgcccttttgttttgttttgttttgttttttatctttaaccaaacccatgcgttctgcacatgtgttccagaacttaaagtataattaaaaaaataaaaaaataaaagcaagttaatgaatgtcttttaaaatgtatttttgaaatgagaaacattgcatttggagggtgataggaaagatcaaatgacaaagttagagattagtgacatttttattcctctgttaccaagttgtgggtagtatttttgtcactatactttttatggtagaagtatccatgcaatggataaaaatacagactttgacagactgggaagataatgtgcaatactgaaatactttgcatgctttgtgacaataatgagactactgctaaggaattttctactactttaaattaggatgctccaatagaaaaggttatctgtgtgcgttttatttatttggtaaggaagcagtgttttctggttatacgtggtaaagaaagtagataaatagccttgtcctttaagatgtcccttgacggtcagttagaggagcaggttcattcatgatctcctctgcagacaccttattggactggactggttatgttcttacatacctttgagttttggtttccttttttttgtaaaagaaatatttacctttttctcaaatatcttgccacccagttaggaattaaagttatttgtgttagagtttggcagagtggacagttgaatgacaccttttttttctcgtccaattttgggaccaatggatataccaataggaatttgaaatatagagatttggaaataaagttggttggccaaatgggttttctggtatttcatacttgagtgagactgattttcaatgtagaaggcaacagcctggaatacactccatctatgagcagggtagcctttctcccaaactcgctattcacataattaacttctcctccaccagggagaaggtgggagagaaggctgaactattaggctaatggaaagttctacaaatgaaagcatgaaactgagggagtggaggtttcccactaacactttgtcgactggatgcattgcatgcatttcatgcaatgtcgtttgccgaacaactgtgcctgcttttttagtaactctattctagctccctcctctctaaaactaggatagtaatgttaacatgcctcagagtgctcttggcatgattcaatgaattagtacatgtaaaacatttagaaatgagcctaggttgggcatggtggctcatgcctgtaatcccaacactttgggaggccaggcaggaggattgcttgaagccaggagtttgagaccagcataagcaacagagaccctgcctctacaagaacaaacaagcaaaaattagctggccatggtagtatgcacctgtagtcccagctactcaggaggctgagatgggaggattgcttgaacccaggaggcaggaagtcgtggctgcagcaagcaatgattgcgccactgcaccccagcctgagcaacagagtgagagcctgtttctggaaatattttatgtatatctaaaggaacgagcctagcacgtggtaaacagttcgtgctattttttacctttagtgacattagtattacttagcaatattatgtcaaagcatttagatgcatttaaatcatggaggggttaaataatgttcactgataggaatagctagagaggtttaaattcatgtgaggagagaaaactgctggctctgcggggaaaaataagcccttatttacttttaatttgtttttaacatatatttattcttggtactgagaaaaggattaggaaggagaatgttgagtgaaaggccactttaaaagaaaatatatatatatatatattttttaatttgggctgctgggagagttctgtaacaggagttctggagggatgtgacctggggtgttttaaccccttttattgatacctctcattgctaccttgggggcaatatcattgcacagaaaaaccagttactatttattttaaatatggaagtttctagaagaaaagagagctgtggtctgcattcctaatagcctaccaaaatacataccagaaatctttgttgctgcattgcttgcttgtttagatgtggttacttgtgctgaaaatattagtaagcatcatttgcttgtatccagataggttccttatatacagcacttacctcaatgctttggaattgtagatgcccccaaaatacctgttgaatgaatcgacgaatttaggaatagagatatataaagcagtggagtagacatccttgcacaagtttctgtgccagcctttgaaaaattttcttccctattcatttttttaaaggcaaattattcagaagaaaagacagcctattttgggagcatttcagtttactcagaaaatattgtgcattgcttttgaaactggattgaacatttcatattaatgtttatatggtgttatttttccctcttgccacaaaacttagtttttagaagtactgtaggagctttatagtgtcatgaaatgttagttcctattttctcccccaacagaatttttgatgccattgatttcatctctcatgttgaagctaaagtttggtaggtctgattataaagaagcctgggaacagaaggcccgcattgtgctgctgagtgaccctggacaggtcacttaaagtcgttggatctatgtgtcatcatcagtcaactgagaggctgggactagaagactaatgagcatttctcagctttcagattatttgatggtaggatttccctaccagtttctgcttgaaaagatggcctgctgagataagaggtctctggctcattgagtgagttttagctgtatactctgtggttgagaatgattgttacttgatttgtcaaagctacaggtgcttgctgagaaaatttaagaatatttacatttggtttttaaggcgcccatattagaaaaacttagataaaaattggatgttttaatttttattcagttctcaaaaccactaatccaacaagtctccaacatgtctcttggaacatgttttattcagtgtttaagtccaatctatcacattttaaatattcctttgtttaaattattgtatgccatatagggtcttaatatagctcatataatggtcacagttctcttactattctaaacgtgtcatgtttcgcatgttgagtagcttttgcaggccagccagggaacctgatcgccatttatacgattgctatttccttggctaatatgtttcattatatcctccaaatgacaagaataggatggagtgttaagggaggaaactgagtctgagttggagagaactgaattggagggtgtgtgctaatgtagaggcagaattgctcaccctggctcttggggcttcctctttctcccctctcctctctcagaaggacatgtggtgacatcagggacatgaacttcacctcccttttgtagtagttatctatagctacataacaatctagcacaaacttagcagcttaatcaatcacaaaattatctcacagtttctgtgggtcgggagtctgggaatgacttagcaaggtacttagcaaggccacagtcaagcatcagctatggctgctgtcttacctgaggctggatgggaggaggatttgttcccaagcccgtgtgattggcaggattcagtttctcatgggctctctaactagagccttggtttcttgctgtcagctggaggttgtcctcatggggctctctcagtaggcagcccacaaaatggcagcctgcactttcaaaaccaagagagaaacttgtagcagagtagatgttacaatcttatgtaatgtacccacatacatcctgtcatttttgccttactctattggctacaagcaagtcacagaacctgtcctgaaagggcgagggaattaggcaaggcctagataggaagagacagagatcaagggggccactttagagtctgacacatctgagactggccaagaatatggcttctctttatccttactctcctctctgtccattctcctacttaatagcagcgtgtttctcatcccttctgcttttttccttccttctgacctacagagaattcaacagccctgagtggcttttcctcctcttctctactgtagaaatgcaatgaaaaggtagcaggaaaccctgcctttggaagcaactctcatgctgctggggcccttccttgtcagtgggcatttggggtatgtgacacattcttctctagacatttgttcctacatcatagtgtggcttctataaaggaccaaagtgaggtcttctcagcttttgtgtcttctgattactattctctttaagcaagcactgaattacaaaaccaggtcactttcactataccatccttttaggatgtcttgctaaggctgtgttggtaaatttcaggttagaatcattagcagttttggtgcttttactcttttgccccagtaactcttatgttatcttcctcttttcttcagacatcagtagggtgctgtttcttgcttttttatggcctgctcctggcctgtgtcttagttagtctttagttattgttccttctctttgccagggacacagtgtagtatagtggttaagaacaaagactaaagctagactgcgtgggcttgaatttcagcttctgccatttattagctaactaatcttgagcaagttactcagttttgtttctgtgtggctggtgttaacatttctgaattttccactggccaagaagcctctgaatactgctgccactctcattttgcttccaagttacatgcacagatgtaagagcagacaatttgccctttattgctacatgagatatcaccccaagcccttttgtggtctcctagtgaagtgggctggaacattgttgagcatactgggatacctctttttttgtgtcttcaccctagtacttgtattgcccccaaagtatgaggatagtgtacattttccaatggcacaacatttaataagcgtttactgtttgccatgaactttattaaattgtgtatagacattatgtcttttaacccatataacaacatctggttattgtactgatatcgctcccattctatagatgaggaaactgaggcttacagaaattacacaacatgctcaaggtcttcagagcttagttgcagaacatagttctgtgtgacagcaacgcacatacctttcatggccacgggatactgtctcccatagaggaagcccaaattcttcttagtaaactagatcatttggagaaagaggctaagaatcaaacaactgtctcatggccacaggaacttttcccacaacttctccagccttattttcatattagctcttgaatgctcttgattttgatgccagccagtcttcttccacccaggggtagcaggctcagctttgccctagagtgtaaagtgaacattcagaaaaggagccaggttttcccatgactgttatggaatcttaacattgtatttgaagcacgattaggaagtgctgggcttgtaacaatcacagccagggttcatacgtccagattgttctttttaagtgcatcagctgaactaattgcttatattccagtgataccgccagtgttctgcattcttttaaatgaacttcatcgcaatcaccttataaccccttccccactcccactgctgagcacagtgtcttccaccaaatgggtggttcaaaaaagttggttgttagcactttgggaggctgaggtgggcagatcatgaggtcaggagatcaagaccatcctggctaacatggtgaaaccccgtctctactaaaaatacaaaaaaaaattagccgggcatggtggcgggcacctgtagtcccagctactcgggaggttgaggcaggagaatggtgtgaacccgggaggcggagcttgcagtgagccgagatagtgccactgcactccagcctgggcgacagagcgagactatgtctcaaaaaaaaaagttggttgttgaagttgcttataattcttttgaataaccacagtggtgctaaattaccatctttgaggatgaatttgattctttgaactaatctattaaaatattttctattatagcaaataaagggaactaaactgtaatgacacacgtgttcttgtgaacattgcacactggttctgaaggtaaaagacgagtacttattctgagcagtcagcatcactggagtgagtcccaaagagggtgacttggaaggggtcaaggagtacttttttagacattaagttctggcacttctgttttaaagttagtatgcgttcacctggtgaatcttgtatttttttgtttgtttgtttgtttgtttttaacataactgacaaatccatactgttgcttatgagtctgtgatgtggtgcccagcattagaatgtacaccagaagaattagcactaatggaagtgattcattccctcttttcaggaattcatcatcaaaaaaagaagctcagtattgatatgaagaatgctaacaaagacatagctagagctttctgtgtgcccatgttaataaaggctgtcaactaaggtggagatttgtattgaacatttcatcagatcaacttagaaaagttttatattgttgtcaaaagttacatttagaacttctttccagaatggtctcatcaggaaagagtctgtgaatttaatggacataattgcaattgtaatcatgaatttaatagtcttgctaccatagttgcactagtgagcacagtaattgcagtaatcttttgagaactaattgtatgatggacacagtgcatatatcatctttaagttatataactactctgcaaggtatgtattattgtatgtattttacagacttggaaactgagccttagaaggaataaattacttggcaaagatcacactgctattaaacagcacagatggggttcaaacctgtttattttaaacctgtatcaaaccttactgtgtttctcattcatgtaaagagcctcatgtcagtggccaggcatataaagccatagctagccaatgaatctgttcctcttagtgttgggtataatttttagatctttgactcctcagttcttccttgctatttttattgaggctgacaagttctttctttattattagagaagatctctatatttatttatttggtgtttgttccatctcctcctgtcttttttttttttttttgagacggagtcttgctctgtcgcccaggttggagtgcagtggcgtgatctcggctcactgcaaactccgcctcccgggttcacgtcattctctgcctcagcctcctgagtagctgggaccacaggcacccgccaccacgcctggctaattttttttttttttttttgtatttttagtagagacagggtttcactgtgttagccaggatggtctcgatctcctgaccctgtgatctgcccgtctcagccacccaaaatgctgggattagaggcgtgagccaccactgctggccaatcatctcctcctttcttaatctccgtaacaccgccctgtccctttatgctttgggtaacttgaggtttctgtctatggttcaggtaactgaggtgacactgcctctcatggtacctcagtgcatgcatggagccatatcacaattattaatctcatctcagaattaacattgaggcctcaggtgatgaaagttaatttaggttcctgttttatcaatgttgtcttcttggagccacacgttcttcacataacatgagcaatagttgcattctagctggtaaaagtcgggtatttttatttggggcccttctctgaagggaaagaaagcaaaaagttctatttctagcctgtttattctaaaatgctaagaaatggaaaaacaaaagtaaacacattgttctgaatgacttcttcttggaaaaaggaaggccctttgctggccatattttattattctgtgaattatatgaatcctccagtagttgttgaactggacatgtggacaatgtagcaattctgatcattaagcattaggtgtccatagttctggtataatgcctttgttggatcaaagcatgtgtgactggagggaggcctttgttgcctggctcagagcagggccaagaaatcatttggtgtctcgtttagtccttccaggcaaattaatccttcacttttgaggagaggtaagaaggggttagggaggagagatggagagagaaggtgggttactctaatactgttgccgcctgggaaacagactaggtatctcttcctgaaaacataatggagggcaaaattttaagggttcaccaccccaatccttcatagtggaaatactgctcttaaaattttttttctcttaaggtaattttctgtgttgctattttctctttcctttttgtttttggtaaaaaagagaagagatgactggacttttctatgtcttgtgtgtgaagaagagactaactagtggaaatcaagaaatggcctttctgagacatgtaactaattagattctttctgcttatgacaggtgatggaactgtactggaacaatgggagaagctggtagcttataggaagccaagatgaccagaatgtttttaaataatccgtaagttaatgttcttggccttttggaattcttttaactactgggtaaattttctttaaggaaccatggtaaaaggatagcacaatcaactaacttgagtgcaaaagagaaactattttataaagtaaatatccaaacacgtcaaacaattgatgctaactttgataaatcttattttgcgtacttctttcttgatagggtgtgtcattttaagttgagtgtgtcaatttggtggacagagcataagtatttgaagaattaagagaattccctgcacatggtcagcatttaaattaagcttggaataacccttaggatatgcagatatttttggtcctagtggtttccttgggctccatttctcactcaggtatttttttctgtgggcatattttgaagtaaatatgaacaaatttggtgaatatgattaaaattgagttctttgtctacatcttctccatatccctcttcatgtatgctacttttatgtacatcagaggctattaatgtttgctaattatctgacagttacatatggttgattttggtttcactgtgataacaataatgttagtaagtggggtagcttagtggaaagatcatatatttttgagtcagacaatcctaggcctcactcttgctcttgtgctttttagtagttactcaacctctcagaaccttagtcaactcatctgtatattggatttgatactatctctcataaaattaaagtttgtggaaagtactttgtgctatgactggcacagtatagttactggcacaataaatcatatttacttttcttccttatatttgtgtcatgatttataatctataggcctttattctatctcaaaagattggccagctcaagttccttacctattgccaagctgtggtgattaacattataggtagtatctgcaggtagatgttaacaagctggcaatgtcagaaggaggggttgtcatgtttgcaggtttccattgtgtaagtaccactgctgtggctggctcattttaaactaccagcaaaagtcactgaaagcgaggctgggaagtcttatgtagtagcacagcattatatagtttctaccaaccagatacagtagttacaaatcacctcaagagcatgcttaacagtaaaataataggaagtgatgagatttgagtatttattacctttgtttttagtatgatttattttaattttgtttatataatttaacttttaataatgactgtgtttaacaaccagcttgctaaaaattttgagaatttaacaattggttctagtggcctggtataagttggctctaatacaccactaattgtaggtttcctgttgtgaagacatttctaagccacaattctttaattatctgcctcagccgtggtggtaagagtttcatttgatgaataaaaacaaggtttggttttgagtcagtgcttgctataactcaagttgtcatgctcatattgtttctggaattgaaaatagatgccaaaaccaatttagaatttagaacagtttcttgagttgttgactcagcttcataactgacccctggcatcgcttgcctattctggctgttaaactgatctccaagtgctagtattggcgatcagtcattctgctcactgcctattgaacttccttctctcccttccccatattccttcaaatcttaaattccttcaggtagtggtgctacagagacaagtagtcaggattcctcccaactaagcattccatgcagctttgcttttgattcaaaattaagttttaatggaaacccaattgcctctagggagagagtaaaaacaaaacaaaacctgggcagtttaaggttcatcttggcttgattaaaatcttagggagtgaaatggaggaaaaaaacgaaaccagatcagacatctcaatgtttcttctagaagcaacttcttcagttttctaacttgccctttagaaggaagcaatcgaaccctgaaattgctaagtaacagctaagattgtgtttgttgtttttactttaaatctcacccacctagttctcaaaacacattttttattgaaccttacaaaaatgccttggatatttcaaaacatttgcttgtgtcagttctttgaatcagacttacataattgtaaaacattcatttccccgatttcctcttaaaacaaaaggtatttatagttcccgctgagtcagggatggacttggattactgcaaaagtaatctgtgttcatttcaagaggaagctcgtggttaaaatctgagagacttgcctttggattatgaaataattacctttggcttaatttaaataagtgtgtctttgtactttgaaagcaaacatggaaataataatttaatacagaaattttattatagatataacattctgacttatattatcatctctcttaacagaatgggccttatgtggtttccaaacatcccttgtatagaagatttcttcattagagagatgctatgtgtatagtctttagatgcgcaaattttatagcgttgcattatgttcatatcaacaaactcatgtttgttgatataaacaaaaatatgtttactagatacttgggactcgttgcttttgacgatacatttcagtacaaataagacagacttattgcactttaggaattgataatcaaacctgaaaagagaaaactataatttcaaactgaatgtggtaggtattataaaagacatataaaatactcagaaaacagaagagaaagagaaattacctgggtggcaagaggagtgggctagatcagggatgagattcaggagcagatgatatgtggattagatatttaatgattaatgcctttttattaaagtaccttttatgaaactataaaagttaacattgctaattggaaagaactttagaatgcaaaaactattttgcatttgcaaaactattttgcatggcagtgaaaatgctaacaattaacattgcttttttttttttttttgtattctgccatacttttctatgccgagattagatacatgctttattttccctctaaaatgggtctggttattactattgttttgaaatcggcttcagttgacaatatagtaagatgatgccacagcaataaatatacatctacataattgtagatgtatacataatatatagcattccatgtgtacgtagtctataatgttgcatattactggacatttttgttttcaacttttcatttttgtaaagtgtgctgtaatgaacatctttggtaacatcatggtgcactcattcagttatctggatgagacctttgaacagagttgggaggagtgcttaggggacactctaggtagaaggaacagtttgagcagaaaggaacagtctgaacagagatggtagaggaagatcatgttttgggaaaaggctagaactatagtttagtagaatgaaaagaagataatactgctaattagggctagaaaaagaaaatagagggtctttgataccaagcctttaatttattcttagttgggtgtcattttggaatctatgttatactttaaatgaatgaccctgaatagcttcaattgttcttaatttttcttatttggggaagaaataaaatagttccaaatgctcaagaaagaatagatcttttaaaattcttgagagatttaagaaactaaccaggacataaacaagtaattgaagtcatgagaaaagagtgtgtgtgtgtgtgtgtgtgtgtgtgtgtgtgtgtgtgtgtgtgtgtgtaatgtgtagaaaaaactataagagtagaggtttttaaaagtgaaggaaagttcattaatttattttctacacttaatgaattttaacaaattctttataattaaaatttaaggacaatttggaaaagaagtgagtttggggatgcatgtcataatttaataatagtaatgccttatatttactgagttgcttaattatgaggctatgttctaagaaatgtgtcctcaggcaatattgttgttgtgtcaacataatagagtgtacttacacaaatctagatggtgtagcctactacaaacctaggctatatggtataggctgtggctcctaggctgctgcaaacctgtatagcatgttgctctactgaatactataggcacttgtaaccaaatggtaagtatttgtgtatctaaacatagaaaagtataggaaaaatataatcttacggaaccactgccttttgtgtgtcccttgttgaccaaaacattgttatgcagtgcatgactatacctgtctgtgcttgtgtgttttaaatacaaacagtccccaatttacaatgattcgacttaatgatttcttgacttcatgatggtgcaaaagcaatacaccttcagtagaaaccatacttcaagtacccatacagccattctattttaactttcagtacagtattcaataatttaaaaacaatattcaatacttgaataaataggttttttgttggattattttacccaactttaggctaacgtaagtgttctgagcatgtttaaggtgggctcagctaagctatggtgttaggtatgttaggtgtagtaaatgcatttttgatgatgggtttattaggatgtaaccttttcctaaattggggagcctctgttaatcattgtacttagtctcataacagtcttcttaggaagcatctgggattatctgcattttgcaggtgactgaaaggctgacttccctaaggtgggtgagagagtaccagatttggtgttgtagttcaggcactgctgaggccttgaaacattgctaggatagttgtaaagatagtaagacagtatctgaaagattatgagaacagcataaagtaccacagaaatggaggggctgctttttataacaggacagcttctatcattacggggggaagaaagctcagctctagccattttccattctttttgtggcagctcatattattgtcagaacacttgctgctcctttctgcccaccttccatccctgtgaaaggattatactctcctactctacagaaggctgatgccccatggctagcttggccaaataaatcctctaggatttattttggcagtgaaatgtcagtgacaataatttgtgtcatttctgagaagacactttaataggtatggcctgctctgccatctttctcttttctttgccatgggactatcatgcgccagttaggggtgctccttctgccctggtctttgagtgaagaggacatggagtggactccatgtccacagcttatctgcaaggagccagacaggaactagtattaagcctcactccattgttagcctccaaaatttgaggacattttgttcctgcagtataagttagcctaaactgatctactcttttttctccctttaggcaccatcctccctctttcaggcctaatacacacacatacacacacatgcacacacacacacacattctctctctctctcattcacacgcagcttagcctcctttttatctcgagggatagagttccctatcaactgttccactgctgtctttctccttcattgaagatgtcaaccttcatcagaatttaacaattcaaataaggtttgaattctataaatgtttgtagaacatatcccatgtcaaagtgtggatttctggaggtttaaaataacccaagccctggacccagccttcaggaatcgaagagtatggtgtgggtgctgtctattcaagtagctatccaacaaggtagacaatgttgggtgctgataaagggtgtgctttgatcctcagtgacctgtttatgtagtgtccccactttgttgtatgtcgacttaaaatgttaagtgtcgttgcttttggttagttcagcttaccttctctttccccccttccttagcttgtatttactgtgccatttaatttgtactacatgctagactgctgtgttctcaatttgtagttttcagtcaatttatactgactcattcactagtttagggtatatgttctttctttgacacacattgtaagttctttttggttgttgttgtgacggagtctcgctctgttacacaggctggagtgctgtggcgccatctcggctcactgcaagctccacctaccgggttcatgccgttctcctgcctcagcctccggagtagctgggactacaggcgcccgccaccacacccggctaatgtttttgtatttttagtagagacggggtttcaacatgttagccaggattgtctctatctcctgacctcgtgatctgtccgcctcggccttccaaagtgctgggattacaggcatgagccactgtgcccggccgtaagttctttgatttcacagatgatacattaattttttctgttataaagtgcttaacatactattacaacaaagttcttagtaaatttctattgttttctttgatttgattatttttgtttcccttcaagttagtggttctcttttctatgatgtatgaaatggagttcattgttaattggggtgctttttcccattatttcaatttggaataatttggagttgttctctcgcaattttagatctccgtgtcttactacctgacatgtgtcaaggcaatccaacttaatttcattttactagtgacaagtcctggctttggagtagggagtgaaatcaatagctcatagaggtctgtctgactagtggtttctatgtcaagccaatgtatgacttagctgttcccctttcttcctgattgaattctgggtgttttctgtttcattacttctgaccacaattctactttgatgtcaaaaggcacagggttaatttattattaaagccacatcttggaccaggggctttcaaacttgttgtccagcatgtacagaaagaaatggttgtcagcctcagttagacaagggaaggtgaactcagagagctgccatgtttcagtaaggtctgcttcataggatgggtggtaacttcatgggtatgactttaatactacatttcataccaaataggtaactgtattcacttgtatctattaaatactgcacaaccagattttttaaaggtatgaaataccattaatgttgataaatgtgtccattgcatttatattggcagacctgagtcatattaatggtagttgtttttttccaattttaattttctcttaaaacatttttttataaacgaaaaatactttcattttggaaaattcaagcaacacagaaaaatgtaaagaaagtagaaaatctcccccagattatgttaacattttggtgaatctttttttacttttgtttttcattaaatcatttttatccacttaacaatgtgctacagcacattctctaaatcaatattgtaatttttaatacataccactccattttatgatatcatatctattttaattaatatcctggtgatgtatgtttagattgtttcctgttttctctattacagatgatatatcaatgaatatctttgtacatatatttttggatatatttccagatataattaaagggatgcatactttttcttttcatacacattgccacaggttcagggaaaaaaagagttttaacttgcacacctcagattaatgtaatgagaaatgtcagactcattcattcttgccaacctgatctacaaaacatgtttaaatattcacggctttttaaaaaatttccatttttattttagacccggggtacattcgcaggtttgttacatgggtagattgtgtgatgctgagttttggagtacaattcatcccattatccaggtagcgagcatagtactcaataggtgggttttcagcctcccttcctccctcccctgtctagtaatcctcaatgtctgttgttcgcatctttatatccatgtgcacccaatgtttaggtcccacttataagtgagaatatgtggtatttggttttctgtttctgcattaatttacttaggataatggtctccagctccatccatgttgctgcaaaggacatgatttcattcttttttatgcctgtgtagtattccatggcatgtatgtaccacattttctttatccagtctaccattgatgggcacctaggttgattccctgtctttgctattgtgaatggtgctgcattgaacatataaatgcatctgtctttttggtataatgatttattttcctttgagtatatttgcagtaatggattgctggatcaaatggtaattctatttttagttgtttgagaaatctccaaactgctttccacagaggctgaactaatttacattcccaccagcagtggataagcatactcttttctctgcaaccttgccaacattattttttgactttttagtaatagctattctaactggtgtgactttttaataatagccattgtgattaatggtatctcattgtggttttgatttgtatttctctgatgattagtgatggctgatcattttttttgtatgtatgttggctgtgctcatatgtcttctcctttttttttttttttttttgagacggagtttcgctcttgttgcccaggctggagtgcaatggcgcaatcttggctcactgcaacctccatctcctgggttcaagtgattctcctgcctcagcctcccgagtagctgggattacaggcatgtgccaccatgcccgactaattttgtttgagaagtgtctgttcatgttccttgcctactttttaatggggttgtttcttgtttgttgaatgtttaagttccctatagattctgaatgttagaactttgtgagatgcgtagtttgcaaatattttctcccattctgtaggttgtctccttattctgttgattgttttgctgtgcagaagctctttaattagttctcacttgtcaacttttgcttttgttgcaattgcttttgaggacttagtcataaattccttgccaaggccgatgtccaggatatttcctaggttaaaacactttagacaggtattttaatatagatagtaccttctttttttaacaggcaaaagacactttttatgaagatactattgataaatcattgattttcaaatgatcttcatgtaagtacaagcatcaggtagcttaaagcctacctagagaaatatttttctttattcagccatagagaagtaccttcttttaagaaatagaaagttaaatctggctagtgactgtgactgccctctagttccttcacgttttaggtatttacatggagtctgatacattcgctctcaatcttctcatctgtgagcccacccctatctagctgctctttgtattagacacaatagtcccagctttcaggtcagacaaacatggctgtacagctggctctgacttgtcttgatgatttaccttggacatatatagcattcttgactccctgtttctttgcgcgttcagtgtagttgttaatatctgccttgcagtgttgtatgtggattaaatgtaaaataatgtgtatgaaatgaaagctgctgtcattagtaggtactcggtaaatggattaaattgagcatgtttttcttgttctaaatggaatttcaaatacattttcctttaggaacaatgtcatgaatggagtttgagtacagtattagaaatattattcagcattatatttcattgacatataatttcattaaattatgagttaaacaggtttttaaggactggccagagaagctggcctctacgctagagacatcttgtgtcaagtgaaatgtattccaagtgttatataagagttcgtgcacttagtttttttttttcccatgccaccttgtctaagaagagttcattgacttttgactctagaagtgaacttttagaatgtaatttattacctggttgaggatggcttggaatttcttgataggtgatgatgtgtttggggcaaaccagaccttccttctgcttctgagaattaaacccgttttcttctagagaacttactgctcctctcaccaatccaaccaggtggtcctagtatagaccagccagtctgtatgggtacatggccccaaactggaccagtgagtttttctggcaatttttaaaattacaactgtgaaaggaggaattgtctctcttggatgcagagctgggaattaagtgggaaaaggcacactttaggaatgaagaataaagccaatgataaaacaccagaagcaaagatgctatcttgtcctggtgcaattcgtgttgagctgatcctagtgcccagctgcccctgtggctttcccgttgctgggatatttagagccaatgtggctcaccttgcttttgcctgtgatgcctcaagtgccatttttgttacctgcaagttaaacactgctgactaattcatttgcttgtttatacttggagtagttatttagaaagtcagtgcttttgtcatgggcaattttaataaagtatttagttgcatagcaggacagacacagccttttgagaacagtggtagtgtttttttccccatctgtcatcaaagcagaaatatgctaatgctaatcaaaggataccagtgaatgaatgtgtgtgcgggtggtaacggctcttttgacagaggcttgctctaatgcaaatgtaaaacttttatatacctatgatgtcatataatgcaaatgccatataataaatgtatacctatgacagttctaggatttatgaattgtcttgaagaactgtcctttgctaccattatggttaggagcacctgttggtaaatagatgtttgtggttgagagtgatgtttacatttaaggaggaattggtactttggcaagattatcaaatatgtatctatgtgttccttacttgaaagggaagatcgaatgacttgttgcttctgttctccgcagtggattcgtgtttggggaactgggattttacatgaaaactctgttttgtaaactccacttccttttaggaagtatcagatttgctgtctcagtagcattctgtattgttggaacatgccacaaagagcacagaaacgcatctgctgcttgggttctgcttgccaactggtttgaacagctataatatttgtttattcttgatgtgtcagcagtcaaagggaacgttttcttttctcctttgtggctgttatataacttaagcatcattatattcacaacaatgactatttatgcagaatctgctaggccctgggggatacagatgctcggaaacacgtctacctcagatggatttccactgtctgctgagagtgaaaggtcagggatctcaaaaagaaggaaggatgctaagatcctatgttagttgtgaaatggaagtataaagaataagatctgtaggtatttggaggagaggagagattccccagggcttttgccagtgacaaaagttctaggagaagaaagggtttcagtggtctggaatgggatatgtactaaaaagaatgcaagaaggttgtcaggcagggggcatggtgtgagcctagtgctttgaatgaaactctgtcaccttagctggtaaccacccagcagctgagaggcctggactaaagagcaccaacatgggagccacctgcatgggtccctttggggcagcctctccaccagggatgagcatggctcccaactacaatgtgaaagttaagaatttttagaccctcgagtgtacatggcacactcggaggcccccaccgtctccactacataggccagggagcacaggcagagataaagagacccatgggccaccatcttattagggtccagtgtgttatccaaatatgtttcctaaggggagctttaattggtaggtttaaagcaagcaggtgctagttccaggaggtcctgttgtgactgagaggtggtcagtttaaatttgcaagcaaatgtctgaacggtctgtttaaggaagtggtgggaaagtgaggagcccagcctgctaggcaggacttgggtctcttcagttttatttcctgccaccagtgggagccattcaggtggggaatggaatttgaaactgtcaagggtgactgagccctgattctgagaaagttaaacctatatttaaagtggatgtcaaggcaacataaaatggtaagcactcactatccctaggtatggtggtagtaatgtgccctctgctttaggggaacaaggagtggaccagcgggttatttggcagagggtttttaagatcggggttgcagaggtagaggcaaggctttgagtgcctataaatgtcatggcactggacccgtagtttcaccgtcacttttttttgataactatatgttgagaatccgtgtactttaaattttaattttagacaacaaaggcatcctagaaccagttatcctgttctcttgtgggaatgttctaaccacattggtcattgtgttgttcttatttctgaagcataaggattattggaaacatctttcaagtgctttgagttatgattgcagccaaacatatttatgaagccttccttcttcctggagagaacacctactctgaatgttaagcttggctggatcctaaacaatactaacaaactagatcatctctctttcctgtctgtgctgcctttccctttctccatcatagatctcaaagtatctctctgtgtccacacacacacaaacacaattgtattttttagactgcagtgttaagtttatggagttgttcatatacacttaagctttatgtagtcttctcatgtaaaagagctgctgtccttgatataatagccaacatattatcagttcagccagtatagctcattgtaacaattacataaatataaaatatcagtgctcttaaaaatacacattaatttacatgaatgtttgaggaaagctgcccgtaaagcaaattgtgttccttttgatctctactataaaattatttaattgactgagaggaaaaggtttatgacatgatggcatgctcgactttgacatttgtcatgtgatgatgatgatgatgtgttgagaggcatagagggaggggcccgcctgctggaacagcggctagaagacactcaacctcagtgactcaggcagaggggacgaatgcctgaaccaggaatggaaaaaatggtccagatatgaaagaagccttcatgttacgcctattggtagtgaaccattaagagagaaaagagggagctcagatgattccagaatttaacttgaagtgtctaggagagtaacattacctttatgaggaatatgagagtcaagagagatttgacagcttcatcatctaggagacaggcccaacttaagtacctgttgctaaggataaatgtgaggctataggccgatcttgcttctgctcttttgaccatagtttggtttccaactggaaacactcttagagatcctcagagagagatgaagcagtcagttcaccctgtcacttactggcagagctgagactaggaagggagctcttggctttttgtgcagtgttctttccactctcccgtgctgctttggagaaaagaacagcattttgctgatctcactttagatcttatctttggctaatgagtattttcaagaaaccttggcctgtggaatgactctaaacatgtatgagaaagatctccaaagagatctttgctcaggagatctccaaagcaaagaacgtttaatttgtaacttaacatttttttcttcccatctagaaattctcttttggcaatagcaatcaactcatttcttaatgggacctcaggaattagcacttctgcagccccctgtaatttgccaattcccaaataaagtttcttttaagtatttttattacaaaataatgtttagggcacagtgactcagatggaatatttccacaaatcactcttacttttttaaaagtaggttcacctgtgacctaaatgaaatcattccaattttaagccttatttgctaccaataaactttctattgtatagtaagaataccaaattcaagaatcctgaacctaaagcttcttaagtttctcaccacttaaatgagggactcagaccagggaataccagagaactatttcagctctaaaattctttagatatttaacataggaaagaatttttgaaaattacgagccagtttgtttacaattttggagattcggattcaggactcagagggacaagacagcattttttgagtgcctactctttgtccagcactgtggtaaatgctttgcatgcattgttacataatcagtagttccccccttatcttcagatggtatgtatgttccaaagcccccagtggatgcctgaaatctcgatggtcctgaaccctatatatactatgatttttcctatacatacctatggtgaagtttaacttataaattaggcacagtaagagattaacagtaactaataataaaatataacaattttaacaatctcagaatgacatgaaatttaaaatttatgcattgcttatttctagaattttccatttaatattttcagactgcaactgaaggggcggggtaacggacacagcagaaagagaaactgcatatggggggactgttgtaatctgtaaactgttaggtgggcattttagcccccttattgatgataattaacttactcaaggccacacagtgtcagaggtctgatccaaatctgctttgataccaggtcccacctctttgcacccagtatctctgcctaactcaaaaacttttactaatcgaaactaatgtacatccactgaagtatctttcgtaagattaatccttgtttcccaagcgttttcaaaggcaacctacccttttctagaagttgtgtcgaagttgtcaaaggcgtaaagaaaaggctgtgaaaggcttctaagcttggtataaatcaagaaaggaaagttccgccttaaccgacactgaacatgcttattggttaggactgaacgggctgactcatttcttttttgccgtggtagagggccacaccctgcattccaaaaaccctctgctgccgggccacacccgccaaccccgctcttggagcctctgaggtccggctgggcgtctagctcgcagttgaccccccgggagaggatcggcgcatccggccgcccgccagctccagacgccgggctccgcagcgccgctgtcctagcaccagggcccggcaagcaggggaacgggaccgccgggaccgatcaaggcgcgggcgcccagcaagagccgcgcccggggtctgcgcgccgctcagcgcgctcgcctttccgcccgcgccagggctggctgcgcgcaccctgagcgcgaggagccgcgcgcaaacttggtgccccaggaactttccaggagacactgcctccggggacgagagaccgtaagtgttgctccggagatgctgtggttcattagaatacactaacagacggtgtgaaccgattaaaataccgcaatcagtgccaattctactacggcgaagtaaagggaaatctttatttttcctgcatcctgctttaatgatcaaataggcactagctatttacacctgagaaggttcagtgcagttgctgaagcagtgggtcaggatatgggtaggatcagtcaacaaatgctctttatattgcgtgatgctaactgccgtggcatgagaaccaagggtagggggtggtttctgtttggggttatcaagtcttcctaatggcagtttttgagagaacgggattgtgtctacagattggttattaagttttggggaagtactcactttctcaaactccagtccctgtacgaaacagcccttttggcaactcctttggttggttggaagctggcttgtgaatgagcttggtactaagtgccacaaggatgcacgtgcccctgtgttttggactgagcgtgtttactccataactgtgctttctatttagtgtggccaggtaatcgctcttgtggaatttgtcaataaatacatggagaagaatgcatgacatttattttattttattttattttattttatttttgtgtttgttttgtgtagttataccaaaataggaaatctggagacctaaattctgttaccctgaatgctacaaatatttatcataacatttttatccaattgagttaccgcttttaaatttatgtagaaataagtccagtgagccacttaaaaaacccgcttttctacataagaaattagtgcagttgtatgatgccaagtaacttattttcttgcaagagtttggggaggtaggggacagggaaagtggaatcctgtgacgactgaggatatacacaatgcaacagggaagttatcatgatcagaaacactgactgcgtacaggaaagacaggttaaagacgtcccagtaacataaaggatggtgggaagacttgtaaactgaattatgaagttatgaatatgaatgagcaagtcacgaatagcatcattacacatgcatttatgaagatagagactgtgatgaggttaaaagatagactgtcatggagagaggaagaaaattctttgcagctggctttttttagcgagagaaagaaaattcttcgcagctggcttttttttttttttttttttttagttctataaaggaaacttccctagaaagaaaccacttctaaatggaataattaaaataatttgttagaaactttaagttaccctatgagctcctagtaacactgttttcaagctcataggttaattgttaagcccttttgctccgagttgaactgatcaaatggctctgtgtaaaaggtaacagtgtagaatcctctttgagaaatagcatgtaaacttgggagaaatggcctaagcccacggttctcaagtcactgagacagttgaaaaagccccctcaggtggtgagaatgggataatattttattatatctctaagatgcctcaaatccaaagagataattaaatttggaattttattagtttcacctaatagttgtataaaagctgaatatttaaggatctcctttatcaggcactgagatgctttgtatacattacttcatttagttttcacaatagtcctaagaggtggaggtatttttgaccctgttttatagttgaagaacaggctcagtaaggttatattacctgctccaaatttcacagctagttaatttagtttatgttggaagttagcatttaaggttggttatttttcctatgtggctccaattgctcctaaaatggtgttgatttttctgtttaaaatgatccagaggaggttcttggttcaaagcagatttttaagtgatttaaaagtgcctcattgtcccagcgccaaattatcaaagttcaaggaattatgcatttactctagaaggctacggctttcaaatattaactgagaaagccctactcttaatgagctctttaatgcacatggccgccttagtgttgctgaactccggtaactttcttctgctttttttctgaagaccttttaattcagggtgtgcattttcctcttgcgtgtcacaagtgctattcaggctttctctagttgaatcccctgtttgtgagtgcatacctgcagtattttatatgctaagtgaaatatttttaaatttacgttagcacctagattagcgttgaacctgttttaagaatggtgagttcatgaaaggcacactctgtgagagctaaaactagttatgtggaggtgagaaagtctcagcgtgtctgatcagagcatccatttctgagagagtccatctgtgggcatatcatcatacaagagaataatgccaccttcatcgaagaccatgaaataccatgaaatattccaggactaggcattgctgacagccccacatcatcacctgcaccatctagttgacacagaacacctacccacttccttaagccactctaaatcctaactgctttaagtgacctgaattcttgagcatgttgaaagaacatgccagtgtgatgataaaaccacttgggagtaatcttggaaaagtcatggagagggggaagcatgccacagagtccattttcaaaaatggggaaatggtaaattcgaaaactttagattcataacttacgttggtgtctagcagaattgtagatcacattttttaaaagattggtcagaatcacttacaaaaataaaagtgatgatcagtatgtagcgtatgtttgctaagaattattcatgtccaattaacctcatttgttttttaataatgttactggacaagtatatcagggcattgccatagatatgcaatgtctgcttcatcagaacatttcgttttgttatgttttgagacggagtctcgctctgtcacccaggctggagtgcagtggcgcgatctcagctcactgcaagctccgcctcccgggttgacgccattctcctgcctcagcctcctgaatagctgggactacaggcgcccgcatcagagcatttaataacgtgctacgtgtgttctttactcaagatggaaaaatatggattggatagcggtatagatgaatgagtttaggtcttttacccaaagagggatgatcagtggcgtaatgtcagacttgagcaaggtgtcgatagtgtcgcttgagaaaggcatatggtacagctggtgggaaaaacttcacacagtacaagagatagggtatttggaaccaaggagatgataattgcgtcgttctttgaagcactgtagatagtggttacgaatagagactccaaagccagactctgggcaagttatttgagttctttatgcctctatttcttcattcataaaatacaaataatagtaataatacctaccttagagggctgttgaagatgttgaaggattaaattatataatccatgtaaagtgcttaaagcagaatcggatagtaaattgtatatattagatcctagtcttctgttgttgctgctgttaactactgtcactactactacttcaggcaatattatgcacatttctgggtttgtgtttaaacacatatccagaatgtggtaaataggttagttgttgttttttcaggcagagtcttgctctgttgcccaggctggagtgcagcatcatgatctcgactcactgcaacctcaagcagtcttcccacctcagcctgctgagtagctgagactacaggtgtgccaccatgcctggctaattttttaatattttgcagagacaaggtctcactgtgttgcctaggttggtctcgaactcaaacttgtggactcaagcaatgcttctacctcagcctctcaaagtgctgggatgacaggtgtgaaccactgtgcctggctgtaattaggttttggagagtgtctagtaactgttatttgaacagtggtccaaaaacaataggcgtcttcaccttagtgtaaaagctgagagactttcaatcagatgaggtccacagaaaaaaaattaaaaaattaaaaacttttaagctgagaaatgatactttatatttatttactattaccaatgtggtaaaagagagatggtcacattttgaagtctgtacattttgtccagtttaataagtgctttctgttaaggagctatagtttggtgtatgagaaatcttcactaaactaggttttaggagacctctttcttatctccagtccaaatcagatcagtacagtcttcaaccagttgttatgatcttgggtgattagcttaactcaatggttctctgcagggtgcaattttaaacccccagggaaaatttggtatatttggacacgtttttgattgtcacagctggggttggggaggtgtgctagtggcacttagtggatactgccatggatactgctaaacatcctacagtgcacaggacagaggccccacagcaaagagttatcctgtccaaaatgtcagtagtgttatggtcgagaaatcctggcttacaagttcaatgtatgtatttctgtttctgacatttgaatgccaatctttgctttaacgaaatcaccaagtagctttaacagtatgtttataaaaggcctttgagagttaatgtatgctgaaatctgcaagtgtatacagtgtacacattttatcatcagcagcacggtgaaatatttgctttgtttcctggaggaatatattatcgtggtttgagagtcagatacacctttgctggaatctcagccctgccagtttaacttgctgtgtgatttggggcaagtttctttatctgtgaaaaccaaatctctatttcatagggcttagaggaataaacaagatatacatgtaaattatgtagcacagtccttaggcacagtcacaagagataactttttttttcaaatttacattttccaggttaatagaattgactgatgctttttaaaatgtaagatttggaaggaggatatataaggaagttagattttttaatagttaaaatattaaaaataaaagggctcctgttttccaaaggtgataaatcttaggagaagtaaatgtctttacagatatcactttggccttgtagggaatgaagaatatgcactaaagtgagaagcacttattagagggaggcataagttgcatggaaaacaagagtcatctatttcttatcagtctggaattagccaataatataacttctgcatttgtgaattgttccactataaaaacatgtaatgtttgttcttaagcagtgtaattctattttttaatcttactcttgatattatgtctcttaaatatgtttttccatgccttaaggtgtaagcagcacacctagcaaatgtatgtgcaaatgtgtcaattttgtcatcttagtgatttcttataccctctcagccttgcctgaaaagataaagctttcatgtgatcaccctttctgtcacttccacttgtgtatcaagcaagctatagcagtgtgtagcttatccgtaagagccattggcattgtatgtatttgacttaatggtgtgaatttttgtaggtgataggggttggatgggaagatttcagagtattcacaatccgtctgttgtctaccttataaaggcagactgttttgcatttctgttaattttccagggagatggcaataagaggtccagcaatgaaaagttccatggcttaggaagaggcgctttttcagtttggagaattgaagttaggaatttttttgaaaagtggtcttgattttctttctcagtgtccctattgcattgaattgtgtaaacctcacataaacatgtgacttgaatcctctagtggagtgagtgttagtaccctctgcccccagcagcttgcctctctatgggtatctggaaggaaatctgtcccctcacatcattgggacaattcacagccagctcatccctctcaggtggtggctgcccaaggggagcacagcagttccagcataaggggcatgtgaaatgtgactggcgcacagatgaaaacatacttctcagaaattactaacatagactaagccctgctagtgcttagaggccttcattaagctaactttcaagtttaattaactttccttatcatacagaagtagacggtggtgttccagactctgatggcctcaagccgcccctgagttgctgggtaagcagtattggcaaagaaacctggtgatcctaacagagaatcctgaactggtgatacaaaattgcatagttctatggggtcagaagcggagagtttgatactcaaaccaaactgaaagtcaagctgataataaataaactaaaagaaagactaggcagtttaaaatttcaggtggaaccagtgaccacaattcttgagaccccataaaacaatttatccactttaggtgcattctgtcactttgatttctcagatatggatgagactagaaattaccacgcactgcaggaagtgttgctgaaaatgtttgaaagctgattgtgtatttacaaggctcctgggcatcaacttgtaattttgcagtaattggtaccaaaatcccaagttctagacttgtgctgagttaacagatgtaaaaatagaattgtttttttccccccttttgaagcaagggtctcaccaaaaggctcaaacacgtcctagacataaaggaacaaacagatttaagtcaaggtggagtggaacaatatgcctcattatccacaccataggtctattagcttgtattttttaaagagtttaagcttggcattcaatgaattctttaaatacagagtgtggttataggtttattcatttgttttttcaagaggtccctccttcttccttgaaattccaaagctttcatttcactggaattattggcttctaccacgagtatggtgtatatgccatacatgagggccctcaggtaatagtatgtgtactatatatacctttccctcttctcaatttggaaagaaagacctgactccaaaagaaattattaaactaacctataatgaatgtatcacagcaaacatacaacaagagaccataacttggttatagaactataacttgattaaaggaactaacatgttattctgagagggaaattgtctgaagaggaatttagagaagtagaacttgaagactgggatgggagactgaatttgagaggccaacttggcctagctacagagaaggtgccttacccctagggcggcattaccaggtctccatatgggtcttcccctatggtggggctgtctgagggcttttgaaatctgcctaagttccaaatctgaattagagattggtcttgccctcatcggtgaataccgctgagtcctccttaacctcacagtgcacagtgtcaggccacacaggaagacacagaacatatttttgttccatgcccactatgcatccttctcatggtaatttggccacttcatgtaactatgcttttcagagatctgccatcagacatgccagcaaacaacccacctgatggtttacattctcacaataaggtattcagctcgagtttttactttaatgtcaccacaagtgtggtcagtatgaatgcttttctgatcattgtatttataaatttgcaagactaaaggacagccttggactatgtgagtctccccagataacactgcactctaaggaccagctggcttccccaggtttgcttgtcttcaccttgaatgccctttcctatctgacttgcaacacaagagtgtcatgaccatcataatattattatcttttttattgcaatttagaaaacgttgagaagaaaaatgaatgtcattgagtgcttattcatgtgggaaatgtggtgttctgttctgtgagtgactcatgtaaacgagtaaaagaaactagagtacattgttaaaattacaaggtaaactaattcctactttgctagttagtgtgtcctataattctcatttaaattgcacagattactaaacaactacagaaattttcacccaaagcagttcatagacaaaatttcacagaatttttcagtgtgattttatattgttaaaattcttgtagacttatgaaatatactttcatttggttctcaggataataggctgtatatagtttcttaggcattttgggttccagagcctgtggtactttcctatataattgtcctttttatattcttatattcccgttgatatattgaaagagtttcctgaagttatctgttcctatataattgtcctctttatagtcttatattcccgttgatatatcgaaagagtttcctgaagttatctattgctaatatttagcatttacttttaggagcaaaattctcaggagaattgagaaatctgttgtcatttattttgattatgtccaagtaaaggtcagagatatgaaattaaatgtttgtaactgacaaactagtcatcacagtctacttcaaagggaatgtctgtcacagtttcagtagtgccagggtacatagagatatgttgtatgaaaaccatatggtcttgggaagactgtagaggaatccttttgggaaaagagtatggaatggacaggaacagttcagggaataaatgggattatatccagcgaggttgaagaataggaaaaacagaaacatccagttagaataagtttttgtgtttgatagcagagtagggtgactatagttaacaacaatgtattgtatattttgatgtagctaggtgagaggacttgaaatgttcccagcacatggaaataataaatactggaggtcatggatatctcaaatactttgagttgatcatcacagtctatgcatgcaaaaactatcacatgtaccccataaatatgtgcaaatattgtgtatcaataaaataaaaagaaaaggaaaaataaagcaataattctaacattacctctttccaaagtgagtgcctctcactactgggtctggactctaatctatatgaataaaatgaatggattttattccctaagaatttgttaactaagttatctgagtaagttatatgtccatgtttgtagccagtagcaggagggaggtcaggcaggctaggggttgttataatctttttttgttttgttttgttttgagatagagtctcgctctgtcagccatgctggagtgcgatggtacaatcatggcttactgcagcatgaactcccaagctcaaatgattctcctgcctcaactgcccccccgacccaatagctgggatacttgagacgcaccccagtagctgggactacaggcatgcaccaccatgccctgctattttttttttaaatggagtctcactctgtcacccaggctgaagtacagtggtgtgatctcagctcactgcaacctctgcctcccaggttcaagcgattctcctgcctcagcctcctgagtagctgggactacaggtgcgtgccaccacacccagctaattttttgtatttttagtagagatggggtttcaccgtgttagccaggagcctcgctaattaaaaaaagtttttattttgttttttttttttttttttttttttaagagatgaggtctcagtatattgcccaggctggtctctgggctcaatcattccttctacctttgcctcccagagtattgggattacaggcgtgagccactgcacctgccagttataatgtttttaaactgtgactagaatgaataaaagggctagtatttctatgttgcttttctctatacctacttgttccctgccaaagcatacaagaacaccaccagcagcagaaggccttcctcagattacagaggaccatatgccagacctttgatgtccaatacaataggcactagccacatgcgaatatttaaattaataatcttagttggacctaacacatttcaagtgctcaatagctacatatgtggttagtggctatcatattatgtagaacagatacagaaccattccatcatctcagaaagctctactggacagcactgtgctatatacactgtctaaaggaagctttttttaaatgaattttttgatatttagatacaaatttagggaaaatgattcagccaaaagttcagccttaaaaaaaatagatattaaggcgctggatccattttcaagcaagtcctctataaatcaaaatatttcaggggtttaactggctcttttaggccaaacaaaggtatattattttagttttcctcaggtttaaactttgaatcctagaagtacatgatggctttcaagagtagacacagtgaatctttagcatgtgtataggcacccattctattgtaactggttagtcagagcttagcagggggaaaaaaaagccactcttatttacggcggggggaatgcggtaaagttacttccacaggtgatgcaatggcaggaagtcattaccaaccccaggttgaagggacaattggaggaggccgtttggaggtcagggtggataggagctgagaccagaaaggatatcaaagatatcaacagaaaataaggtgagaagtgctcctggtggcttctccctttctcgggttaggcagacagaattcttatacagaaattgtagaaatacagaatttctatacagaaaatgtagtacttcatcattttccttagaatgctcacatttttgtggttttattacctgtgctattcatagtgacatcactaggggacttttgaggattaaccacttcttcacctagatttttatcggcacattctatgatatatcacttagcaaatccagagaggttaaacagtttaagccatgatagggacagaactggaaaaatgctaattcttgctcttttacttgtgcacgttgccactgggcctactgcagaaatgctactagtaaagggagtatatcatcagttcagtctgggagcagaaactgcatagtagtttaaacaaggaaagtttaatattaagacttattagggccaggtgaggtagttcatacctgtaatcccagcactgctttgggaggccaaggcaggaagattacttgaggccaggagcgcaggacctgcctgggcaacatagcaagacactgtctctataaaaacaaacaaacaaacaaaaaaattacctaggtgtggtgatgcatgcctgtagccctagctgcctgggaggctgaggtgggagtgtctcttaagcccaaggggacaaggctgcagtgagctaggatcacaccactgcactccagcctgggtgatagaggaagaccctatctctgaagaaaaaaaaaaaaaagaattatagctataacaaaggattggagcaatgataagattggctaataaaaagtaaacagaactctatagaaatagcagatataggtagcatctactactccaatggctgagatagaggatccaaggaagagaccaacttcctaccccctctcagagctgagatccagaccttgttggagaggacacgtccttgattcactgcatggcagagcagttgctgtagtgccacaccagcaaaacttactaaaaatctgccttccagaacttgctgaaaatccatccttcatggtcccagggaaagctattcatgggcggatatctactggaggcactctgctaaaaactgtttgagacaggctttggagaagctgcacatccgacaggagtctgatgtgactcctgatcagaccaggaagcaaaactccttcctacaatgtctctctagcattttctacagacaaaaattaacaaacatcatgtcagctagcaaatggaaaatacttacagggctcagatccccttttgcaaatcaggctgtaaatggtgaatttgtagctgagaggcagtaaattgataactgacacagggagaaaaacaagaccacccttcttctcagagcctttattattatttttttcaacaaggtaattgcacatgtatgtgtatgtgtgtgtgtatatatatatttaggtggggttttccttccagtagtacttcatcattttccttagaatgctcacatttttgtggttttattacctgtgctattcatagtgacatcactaggggacttttgaggattaagtattttagttttactgttcatctcttaaaccttggataaatacatgaatattaatgagttggagccacatttttgaaatgacattcagctaaatgacattccaggcttttgtttaatgcctatgaagatatgtagcataacctagaattatagttgcatgtgaaataattcaatttgggattttatctcaagaattataaatatttgccaaaagatttcataatacattctagtatattttatttgtacatggtaggatttttctttcatttgtgagggtgtttctttactgcttttcatgaattgggatagttcttccagaagagcttttcaaagatttttcttctcagttgttttccacattctacaactgtaaactgctaattttttgtggcttcttgctctatacaccatgcaatgcataatttatcagtttgtttaaaacattagaaagggagaaatactcagccttgtccttgaacctgagttgatactcgatctatctccatctgcattgccccctttttctctactttgtctcttattttgctgtattttttcttcctcagaactctcctgaaaagcctttgatttggtaaatatattttgggattttcagatgttgaggtttattataaatgctttaaattttctggttttattttttttaattaggttttgttgaggaacagagtgtaaaagaaaggatatggttaaaatatgaaaataagtaaaaatggtgcatgtacatcgttagtatacaaatgatatcaaatagtttagaaagagatgtcaaaggctcctctcactgtaactgttattacatttcttgtgatttgttccaggaaaaaaaaatacatattttggcacatatctgcgtctatcttgcttttggctttttacatttttaataaagggattaatatacataccgttccttagctttttctttgtactttacctatttttgagatatattcctgtcaacacatacagatcttctttattcactttaatgatggtacaatattttattttatgggtgtataataattgattttatttttgccttttttctggatgttttaatagttgccattggggggattgtgtttagctattggatttattgcagtctgcctttctgtaaatattttcgtataaatatcttgctgacatacctgtagggtaaattcctgtgagtgggattgctacatcagtgggaaaatacatttcaaattttgataaacatcaccaaattcttctctggaaaggtcactgattgtttgttttttcgagacagggtctcgctcttcacccagactgcaatgcagtggcacaatcatagcttattgcaacctcaaactcgtgggctcaagcaatgctcgctcctcccaagtagctaggaccacaggcatgcaccacgatgcccacctagttttttgtattttctatagagatgggggtctcactgtgtttctcaagctggtcacatactcttggcctcaggcagttctcccacatcagactctcaaagcactgggcttacagctgtgagcctggcctttttaaaaaaaaaaaaaaaatcaaaacaaaacaaaacaagattatgtctttcccacgcttccatcaacatttttcattcaccaagttttaacatttttgccaatctggtaagttaaaaatttactttccctctgggtgaggatcttttcataggtccattgtgagtttctttctgtaaactgctcactcatgtgctttcttcttcctctttctccctctttttccttccttttgcccttgtgtcttcttgtctttatcatattgacttgtatgagctcattttaaattaggaaaattcatcctatttcatatgtattatacctgtttcccccatgttaccgtctatcttttgatttccattaaaaagatttttattttggtgtaaggaatattaaacatgttcttttacaaaggaaataaaagaagggtaggggttgaggaaatctggccatactttctgctgtttttgtggcctgagtagttgtagtttggggctaaaggttatcccacctgacactaccatgtcccatacctgtggagaccctgtactatcttacagcaaaattattcttaagacatactagatgttggtgtccttcccctctgtatttgcctaaaccttcatcagtgtattgagcctcttaagagcaggtgagcttatgaacaaccttgtctggaaacgtcagaatttagccacatgatgagatcattcctggtagccaggagttgtagataatgctcacttctgtatcctgagcacctagggtagcatctggcttttgaaacaccatgtgttgaatgaatgaatgaagacaaagaagagcaagagcagaggatgagcagaaatagagaactcgaatgaagattcactttggaacacattagtcaattagatatatgcatgcctgacaaatgtacccctagagtctagaatactttcatttcttatcttcgtaacctctactcaggctcttgacagctgggatgggtttaagctaatagtatattatttacctcataaactttatggaacattgaacatgcgaaccgtgtacttgtgccaactgttagttagttgaaactcttctttctttgaatttacgtaattttctgtctagactggccagtgagtaataatcatgtctgttcttttgtgagtagtgttattaaaactatgtttttcggattttaagataatagatcaaaaatgaatttctgtctaaatttattcaaagaacaaacttcttcgaacatttaaaatggttctggttacaacataatgtctttggcagcaacttgggtggaactgggggccattattctaagtggagtaactcaggaacggaaagccaaatactgcatgttctcacatataagtgggagctaaattataggtacacagggacgtacagagtggtataatggacattggagactcagaagggaggaaggtaatggataaaaaactacctatggggtacagggtacactgctctggtgacaggtacgctaatatcccagacttcactatacaaatcatccatctaaccaaaaaccacttctacctctaaagctattgaaattaaaaaaaaaaaatggttctggttaacaaaaattgagtatacaaatggcttgttacatactatgtaaactatgactcaacctaaatcctagaaaaatagttgactagttctttgtttaattaaacatctccagagaaggtttttaaagatttcctcacaattcaaataatctatatacttattcatacatatggaaagtcttttaatgatatcctatgaagggcaatactgtgcagtattttcttggcttggcatgtaatgttataccctgaaaatgtcaataaatcttaatttccagtaggatcgtggcccctttttcttgccatttgacctgagatgtctaatggttttgtttattcttcatagttttatggaggcaattgactccattaatttgaatttactgaaataaaagccaacaataggaagatagattaatttttgaaaaagctaatgctaagctttgacttctgttactgttcagtggcattcaatgcaaaaataattgaacctcagaacattagagaaatagtcattgttgttttgagtgatcatgatgcttattacgcatccatttcaatgcggactgatgcagtaattgatggatgatgccattaattaggcttttgaccagacaaatttattgtagtttggtaattttttaggcagaatattgaaatgaaaggtaaatggagatttttttaacaaaatgaagatgtttaaaatgtcaacagaaagctcacaaataatttcttgggtacaacagttttgtaccactttggtccatcttttgcatctttagcttaatcttaaaaaatcaaggtgactaagtaaggtgacagaaattcatttgtgaatttgtctttgacattttgtgcaggagcataaatgaatacgacaagggaatctactttgaaaaatgagtgtttgaaagtaggtgtttcttggatttttttagcctcagtgaggacagatctgtgggtgagaccttggtgctttgttgaaaaccagttggcattgaagaaggcaaatgaaaaatagaagcctaatgttgattgtgacaaatgtaaaacatgtatcccttaagaaaatttcaggagcttttggtggggggtatttctggttggttggtgtaaagttttggtggcatatagaccttttgaaggagtactttatagttggaatagagtgtgaaccacctgagaatcaaactagagggatttctcctgtgggtggaaaagcagaggctttgaaaatgaattcttctgtgtttggttcccagtgttgccactcactgagggatcccagtaaggaacaaactctctccgagcctcagtattcttaatttgcacaagtggagattaaaatgtctccatcaaagagtttttaaagaataggtaaatttggcacatagtaatcactcaacaaatgtgttatttttaaagaaagagtttctagtattgttcagattaagagggtggccactgaaaaatattttcaggactaccaaaggttaataaaataattacagtataaggtatggaaattggggctagtttagaacttgctgtttttcagcaaggcagaaatttgctgtgtattattagaatgtgacaattaatgatttttcccatggctggctcaagtgtcagataattgaccctggtttacgtcgtatgtctcaagatgaggccacaagtcccattgaggtcaattactaggcataagtgtttatttcaaacagtttgtgtctctgccattggtctggtcacacacactaattatcatcatcttgaggcattgcagttgcctggttgagtggaggcacttgggagcttcctgcccaggaaccctccggccttgatgtggtctattgggaaattggttacatcagtattggccataagacaggatctgacaactgtccagactttcattattgcctgatacattctggtcacatactgatattgaacaggtagtaaaggaacagtcagcacttgtggttttgtacttcttacctttttcctcacaaaaataaagctgctttcatattttcttcttactaataagatagtgagcaacctgggcaacatagcaagaccttgtctgtaaaaaaatttttttttaattggctgggcgaggtggtatatagctgtagtctcagctactcaggaggctgaggtgggaggattgcttgagtccaagagttcgaggctgaagtgagcagtgattataccactgcattgcagcgctgggtgacagagcgagaaccttgtctcttaaaaaaaatagctatatatatatatatatatatatatatatatatatatatatatatatatatatatatgccaggatgtgttctataggtcttgtgtttatattttgttgatcttcacaagctatggtgtaggtgctattgttatcctcaatttgcagaggcaaaaaactgcatcacagagtgggtgagtaatttattcaaggtctcacagcaagtaaacagaagagctaggttttaaatctaggccatctggctccagaatcttttgacaactgtactaaccttcctctccattagaaagtatagacagttatactgaatatatatgaaaagaacatgaacaaccatgtaaaacccatctaaccagtgaaaaccattcctagcacctcacgcacgtacttccagattccttccttgaactctttttttttttttttgagaaggagtctcactgtgtcgcccaggctggagtgcagtggcgcgatcccggctcactgcaagctctgcctcctaggttcatgccattttcctgcctcagcctcccgagtggctgggactacaggcgcccaccaccatgcctggctaatttttttatatttttagtagagacagggtttcaccgtgttagccagaatggtctcgatctcctgacctcgtgatccgcctgcctcggcctcccaaagtgctgggattacaggtgtgagccgccgtgcctggcctccttccttgaactctgatgggaagttctctccccctgacccttttctacttccaagagctaagcataatgaacaatctggtatatatcttcccaaatatagatgcagttattcacattgtacatatataggtaattcatacacattctcatatatcctcctgtgtgcattgttctgctaagcactttttctcactcagtatgtcctggaaatatttctgtatgtgtcattgtatataatttaacacattcttaaactgactgcttatatggactgcaccacttctgtaggatgggtgtactataatttcagtgcaccactttcattgatggacatttacattgttgtcatattttttctatattattttcaatagttgcatattctatattattttcaatagttgcataccttttattgtatgaaagtactataatctcctgttttgaaattcagattattagaaggtacagggatgaatattctcaaaacttggaatttgagcacatccttccttagttacctcccagtcccaattaaaatgctaagtccaaatgatcaccttgtcatttaaaaaaccaacttactgcggtatattttctatataattcagtgattttcagtaaatttactgagttctacaaccagcaccataaaccagttttagaacatttccatcggttcttaaaagataagattcctctcttatctttttacatttaatctctacttccacaccgagccctaggcaactactaatctactttctgtctctaaagtgtttccggtcctggacatttcatataacctgtcacttttaagaatttgatatccataagtagtatttcttttcttactcttttgaataatttggcctatatacaactcctagctagaactgtctattatattagggtactgtcttgaataataataataatatatatattttttccattccatagagacaaactgcttctctgtttataaggcttctttggtaatacttgccatattacaagagaactgttaagcttgtttggttaatttcttcatgtggtggcttgatagtaattgttattcttggcttggtttgattgagaactgaatatgcattgatttctcagaagacttgctaccaaaatatagcaaaaacttaccagaacctccccccatgagaagtaacactgaaaagttctcacttatgacatcacatcccaacttacaacaccggtattgttagcttcaaattgcttacaaacgttctgcaattcttttggattaagtaactctgtactattaaaataatttttaaaatattattttattgcctttataaaccagtttggattaaaagctaatattttttaaaggttaggataatttcatttcattatttaatatttcaaaatctgatgatatgatcatattttgaagtcatctgatagttcctgaaagtattttagatgtctactccctgcatttatacatctgtttagagcctgattgtttttatatggtgtgcttatttattttttgtcattgcacgtgaataattactgttttctgaagacctctactttttaagaagctccgagagagtggaaaaataaccaccaaacttgtctgcctcactttattactgagagaaaaaatttgcagaatgatattaactatatactaaaatcttagcacaccagagtacaaagtcagggacggaaaactttctgtgtgtagccttttgaaatgtatctataagtagaaggcattcccaagtcacatgctgaagagcggcgaaatggcttagaggcagagttcttaggtgccactctacctatttcaggcagattctgtcaccatcagcccttcgtaggtcacataacttacttgattttagtgacttatttaaaatcagtaattaacacctcaagaggaaaaagcttttctttagaagaaataacagatttatcttcaatacctctgaaacctaaatggttgcttaagtaacagctgttgcattttatcatcattggcaaacgggaaaggcagcttcctcaacttgtgtttgtcttctaaaggaaaaaccaaagcaatatatagcaactgatgcttatccagaagagataactcagatgcacagaggcaaagagatgtggacatctaaataaacccagacactttgttcttcagaacttttaaacataggcattttctctctcggcgagagagtgagctgtgatcagttgtgtgtgtagccaggatgttgctaaagcaaactgactttatctgccttgcacgccttctcctctgctttggtgtcatgcctgtctcctttctaagaccagctaaccatacttggtttcttctgtcctctttaacatcttcatcttgctttattgtgcatgtgtatgatttgaggttctagatccttgaactggggagtgacaacttagacacccacagagaccacgtatctatcctacctggtcctgcagagtgccctacactgagtgagtcctctgtctaagagtgctgctaaccatctcctcaagggcagttatctgccatttgcaaagaatgtacaagttctctaaatcaagcaactacatcagagatcttagatgatgattcatttgaagagaatgggttgggagtactcatgcaaagagaagaagcattttttttttgcttttgatcttactgcacattaattttgagtaaatttgatagtacaaatcaaccaacggatattcacattttgagtgtcccgtacttgagctcctgagagtgtgcagaagggtggagtgcttatcttcaagtaacaccgcctgttcaccacacagctttctttttaacagaacactggaggctgccgctgttgggatgcattgaggggaggggacctagctacttttaaaagaatctttgggtatagaaattgggggaaggaagatgtgaaaaataatgccacttgtgggtggggtggggatggatgtgagaagacagactgctaaaagcagccatgattggtgagcacctgctgtgtgcctagactctactaggtactctgcagctcattatctcatttaatcctgtgagtcaggtgatggtatccatatttttatagacagggaaactggcttggaaaggtcaacacttcctcaaacaaacaaacaaaaacagatggagttagtctaattctttctatttgtaactaattcgtcttaagattaacatgttccttcctctctctagttccaaaatatccccccttccacggtcctgaattttttcacttctcttttgtatactcttgaactggaggcatttacagttgtggaacatagaccttctgaaatgcaaaacatcctagggaagagaaatgtaccttactgtgtgggttgacttttgccttgctttgctcaactcctagctgagaatacctggacttaagataatgggggctgcacgtgggaagtaaagagaggagaagaggtagtctttaagcttggacctctagaggggtgggactgggagccccaccctgagggctcagagaagcaaagactcctgaggagacagccactaaaaggagggcaagatttcaccaaaggctaacttttccccttctggttttgttaacgtttttcatcatggaaagggaggaaatgcactggagggtccagaccttggtttagttcctctttcagtagaattgggatcctcagatgaatgatgaatcggttaagggtggaaataactttttcagcagtatacatacccaccataaacattttattaactttagaaacagaaatgtttaggatttctcaatgttttatgtagtgtcaaggaattttcttttgaatatgggtcctctgatttgtgccatttcttgtctttcctgcacaagccccacccataatccttcatcgatgtccagtctttatttctttaaagtgatgccggaacatcaaaacttcaaagcagcccaatactgaatccttccacattttaagttacattttcctcgtaagaatattaaagttgtctcaaccacctctaattttgcagcaatcttttggtaagactgtttacctttatcaagtctttctaaagcattcaatttagttttgtggaaataacagctcactttctttccagactccagtttcattgattactcaatatttatttaaattatgtaataatggaaacaagcaggtttggagacaaatacagtgagtcttggtaagcattgcatattgactaatgggagcagagttgccaagcttaggttggctaatactaatgacagcgggcagttgcttaatcatccacatgcatcagtatgtctgagtgaggggtaactaatccagtgtgagagtcaagtagaattgtttaagagcactttaactgtagtcaaatgctacacctgctccttaatagcttgaaggagctatttattacagggatcccaacaactcgtgtgatttgatttttactatgagttgcacctagaattgtaaacattcaatatactaatcataacagcgaccatgaaggtgttttttttcttggggaggtgtctaatcacacacacacaaaatcagtatgatcagagagggcaggaaattgatttatcaccctcaggggcttgatgttgctcttgttaaagggacaagcttgttagatgtgagctcacgcaaagtattgccagagatctcctgccaagctcttcctgttatgtaaaagcaaaaaggagtgggcagattatgaaattattctgtatatgatgattagttcgtgatggtatagtgatttgttaatctggttcattactttaaaaagcttaatcatagtcatcaacttccatatttttactttttagataggcagaaagaattcagaccagttattagttgctaaacaatttgttgttgaatgaaaagcaaaatcctggaaaaaaacaacttagagtattagggtctaacagcctgaaagtcattgtaaacttgacttgtttttctgcccctgaaattaagttagatgaattaaaacaaaaggcaaaggcagttatttaaaaaacttgtttttgctattgcatatttatttcatataacctcagatttattttgatttccatttcttggtgcctggcaccagaatttgtgcagatctatttcaaaaccacacattgtaaaatcaacactattgacagttatgggtaattgaatggcaaatggggtttccaactgggtgctccaactgggactcttaaacaaggcttgacaaattctgctttgtcaggtgtcataaaatatggttcagaacgcatctgtagtgtcaagggaaaatcacttatgccattccctgtattaccacttctgactcttgtccgtcctgaagtaggaattcacatggcttatgatggagtctttgttttaggaaacacgacacaaacgctaagactcttcagatatcatcactgaatctttaagttcaatccagttgctagatttggcctgtaacatttggctcagggattcctggtggccaaaggaaaacatcacaagagtcacattatctgtaagataggaacagactagttgttttaaagaaaacttctcttaaaactcaaagcagaaagatgtcagaatgggatttaagtaatttctgccttcagcctagggaattggcttgtatggcagttttttccactccttttgtggtatctatatagagataggatatatgactcacttggcaaaggtcaggagtctgaacatttgggtaatgagtaccttgtcctaggaagataaactgagcacagtgtccctaggacttgcacgatcgaagaatccccttggttggggcttggacctttgccagctcatctgcaaaatcttttaagttgtcctgatcagccaaagctgctatcacctgaatcttggttgtttttactattaataatatagaaatattttgccaagaaaatcttttgtctttttgtgggacaggtttcagaaatggtccacagtctctgtagatacctctagtaattggtctcagaactcattgcctttaatcagccctggggatcagtgggtgacagatcagtgcctttatgaaatggagttactaggaatggtgtgtcattgcctgacgtgcctccttatctgccataatggagttccttatatatttcctgcttgtcttgtatgcctttggatctagtaaggaaataaggagaggttgagaaaatacagagtaaagctttagcaggtatcttcccgttaagtgacaggcagtgatttgtgcttctttggtttttatcatcggtctaatgtgagtcattcttgtgcgtcagggttggatctttttgcctttcctttctcttctcctgttgacttgacctggtttctttagtctgagaaattggacgtatttttctttctttgaggaaagggctagtggataaagccctcccatagagagtgtaacgtgggtaatatttgggtgccctttcagggttaggtcccactttgttcaaggaatgctgtatgcatgggtagattattaataagatggtggccccagtaaatgttggtgtatgtgtgagacttggtgggaagagctgcttgctgtaaatagtggctcctctgctcagcagttttgtgaagtcagttgacttattctttaatttcatcccaccacccaacataaattttttggttcattaaaaaaaaaaaactttctggatgctttatgtttgtattattttttaaccaaattgggttcataccagattaaatttcaagttaaagataatttattatggcagtttaaaaaaacacagaatgtaaagtgaatagtagaatgaactccatatccgtatctcccagcattaacaatcaactttctggattcttgttctctctctccctttcccctacttagttctggggaaagaggggcagtattttaagacaaatcccagacatcataccatttcactcccatactttgttgtcatgttcgtttttcaattatttaccttttgtctgttgacttttctttctcttgtttctgaaataacacttggactgtgccctggtgatgttatgaaggtacactttctggtagtgttgtcctttgcatggcgcttgctgggctggtcttcatggatcctgaggaagacagctctgctggtatgcagttcacgtctcagtagaacctagtcaccagtagaacccagaggtatcactgctacctcgcgaccttgtacagttaggtgaaagactgtgcacttgtatactatgtttagaagaaatggactcaaatctaagtcatgatgatgtttattattttttaaacccataaagaaaccatggctttgattaagactctctaaatggatatagctagattctattttgtttttctaattacatagacagaaaacttttgacattacaaattaatcatttataagtttgccatcttttgagtacagtaataatttatttgtgcaacatttcagttttttttttttttaacttttactttaggttcagagtacatgtgcaggtttgttatataggtaaattgcgtgtcatggggatttggcgtacagaccatttcatcaaccaggtaataagtatagtactcgacaggtagtttttcaagcctgaccttcctcccaccctccaccctcaagtaggccctggtgtctgttgttcccttctttctgtccatgtgtactcagtgtttagcttccacttataagtgagagcatgcactatttggttttctgctcctgcattacttcacttacgataatgacctccagctccatccatgttgctgcaaaggacatgatctcattcttttttttttttttttttaatgattgcataatgttccatggcatatatatacaccacattttccttatcccgtctatcattgatggacatttaggttggttccacatctttgccattgtgaatagtgctatgatgaacatacatgtgcacattctttatgatagaacaatttatattcctttgggtaaatacccaataatgggattactaggtctaatggtaattctgttttacgttcttcgagaaatcaccaaactgctttccacaatagttgaactaatttacattcccaccagcggtgtgtaagtgttcccttttctccacaatcttgccagtatctgttacttttggctttttaataatagccattctgactagtgtgagatggtattattgtggctttgatttgcatttctctaatgattggcaatgctgagcatttttccatatgcttattggctgcatgtgtgtcttcttttaaaaaaaattcagcttttaaaagtttccatgtaagttatcatgttcaagtcccacaacagcactgcaagtaaggaaaagtattaaattcctcccagttaagtcagagaaaagtggaagatgagaggggattagttaatgacttgattttaggtctgtggtctcctagactagaagtcctttctcttttaaatgtgttttgagttgctttggaatggttttgaaatggaaatgtgccttgttctttatatttgtttcttcaaagttttgtcttttgtttggaaaattctcaatacctctgaccaggtcttggagatgctcgggcaaactacacgcttcttggcatcctattccaggacaaggccagggcagagtgcatagcccctcttggagccgttttattcctgacattaccctctctccgctatgactttggtttctacctctccactgctaccccagacccaggctgtgaccattaccagggatttttatttgggtatgctggtgacttttgtgacagagtggaatttatttgagcctaaagtgtctggaatttttcctggagactcaagatacttgatacagtaaagaaattgttctcagattcctctatccttgtagacattttggttcaagcacttaattgcccaatttctttcaaagggagtaattccaaaaaagatttttaaagtatctagacatgaacattctaattgttagatattaatttttttttcttaagaggcagggtcttgttccattacctaggcaggagtgcagtggcacgatcacagctcactgcagcttccaactcctgggttcaagccatcctcctgttccagccttccacagagctaggactacagactacaggtgtgtgctaccacgcccagctgacatgaacattctattgacttaaattcctctggggaatagagtaatgcttcagggtttatgctttattcaaaaccaaagttctagttttaacaaataaaacaaagttcagctttattcagtaaagcataaaagaaaataaatttctataccagcaatctaaacatttgtgtactttgtttctcccaaagagaaacatcagttaaaattgatttcctgctcaaatgtcttgtctgctgcaggtgtatttcctaaaacatgatttatgcatttgatttagtgacgttacatgtatttgtagtaccgaatagtttgaataataattgaacataatttcattgcagatattttaaccatcggttattattcaatgaattatttatataaaataggttaatataatttcaaatatgaagttgctttggaaaaagtaaaggaacaccagctaaaatcaggagtaatgggtattatggaatattttcaacaataggcagtgctgttttcaaacacgtaaagtattcaaagtcattggttaactaaatgttgtgaaaccaaagttctggttttaacaaataaaacaaatcttcaattagtacactaaacgtttataaataatacaggcaaaatgattcctaaattgcttaggaacagtttatttatttatttatttttgtacaaacaaaaagcttcatagaaagtctaatgagatttgggacttgttggagattttatgttttgtgggcatagctaggctgaattagccagttatggtcagggggctaccaaagaaccttttcataaatggaaattggtagagcctgatgagacatcagaggcctttattttagtggctgtgtgcatgtggggatggccaggaagaggagaaaatagcaaagtggaatatttttatttcactgggaagttgctctcatagcctagtctcagccttgctggtgtgtgccttgtgatcttaagtaaaacactttgatttgatggccccagtctgtgtataatttgaggctttaactagaacctgcgactttcacattgggtacttgacctccccccagatacaaggtggtaagccaagaagtatgaggtaacttgctaaatacagcatatattttttaaagatttaggcaaagattggtttttatattagtacagccatgactatattattagagcaaagcacaaaatttacatgtagttttaaggtaaactataaacataaaaaactgcaccttttattagagccccttgggatgatgcacctagacattcaggtggctgtttttgacctctacccatagtattcttgggagaaaatattcaggaagacagttgatattttttaaaataaatttcattgtatatatttaaggtatatgacatgatgttataggctacatatagatagtaaaacaattactatagtgaaactatcatttcatatgttactcaatttttgtttttgtggcaaaaggagctaaaaatttactcatttagtaagaatcccatatacagtatgattttattacctatcatcctcatattgtacatcggcgctctagacttgtttgccggttgctagatgacatccaaaatcttatttcactcttagtttatatcattcctatctaagaactgatcatggatgccttttcatcttaataatcaggtgttttgttttattattgttttatgtagtaggttatttaaaacagcatgtgccatctaagtagtgtaattccaattatgttaaaatatataggcccactttttccatttattctacagtacatatcaagcgctcgctatatgtgaggcactcttttggacttctgtttttgttttttgttttatttctttttgagacagtctcgctctgtcgcccaggctggagtgcagtggtgcgaacttagctcgctgcagcctctgcctcctgagtatctaggattacaggcacccaccatcatgcctggcaaattttttttttttttttttttttttagtagagacagggttttgcaatattgaccaggctgctcttgaacttctggcctcaagtgatctgtccacttcttcttcccaaagtgctgggattacaggcatgagccaccatacccagcctcttttgggcttttaaggagtacatttgctttgtttaaatatttaattaaattgttaacattttgagtacataacaaattcacatggttcaaaattcaaatggcatgaaaagatacataatgtcaagtgtacctcccacccttgccatccaggtctacttcctggagatagtggatgttgctttcaaagccttcaagtgatattgtatgtttttattaccaaatatgtacatatctccttccttccctctcttacacaaatggtagcatatgttaaatcaagtttagtctaaagctgcctccttaaatattttaagttcagtgtaaaggtttctctgtatatagtgaactgtacctaaatgcaggtgtaaacagactgtaacctactcttgtgccaatcaccaatttttggtcaatcaaagggggccaattgttcaaactgtattcaaataaggcaaacactaagctgtaaccactccagctgtttctgtacctcacttccactttctgtacatcactttcctttttctctctataaatcttccaccatgtggctgtgctggagtctctgagcctaccgtggcttgggaggctgcttgattcatgaatcgttctttgctcaattaacctctgttaaatttaatttagctaaggattttcttttagcatatacaatacctatgaatctgccgccttgcttttttcatttgacaattagatttgtcctgaaggatatatacctgttagcactggttatctctgaaagataagatggaggaggcttggcttgcggtgtctgtttatctgtctgtctatgtatttaactttctgtatttctgtattgcctgaatcttcttacagggagaatattgccttttcgataaagagggaaagtcctttttgaaaaaagagatagcgtaaggtaattaaatccacacaaacacatataaatcggatctttgatttttctaatagctccctccatggtggaagttttggaggaagtgggtgtatgtgtttgtggaaggctttttgacctgggatagggagtgagcaggggaagtctctgaaagaacccccaaggaatgcttttataactttgccttaatggttaaggaaagtgaaactacatggatttccccctttaggcagcatttgtctccaggtgtggtaactcattttaaggaactgaaaacacattccagaatcttctatcagcatcatcgatggtatccccagttggaggtgcactactcagttggggagcacacaggctttggagcctattgttgggactcctccgctcaacatgtgaccctttgtagggcacttgaccttgagtaccaggttgcttggtaccatttgaccttgagtaccaggaaccttgagtacctaggttcctcacctgtcaatagatattcatttatccctttttgtagaattgctttgaatttagtgagcttatacttttaaaaagctcgggtcatagtaggctttcagtacgtgttagctattatcatcaccctccttgctaggcagagcaggacagtggggaattgatgtttcctcccctccatctcacaggtggggcaggggtgtgctgagaagagaacttgggactcttggcccctgttcaattctctgcttaacctgctaggcaatttgggcctctgaaaattcagtaatcctcatagcaacttagacgtcacctgggcctgtggtccccttcctagcctaggagccagagcatgaagctccatctgtcacattggtttgttcagagaactacacatgcgttttattttagcagcatacaggttcccacttaggcattgagaggacataggaagctgtttaacttcctagtctttaaggtgtggacgctgaagagcttagctagtaatgacagtatcctgtagaaaaagctatggcatcacatactgattttctaattacttcaacccataaggatgctataatgcttttgtaaattaccgtctaagctatatgaagtaatgcattccatcctgcagtgcagtaaatgttactatactcttgtaagtagtggcatgtgtttccaaagttgaggttaaatccagaaaggctgcgacacaataattagttttataattcttcatgcagactgatggagaagtctttacaattttgacttgcctcttaagacccctctagggttagtttcacatttattttccagtctcttcagtgttagatttctattttaaaaggcgggattatttcataacataactaccatgtgttaggcatcgcagaattgccatctgataatctaaactcaagtacaacagcaaagacagctgcagaagaaaaatttttgatgtcctatgtcatagcctaaaaagccccacaagagggtctagcaagcagaggatagtagttttacaggagagaacaagtgagacagagcccttcacagcacataacaggggttcggctcttgcatcatctggttaatgtgctagaaatcaagcatgaatgccttttgtgttctcaagctctaattgcaaaacttgtttatccaaggaaaaaataaaatgaaacaagagagacatgccattggctgtcacacggccaaggttctcccatgccttcctagctcatctgacatcttcctctcctactcccagcatgcccctaagtcacctttttttttgtaatcagatctcaggttcctttatcttagttcatagtgattatttcgcagaacatgacaactcgcttaaaagaacagtgattgatttcatggagcacttataaaacataggtactgagtacttttacatatgttatttcatttaacctttatggtaacttgattaaaactttgtaacttttcaggtagctttgtttttgtggtacactgaaggaaagaggactagggaagttaaaaacctttcccatgatcacatggcagaaactgggagagtgagaactggaatccaagtctacctgattcaaaacttgttcttagtctgaactttaccataataatagctgccatttattgaagacctactgttttctaggacctgtaaaaaaacaactctctgaggttactaacttaaacaatggatcaaagttagtgttaccagtaatggggcagatggatagcttctgttctttgatatgatcagagtggaacacaacattacttctggggcattcttgccaaaaatgcataacctcaatttaatcaagagaaaacatcagagaaacccaaactggagatattcggtaaaaaaaaactagcacccttcaactgtcagggtcatgaaaggtgaagaaagattgaggaactgccacgtattagcagagactaaggggacactaaataattgtgggaacagagaaaaggctattagaggggaaatttgtgaaattaaaaagaagatatgtcatttagttaacagaattctaaccatgttaattccttggttttgatcattgtactatcctcatctaagttgataatataaaggactctgggtgaagggtatgcctcagttttttgtactattgcagcttctctttaaacctaaaattatttcaaaatagaaagtaggccgggcacagtgggtcatgacagtaataacagcactttgggaggctgaggcaagaggattgtttgagcccagaagttcgagaccaggctgggcaacagagtgagaactcttctctacaaaaataaaattaaaaataacctggcatggtggcacacacctgtagtccccaacactccagaggctgaggtgggagactgctgagctgtgattgcaccacttgcatttcagagaaaagaaaagagaaaggaaggcaagcagggatggagggaaggagggaaggaaggaaggaaggagagaaagagaggaaagagggaggaagagggaaaggagaaagaaggaaggaaaggagagagagagagagaaaaagaaagagagaaagaaagtaagttagaaaaagtttaaaaatctatctgaggttgatattatttattttcattttaggataaagaaacaaaaggctcaaatgttagataacttactcaagatcatacaaatggtaatcattagtgagtgaaggaagaaaaaatcttaatagtcttggagattccaaggcccatgtgtcttagttcattccgtcttctataacaaaacaccatagactgggtggcgtataaacaattgaaatttgtttctcagagttctggaggctagaaagtccatgatccaggtgctagctgattccctccttctcctggacagctgtcttctcactgtactctcatgtggcagaagggttgaagaagtcctctagggtctcctttataagggcactgatcccattcatgatggctctgctatcatgatctaattatccccaaaaggtctatattcagtgtatagcaccacattaactgctatgctttatagctacctcgttttaaatattactaaacatagccctagccctgagccaaagcccctttctattacatagtctttattttatactgaaaaaatggcatctttgtgcctattgaagaaaagcaatggatatatcttaataatataggatatatagattatatgtgtgtgtgtaaatagagcaatatttatagagaattaaggcaatttaaaacaacacatgagaaagtatacaaatcaaagttttttgtttaaccaaggaaaatgaaactagtcattattaagtgttgtaattaaaaaaaaatttctacatcctgggtctccagattataaaggtcatgtttatctctttttctgctgcccaccttttccaaactttcctgtacaagcgatgcttatactgtttaattcaaaagataagaaagccatctttttgttttatattattaaaagattgatagtttgaaaagatatgtagattgttttcagactttaaacccaaaagaagaatacacgtttaaaagaaaatcctgcagtatttttaaatactgataaaatataattacaatggaaatctttttaaacttgaagaaacggatctttcggctctattcatctgtaaacaatttaatgataaattctgcataattcttctatgtgatatcattagaaatgtagtacaaagatctaatttaaaatcacttactttctgagcctccatgtcttcatctgtaaaataggtacaatacactaacccaaaatttttgccgagataatttgataatcttataaagtcttttcaattaaaagacttcagtatacgtttcttcctttaaaaaaacttttttacttcttcttaagactctattgtagagtttatgactcctgaagttaataacttccttctaaagactttacaaactttgacctttgttattttgatttacatgtgtgaggcatttcatgaaaatgcagaaaacaagttgctgtttgccaagacattggatcagctagcatagtgtggtgctatttttaataatacgtaattcctgtggccatttgataaaactagaagctcattaaatgaagcccagagtgacagtcgtatgaaattcaatttcataagaccaggactatttcagggatggtttttgagaggagctgtaacttagatctgtcggctaaatttagtctgtcagctcgctgggtccctcctctccattgctgtttataatagaggatgaatgtttgtgtgtgtgtgttttttttttggtcagaatggagtggggaagttgtgtgtgtgtgtgtgtgtgtgtgtgtgtgtgtatgtgtgtgtttgtgtgtgtgttttcttgaagggtctccacctttgaaaagtctttatagctttttattgattataaaaatagtagctattcattataagaaatatttgcctgtgagaaaatatgcagaattgttaagtcaccaggggtaacttgtatcagttttgtatgtagacctaaattcttattttctatgaatatatatctgtgatatagatgtcacaaaatcatgatcatgcattttctatatccttgaacattttccaagaagatactttacaattgtatgggattgcttctaagggcactgatttgtttaatttcctattgtatatgggagttcttcttttcccccttagattagctgataccaactgaaactcacaggtcagctgtcaattaaatgtaatcccaattcttaatttctaaggttactaccatgtaaaacttgcctaatataaaagagatatatgtgtatatcaagatatactctaaccatctagttttatctaatagtttcaacctcaatagtctcagaaaaatgtattgaaaggaaagaaaaagacaactcaccttccaccctgcgttttacagctagaaagagacccagagtgccactttctcctttttcaaacttggcagcaaaaagatactgacgtttagccagccagctggttatgatttcattctttcttggaccgccctatttttccttccacaccacagttaaaccccctgagtggtaacagatagagaaggtcaagggataaaggctgacctgctacataggctgtgccaggccacccttcgagcctgcccaagcccactgtgggcaacttctctagattctccttagctcatttgctgagtgtggttggcttttattaatgttaatttttaaaatctggcaaaatacacaaaaacttaccattttaatcatttttcatattgttgtagaatcatcattttcatcatctcaaactgaagttgtctgttaaatacttggactcagaacaaaaagacatccctaaggccaaaagcaattggatctaaagaaaactgaataatagtgatagagaaaattcacgaaaggatttttttttctcatctcctttctccatttatttactccaactgcttttttagctaaagacaaaagatgctgtagtcatgggtggcagaaccatgcttttgtgtaggcagtgctcccaaagtttgtttacagtgcttttgcttgcacctcagatcatttttccagaatgttacggattttttttttcttcttcttctttttttttttcttttagaacactgttcacgatcactttttcatataccatgggactcaggcaaaccctttttaaattcctggttatatatttgttttaatgttcattagtatttttttgtttgtttgtttgttttctttaacagccatcaaggctaggcatggtggctcacacttgtaatctcagcaatttgggaggctgagacaggaggatcacttgagtgcaggagttcaagagtagcctgggtaacagtgagatcccatctctgggaaaaaaaaaaaaaaaagccaggtgtggtggcacatgcttgtggtcccagctactcaggaggctgagatgggacgatcatttgggccccaagaggtcactgctacagtgagctgtgattgcaccactgcaccgcagcctggtcaacatagtaagattctgtctcaaaaagaaaaatgccatcaaatacctgttttcacagatattgttccttagaacaagacttagttaaaaaaagagagtgtgagctagtttaaagaacagtattaagtaaataatattataggtggtatgaagaggtagcaaattggtgtacaagtaatatttggggaacaggttctgaatggtctttcagtagcccacacctcattccatagctttggcactccgctggcagcaggacgaagccaggtaggcagtggcatggacgtttctgtactgattctgctaatgggctgaggaggaacttgaggacctgggggaactgagaaagcccacgtctctttctaatctgggtttctaggaacatactccagacctgggtagcgccatccctatgattgtattcttctgctggtgttatttttacagcttgcaacattagaaaggagagaggaatttttttttttttttttgatacagagtcttactgtgttgcccaggctggagtgcagtggcactctcagttcactgtaacctctgcctcctgggctcaagcgattctcctgcctcagcctcccaggtagctggggctacaggcacataccaccatgtctggctaatttttgtatttctattagagacagggttttactgtgttggccaggctggtctcaaacatctgacctcaggtgatccgcccacctcagcctcccagagtgctgggattacagatatgagccactgtgcccagccaagggaggatttttaaaagtctatatttcagcctgtcccattttttgattcagatcttagatagaaaaaggaagttttattttggtgaccgagatataggtcctggttgggtgagtctttctgaataatgctcagtctgctggtaattttgtcacttactcaagcttcaggccttgagatgggcaaaagagctctgttctcttctgtttttctttcctgttgctcttgccagaactgccgttgccaggaagtttggggcaggtcccaagcaacatgggttcccaaagaggggtgggagtagaaatctctagaaaatatgactgcaagagaaggtgaattccatgactgcctggccttggtggctgtgtcacaattgctgcatatattttaaaatgtatatgtaagtcctggacttgagaattcttaggaaacccttcttcttttctctctttttggtctttcctcctactctctctgtaatctttagttttttgaaagcatagaatgatatgtaattattatttataaatcatgtataaacaattgaaattccctgaccctctccaattctctatccctgtccctccgtagcctctgtatgtatatgtttctagatgttttatgcttacatacacgtgcacatatatatatatataaatgtatatgcccacatatatgtgaatgataaatacatttttcaattaatatgtatttctacgtcacagatatgttggtatgtacagatataccacattctttgaaatgaccacatggtattctgttgtgaggaggcatcaaatttatttatccaaaccacagtgaaggatatttaggtgcttttggaaattgtgttacataaatagggctgcacttttgaacacacatcttgactcatttttaatatatctgtaagtaagagatggaattcctggggcttaaagtatattatacattttggtaaataatgtcacattgccctatgactgtcataaaggttatgacagtcttaactaatttttgctcttatttaatctgagcatatgttatttgtacttgtctactatttcatacttttggcatattttattccatatattctgccttagcctgtgctcctttttcccctacactatcaggaatacatagtgctttaatagtagatgttcaatacgatatgggttttaggaagaaaaaacctccctactcatttgagaataatgtagtaaccccaagctcagtgcattgtcctgtcatttttgtggacactgttttgatattccttaaaaatggatagtaaacatcaggtaggtactaagatatcaattaagagaaagtactcctattcactagacactagtagtgattaatcccacttaaaaaatccacttattcattcagcaaatattttttcaaagcctattctgtgctaagtgctatactaatccaccgaaggttttatatcttactatatatatatgagtttggggtacttgaatagaagttacaaattagtgtatgaataatgcctttgagtggttctgaaaacattttaaattttactgctgtagttggctgtgaatgaagaaactttgcctaggacagactttaggactcatttgtctcagtctctgtttatgatctgctgaagaatctacatttttcaggttagatgctttatagaatgcaatcaaagttaaaatttttagccataggttctaaaacttaaacaaaacatgagtgaattgtagtctgtttctttctgtcttcccatctctctctggtatgcccttagtttaaaaagagttgttttgtttgggttgctctgccgtaaagaaggaatttgaagaggaatcagtaaaaagaaggagatggctccattaatcaagtgtgaaagacttttccaggaaacaggctagtgtaaaagctgcaagtgaaatgtataaatacagatctaaggttttaaaagaagatacactgctcttgaattatggctcctaaaaaatccaaggtagaagcaaaatcactgaaaatatttcaagagctggcatttggatatcttggttattaggagtaaacattttgaagcaaaacatgtgattaaggctcttgagaagaggagcttatcctgcattatccaggtaagccctaaatgcaatcatatgtatccttataagacaggggcagagggagatttgacatgaagggaaggcaatgtgaaggtgaaggcagagataggagtgatgtggccacaaatcgaagaatgccacggaatgccagtagccaccagatgattgagaagcaaggaacaaattctttcccagggcctccagagggagtatgtccctgctaatactttgatttcagacttctggcctccagactgataatgcatttctgtttaaagccccccagtttgtggttatttgttacagcagccgcaggaaactaatgtatcattctgaggtcccccaaatctcaacccattgcagttcaagatagagtccaaaatctcattagctgagaagtatggcgtaccagaaaagaagtgactactgtaataaaaggcatacatctaaagattagaagacatgatgaaaacatcttccatcagtgctatagtttgaatgtttgtcccctccaaaattcttgttgaaagataattcccagtgtaacagtattgagagatgggccctctaagaagtgattgagttatgaggactctgcccttatgaatggagtaacccattcattaattaatagattaatgggtgaatgggttatcatgggagtgggttagttatcatgaaagtggatccgttataaaagccagtttggctctctcttgtgagtcatctcaccctgagatgccttctgacatgttttgatgcagcatgaggccctcaccggaaaccaaccagatgtagctgcctgagcttggacttcccagtttccagaatcatgaaccaaaataaactttttttctttgttaactacctagtctcagatattctgttctagcaacagaaaacaggctaagacaatcagcaagtagaatgtatcagaacatttccagggagactgttgcaagaagttcttaaactgataattccttactgcctttcttagtctaatgttgtgctcactctggatatgagtaaccttttttcatggaaattgtttctgtagagctgcccatcttaaaaaatgcccattgacattattcacaatagcaaagacttggaaccaacccaaatgtccatcagtgatagactggattaagaaaatgtggcacatatacaccatggaatactatgcagccacaagaaaagatgagttcatgtcctttgtagggacatggatgaagctggaaaccatcattctcagcaaactatcgcaaggccaaaaaaccaaacaccgcatgttctcactcataggtgggaattgaacaatgagaacacttgaacacaggaaggggaacatcacacactggggcctatcgtggggttgggggagcagggagggatagcattaggagaaatacctaatgtaaatgatgagttaatgggtgcagcacaccaacatggcacgtgtatacatatgtaacaaatctgcacgttgtgcacatgtaccctagaacttaaagtataatttaaaaaaaatgctcattgatagaatctgggggaatctctttaaagaatcagttgccctatctaactcagccgggaggtcgagggactctctggttcctaattgtaagaagatgtctgttaaggtgaaaccagcaagagtaaggcacatctttagggactggtgacaggtaattcacttcaaaacaaaaatcctgtatttctgtttgtggtcttttgtgcattttagtgtatatcctctatccccacaccacagcgaacatacccccctctgaagacatggcttgtggtacattgttaactgccatgtgaaagtgctttcacctcttaaaaacaaatttgttttgcatttcttggattttgcccagcaaatctaccttttaattagaagaaataaaagcatgagaccaaacctttgacttataagagtaaaaaagtaaaaataaacaaatgccggctgcagtagtactcacttgtagtcttagctactccggaggctgaggcaggagaattgcttgaatccaggagtttgagtctagcctggacatcatagtgagaccccatctcttaaaaaaatgtgaggaaaactagttagggaaaaaagggttatttttattttcatatcattctaagtctttacatacatcttgtatgctttgctgttttgaggtctgtacacttccacatgtgatcaaataatttaatctgggcacactagtgtttgccttctgccatctatactacttccgatctttcacgtctgtgtggaacttcagccaggctgtgaagctacaaggacaagcccttctcaatctgataccacctgactcctctctcttccattctgtcttgaaagaaatgtgtcccactctgcaaaacagcttgtcccctgatcatttctcccatggtggccaaaccctccttctcaagatttgtgccttggccaactaataaattacagtgctctcaccccctgtctttatttgaatccactccagttgatagctatcatgagccatgcctgctacaaggtaatgcctgactcttaaaaattcctcctctctacatcaagtttgatgccttctgtgttctcaaccatgacccattttacaaatccatgtgctcaatgttctgtgactagactaacaagcaccagtcacacccttaaatctttttgtctcttaggttgttctagcccagaaatctctaccttgtctgccttcccacctcttatgttgtagtcatcaccagtccctcaagacagccaccaaacctgttctcctttcaagctccaggaaattacctaatcccacttccttacttctttctgcttggttgcccaggctccctaacctaacctgtggtcacagtttttttaatagtcttgaccacagccctagaatttcttgttccctctgtcctgagttctgcaaattctgttatccccatcctcaatcctagattatcttacttttcacctgcctcgggctgcgaaggcattaaacaagtaaaatacagagtatgaaaggttgtggtcaagggacattcagttgatattaaggatatttgaacagaggcttgaagtaggcaaaggagtgagctatgaggatatctggggaagaatattccagaagaagggccctcaagtgcaaagactcaggtagagcatagtaggcatattagagaaacagtggccagagtggttgaagtgagaatgggcaagtggggagaggctggatgagtgaggattcttaagaggagggaagaggatgaggtcaggaaggtagcaggaaccagatcacttgggaccttatggagcctagtaagaaagaggtttggtttttttacttggagtgagatccagcacaaagggttttgagcatagaagtgattttaaagaggcaagggtagaaacagaccacacagtgttagaggtgattggtttctggatatatttggaagataaagctgataggattgctctaatagattagataatgggggtgggggtggggggagcacagattggagagagtgcactctcatatgtactcaccagctgggagtctttgccagagcaaatgacagaatggaattgcaatttactaagctgaagaaggcatgcaggaggagttggcttggaggagaagagcaggaatttggttttggacgttttaacctagttaggcagcaaccatggtgtatgtttctttgtggttcactgaatgcccaggacaatgctttgtgcatagtaggtgcttagtaaatgtttgattttattttgattcagtgatttggcttttgtaaatatatattaatataatcagtcattagctgcttagtgctggcctgctttgtgccaaagagaaaagctcattaggtttataaatagaagataaatttcagctgtgtcttcagtgcaattgatgtggctatgcctttgccagagtgctttcataatctgttctctgaatgctgatcaaattcttataatgaacaggatgtctatataatgtgtacttagcttcttaatattatgtggatagtttgactcctctaccataggagtagcacatggtcaagatgtggaatagatacctatgggactgctaatggttattttatggtaagaaagtagtttccagaaataattttagaagccattgttgggtatttctaggtgctagatttttacctcttgtactgacagaatctttttctcccaatgtggtattaatacataattgccgctcttagtcatttttccagtttttatctttatgactgacgttttgttcttttacaaattaaatccgtatttttccttgttccttatttgtcttttatactgaagtaacctgtgacatttgaaagttaaattgtttgatcttacagtttacatctttagatcatttgacaaaatcttgaaaagcttttaatgagccatgccactgtctcaggttatgatcacataatgctctcatcatatatgaaactgacttttcatcaaatggtttgggtattaatgcatccagaattttgaaaaattgaacattccatgatcagggcgttaagacaacttaggacagtgatgcctgcagttctattttagtgcgtaggacctgtttgggaaggaataattaaggacatgccatcctgatactgtgttgctcagatgtgcctgtattatcttattattcctaccagtgtctcagttgctcatacaaattaatgaacaactcatctgtaaaggatgtggaaattatcatactttcaaaagcttttgggaaacatctataagggcctgtgtttaggttgtatttcctatgatgatacccttagaaatctgattaaatatactgctgaggaggattttgatagctttgaaaagaatgaaggctaaattttatgtggaagatggctatatatacaatctgaagaaaaaagtcaactattttatcattgtacaaatgtgaaataatgttttgaatattttttttatattatagcattgactttggatttaagtttccttttcttatagcaaagaataaaaaaattaggaacctctctggaccttctcttaaggttgactgattccctttatatatttaagaaattttttaccaaggccagtagggctcactgattttttctcctccttgagcaaatctcaaaaagaaatggtatgattaaaggaggtatatactttcccatgtaaaaatcttagctgtgtgtgttttttgtttttttttgagacagagtcttgctctgtcacccgggctggagtgcagtggcatgatctgggctcactgcaagctccacctcctgggttcacgcctttctcctgcctcagcctccgagtagctgggactacaggcgtctgccaccatacccggctaattttttatatttttcgtagagatggcgtttcaccatgttagccaggatggtcttgatctcctgacctcgtgatccaccctccccggcctcccaaagtgctgggattacaggcgtgagccaccgtgtgcccggcctattagctgtgttttttaagagattacttatttttaaaaattaattttctttgatgaaatctccagtttataggtttgttcttttttatatttggggaaaagtaagttttaaggaagttaatataataggtctcatactgtgaagaatctagatttaataagtatgttatgatcaaacgtagttggccaccttctttctctagtattcgctttttgttgttcatgaaacgtatttatattgactgcctagcatgtgccgggcaccgtgctagctcctgggaatacaataatgaaaaatacaaccaagggaccttcccttatggagctttgattctggtaaggcagaaagacattcagcaagtaagattatatagataagagtgcggtggtttgaatgtgttccccagagttcacgtgttggaaacttaatcctgaatgcaatgtgttctgaggtgtgacctttaagaagtggttcaaacaggagggctcttccttcatgaatggattaatgccattatcacaggaatggttcccttatataaaaggatgagctcaccccctctttgcccttttgccttccaccatgggatgacgtagcaagagggccctcactagatgccagtcccttgagattgaacttcctagccttcaattctgttacagcagcacagaatgtactaagtcagagaggatgctcagagaaggcttatttgaagagacgacatgggagtggaggcctgaatattgactggaagcccatcatgtgaaacatagggtggaggtgttctaggtggagacaatagcatgttcaaagtctgtgaggtaggaactacaagtagtccaaagtaattgaagtatagtgtgcagttgtagaactccaccatacaaaggcaggaatggtcttgtacaatatgaaataatgaagtgtgggttttattttaagaacagtgggaagttactgcaataattcaaagatgagaattacacagttttaaaagttctcttgctgccttgtgcagtttgggtttggatgggatagggtgtgtacgggagcagtattgaggaagctttggcagtaattctgatgaaatgtaatgccacctgaaccatggtggttacaatggaaaggagagtcatgcgtggcataacgacattttggtcaatgacaaattatctgtacaatggtggtcccaaatgattataacacagatgaaaaaacctatatagcctactggtgtaatagctgtcctaacatcctagtgcaacacattactcacatttgtgatgatgctggtctaaacaaacctactgcactgccatccgtataaaagcatagcatatataattatgtaccttacataacacttgataatgatagtatttggctctgttaatggtttatgtatttgctatggtgtaccttttatcattattttagaatgtgctccttctacttatgtattttaaaaagttaactataaagcaagtccttcaggaggaattccggaaggcatcattatcacaggagatgacagcttcatgcatgttattgccccgaagaccttctggtgggacaagatgtggaaggtggaaaacagtaatattgatgatcctgaccctgtgcaggcctaggctaatgtgtatgtttgtgtctttttttttttttttattgagatggagtctcgctctgtcgccagactggagtacagtggcacgatctcggctcactgcaaacgttgcctcctgggttcaagtgattctcctgcctcagactcctgagtagctgggattacaggcatgcaccaccacacccagctaatttttgtatttttagtagagacagggtttcaccatgttggccaggctggtctcaatctcttgacctcatgatcagcccacctcaggctcccaaagtgctgagattacaggtgtgagccaccatgcctggcttgtgtctttgtttaaaaaaaaaaaattttttaagtaaaaaaaaaattaaaatttaaaaaatagaaaaaagcctatagaataaggatataaagaaaatgtttttatacagctgtataatgcgtttgtgttttaagctaagtgttattacaaaggagtcaaaacattttaaaaattagaaaatttataaggtaaaatgttacagtaagataaagttaatttattattgaagaaagaaaaacttttaaataaattcagtgtaccctaagtgtgcagtgttgacagtctgcagtagtgtacagtaatgtcctaggccttcatactcacccaccactttactcactgactcacccagagcaacttccagtcctgcgagctccattcatggtaagtgccctttataggtgtccaatttttattatttataccatatttttacagtaccttttctgcatttagatacacaaagcttaccattatgttacagttgcttacaataatcagtacagtagaatgctgtacaagtttttaatctagaagcaataggctataccatacagcctaggtatgtaataggttacaccatctaggtttgtccagatacattttctgtgatgttcacaccatgacaaaatcacctaatgatgcatttcttagaaggtatctcgtcgtgaagtgacacatgactgtagatggatttatgatatacttaagaggtagaattggcagaacttggatctttgttgaaactggttcttttcagtgcagccctttttcatctttgccatcttgatagctaaagaatggcatcttgctgttgttttaatatgtctttcatttttttgtaactagtgagattgaacttttttcctccacatttgttgatgggattttttgtttgctttttttttttggcatatgtatgtgattgacctatttgtaatttttatttttattttactttttcagacagagtctcactctgtcacccagaatagagtgcagtggcacaaacatggctcactgcagcctcaacttcccaggctcaagggatcctcctgcctcagcctaccaagtagctgggaccataagcatgtgccatcacactgggccaatttttaaattttttgtagagacagggtcttgccatgttgcccaggctggtcttgaactcgtaggctcaaacaatactcctgctttggccacccaaagtgttgagattacagatgtgagccactgcacctgacctgtaatctttgtgtaaagtctttttcttatcagatttttaagaaaatatctgctcttcatatttacagtgtatgatggattttttaaatattctgtcccctgttgtcatttatcttttaggcttgtttatggagtattttgtctacaggtttttaatcataatttattgaaagctatggttcatatgtttgatgttatatatacgttaatgttggagacttcataaatgcttgtgaacttgtgaacacttttatgtataacttattttgaaccttggttctttaagtgtaacattccacagtaatatataatcaaggctttctaagagtaaagtatttatttgacctaatgcaaaatagccttggccgtgtttgttcaaatcttttatctattttacaaattgttttataatgcctttggttaactaatttgaaaacttacataatttatataatttctttacagttcagtggtcattgattaattgcaaggctctagttttgttatgttgaattatagttatggaagtgagagaagaaagctcattaaaatttagtattggctgggtgcagtggctcacgcctgtaatcccaacactttgggaggccaaggagggcagatcacctgaggtcaggagttcaagaccagcctggccagcatggtgaaaccctgtctctacaaaaatacaaaaattagctgggcatgatggcaggtgccagtaatcccagctactcgggaggctgagtcaggagaattgattgaacccgagaggcaggggttgcagtaagccaagatcgcaccattgcactccagcctgggtgacagatcgagactccggctcaaaaagtaaaaaataaaaaataaaaaaattagtataaagcaagaataaatatttgtagtgatggttttgagattagtccttctagaaaacaacatgctgtttaatttttaagcttttgtatttctttgaagtgtcctagatatggtcttgtatgactgcaagatagcttagatatgcagtatgtttgcatgaaaaactatggaaacaactaattgtagagtcactaaatgcacattaaaatcacatggatatagaggagagcacatcagttgatggctcagaaaacaggggttctagttcttgcaattccattacatagttttgtcacttggtcccaggacatctattggaagctatctctaagatgctgtataacttgagaagggcactgggatgagtgtgtaatttcacagactttgcgttgccccctggtggtattttaccttagtccaaaactagagctgtggtcactttacaacctgatcctgtgatccagtggtgacctacttcatggataaggattatcctctagggagccaaactttggtgcttttaaccagcagttagttaatagagaagctcagtgaaagtgggacctggaagtttgggaaattagcacatcttagttagaagcaagaagtcacagtcagcggtgagtggaaaggatgtaatgaattgattgatggatatttgttttcaaagaattaacgtaattgctgtcaggaaaagaaaaccttaatgcattaagggtagggactggtgtggagatctaggtagagatctacatgtgcttttcttaaaatcttttgattctttttttacctccaggagaccagcagaaggagacagggagaaccatatatgggagcaaagaacatggtgggcacgcaagtggtgctgtcatggcgaggaatgctcaaaggatatacatttaagcgccatgaatttagaatttatccctttgcatgttctctagtctgaaaatagtttgatcttttgtagctatctaaataagtattagaaatttattttgggaggtagacttgaacttgatttctcctatctgggcctgtgagttgttgctaattttgaaacttgatgttagtccctagggttgtgttccttaaattaggctttttacctcagtcactccaatttatttttataagcatactttggtagactttttctcagtgaaatggaaaaccattggttacccagctaatgagaatttataatcctcagtggactgcaaaacttaacttcattctgactggcatgagatggtatctcattatggttttggtttgcatttctccaatgatcagtgatgttgagctttttttcatatgtttattggctgcatagatatcttcttttgagaagtgtctgttcatatcctttgcccacttttttaaaaattatacttcaagatctgggttacatgtgcagaacgtgcagttttgttacataggtatgtatacacatgtcatggtggtttgctgcacccatcaacccatcacctacattagatatttctcctaatgttatccctcccctagccccccaccctccaacaggctccggtgtgtgatgttcccctccctgtgtccatgtgttctcattgttcaactctcacttatgagtgagaacacatggtgtttagttttctgatcttctgatagtttgctgagaatgatcgtttccagctttatccatgtccctgcaaaggacatgaactcatccttttttatggctgcatagtttgccatggtgtatatgtgccacattttcttaatgtagtctatcattgttggacatttgggttggttccaagtctttgctattgtgaatagtgccacaataaacatacgtgtgcatgtgtctttatcgtagaatgatttataatcctttgggtatatgcccagtaatgggattgctgggtcaaatggcatttctagttctagatccttgaggaatcaccacactgtgttccacaatggttgaactaatttacacttccaccaacagtgtaaaagcgtttatatttttccacaacctctccagcatctattgttttctgactttttaatgatcgccactctaactgctttgcccactttttgatgggatttttttttcttataaatttgtttaagttccttgtagattctggatattagacctttgtcagatgggtagattgcaaaaattttctcccattctgtaggttgcctgttcactctgatgatagtttcttttgctgtggagaaactctttagtttaatcagatcccattcatcaattttggcttttattgcagttgcttttcaccatttgacccaacatattacttacaccttttgacccaacatattacttacaccatttgacccagcatattttaccatttgacccagtatattactgggtatatacccaaaggaatataaatcattctagtataaagacacatgcacacatgtttattgcagtaccatttacaatagcaaagacatggaaccaacccaaatgcccatcaatgatagactggataaagaaaatgtagtacatatataccatggaatactatgcagccataataaggaattagatcatgtctttgcagggacgtggatgaagctggaagtaatcgtcctcagcaaactaacacaggaacagaaaaccaaatacctcatcttctcactcataagtgggagtcgaacaaggagaacacatggacacagggaggggaacaacacacagcggggcctgtcgggggtatgggggcaagaggagagagagcattaggacaaataacaaatgcatgtggtacttaaaacctagatgatgggttaataggtaccgcagaccaccatggcacatgtatacttacgtaacaaacctgcatgctctgcacgtgtatcttgtaacttaaagtaaaataaaattttaaaaaaaacttcagtatagttagtttttagaatatgttatattaatcaagaaattgtgttcttttctttcagcctatcaatttgttaccaacactagaaagtctccaacttaaaaaccaaaaacatactttaaattagttgctttttttttttttttttttttttggtgagatggagtctcactccgtcgcccaggctggagtgcagtagcacgacctcggctcactgcaatctccacctcccgggttcaagagattctcaacgtcctgagtagctgggactacatgctccaccatgcctggctaatttttgtatttttagtagaaatggggtttcgccatgttggccaggctggtcttgagctcctgacctcaggtgatctgcctgccttggcctcctaaagtgctgggattacaggtgtgagccaccatgctcagcctagttgcttttgattatctttgttaggcgtggtgactgggtgccccagtcagccttccaaagtcctcaggttatttatagtggccatgcttctgagtaaaaatcgtcagcacatatctgatcaagaatttgtaactactactgggtagcagaaacatgctaagagagaagtcatttagaaactgaaatattgcatcctctaggacattttgatggtgtatgagagaagggaaaaatatgtttgaaatctgaattgccttagaaaagctggagggaacgattattttacataacatgtatgtaaagtttatggtgttattgttctcatcacttctttagtgttaaggaggcactattgcccattacaaggttgtgattggaagtacaatcaaaactctacttttggatatcaggaacattgtccttgtgctttaggtcctcagtagctcttctggttagggacaaaagtcctaataaggaaggtcaaggatggagactagcccttctggttggggtgagatggagggaagtacaaccagaaagtgaaaagcaggatggggctggagcattcttcaagatcttcttatcctttttaaaaaaattaattagtgtggaatggtaataacagaaagtgtactttcagccattgtttttggacatttgatgaactttcagtctgccaactcatgtctcctttagttctgataatttttttaaattttctctttttagatttaaaatatttctaaatctttgtttgtttttttcttggattttcttgaactcctgctattcagatcttgggcttctagattgcttttttattattctcttctctcaattttccatctttcattttgtttcacatctgaaattttttttcaactttttctattgttcctattgaattgttcatattgactaggaatttacaggagctctctttttaaaattctctctcctttttgtggtaccatcttgttcttttttgataccttatgtctttgaaaatgttagtaatagtttttcatagtctgttttccaagttcttttagtttgtttgttttttatcttcatctctggcttttatatttattagagagtttcttcagatacctggtgattttttttcatattttaaagtaggcacaaataaaactgtttggaaactctttgcatgaggtgagcttgtttatatggtttcagtgtaagatgatcagtatccttaagtcttttttcttaaaatcttgggtatttctagaaaaaaattcatctgatcattaacctgcaagttattctgggtgcctaagaaggtaaaaggcaagggcagatcctacttaatctttttgcaactttcactttgtcccttgtttttagtcagataccactgctttcaactgtgtttaatgtccactactctagaaactctccatgtctcttttccagaggataaacttcagtattctatggtgtggggaagaggcagttgctcagctgtacaaagtgagaatctagagaaacttattaagtggtcttttaactccactttcacaccatttccaaggtacttgatgccaccaattcctcatacttttaaggctagaggaaatatttagtgttatgtaaatcagaatgcttctttcccctttgctggcttagggctccttgttttgggcctgccagatccgtcaccactgattcatgtgcttcccaacttccgaaatcgtgtccctgttttctcctcttctgttctcttctcttctgttctcttcgactgttttgatttcttgtccctttttttaaaaaagaaaatctttttactaccatttcagaggagtttttggagacagtgagatagaatgtatatgtccagtgaaatacctttttggaaatctgattcatctttcaattaactggattcagttttttatttcccttttcaccccccaaaaaagatgtgggtgctagattgttgagatccttggggcttgacaaaatttgtcagttgtctttatatttatatactttatttttttgctgatttcacttcctcttttgatctgcttttaacatgttgctctctcttctttcctcctgaagtatcagtgggtcacaggccagaggagagaacctagggtttctccgtaccttctttaaacacatctatctttaagaaaaaaatcatgtcttgtttttacattgtggtttcaattctttatttcatagcctcttcaaacctgttttatatgatcaaattcatggtttggtaaacttcctgtttgtcacacctggcaaatctccctcatggtggatcatttccttgtgtgattcataattttcaattatttgctcatcctcagcaaagattactttttccatgggagtcctatgaaccattgctttttgaagcgcctttaaggagctatttatatttatttttcttttatatttaccttaatttcttggcttggaaatttcacactacgcagatagtataaatctggactctgtatcattgtgtgtcagtttcatggatccagtttttctggtcttagagagattcttgctttattcaaggtctaagtttcagtcctctgccctggctgggatcttaagtccccaacccctagcagctagagtccaagtctgatatccctgtgggatataagtgttaacttgtatcttttctactctgaatttgagatttttcttcttttgacacatgagaaattctttttctttattttgaaactgattatggtattaaaatgtcagcagttatattttatgtagatttttatgtgcttgatatataaaggagatacgcatcactgggtccatgttctggaaccataagtcatctcctttgcattctcatttaattaggtattcaggaaacatctattaagtgtgtactatgcattaggctctagagattccaaagcaaatgaaaggacaaaggaaggtataaggtaggaagaatattccaggcagaaggaacaacttgcaaggtatgaaatgactggtttgtgtgggaatctactggaacacttgagtatggatatgatacaggcccagagcttgtagggcaaggctgaaaaatacaggtaaataaataggccgtgtcatggaaggccttggagctaagtcaaggcatctgaacatcatcttgagagctgtggggagcttaagcctcaagtgaagagatcagattatgaactagatctcatggtagtgtggcagagggttgcagttgagccaggctggaggcagaaactaaagcagaagcaaatgggaatagggaaaagggaacagtttgagagagccttcaagataggatctccaggaattcatgattagatataatgaatgagagagcaagtgaagttgcaaggggcaatcccgtgggccagattcagcttgcatgttttttgtttatttttgccccttaaaaaattgaactttaactgcactaggtatggcttgccctatcctgtttgccacagtcctgacgactgcatattctctgtgatccaggttgatttaatgtgcctgggttctgacgggtatgtgaacttgagagcctgatggaatgacttcctcgggcagcctttttagtttatgcttgcttaatcctgggggtatgaggagagacagggatgaggagggatcaaggagtggtggggcagggtgacctcgttcgtctgttctgacactggctctgccacctccccaacctgcagttgccactcctacccccatcgccagctcttgactgatcactgttggattttctgtaggaaagggaggaaaagaaggatcagaactttttctcccatagatgctttcaaaatcccctgctgctatgcccctactaaattccatgtcagttttctgatctttcttactccccagaagaatgcaggattacttttactttataggtgagtagatagaggtagttttagtaagctgggcactgtgggtatgctttagaatatggcatcaaagattcttaaaaagcagaggatagtaaagcacggcctcacccttttcctaagccatctggctttttacagttttaacttacttttatgatggattccagggcacatgcaatatttttattctagctaaatgaggagcaaattagaagaattttagctctcattttgaaaaagataggaagaagggaaaggaagtgagtgttgtgtgatagaaatagcctgtgttagactttcccaggcttctcagggcagatgagatcagtactgtgtgcatcagctcatgtgagagctaatggaatttggaaacattgattaggtcctccattcttgagtactgctggagtgaatccgtgtccaagttctacagattaactaggcaaatattaaaatagtcctgctggttcggactcagaggggcagttagtcagttgagtgggagtagatcatctcccgagtttttggtaattagtactaagaatgaaatcccatgggaaaaacaatagtgattagttatcagtagagctattatattagtttttattgtaatgacaacctgcagagtttttttttaaaggctttgctgttttgcagcagcctggatggatggatattgaaggaaatctagataatagaacaattgtaaagctaatagcttattgttttccctctggaatgatgggaaatatctgagactggagttgctttatgcacttggattcagatttcagcttcatcttttttggtggtttggcttgtacgcctggaccattatgtcttgggaatatgaagaatttgggaacataattatacacagaaagccaagattcctattatttagagaaatctgcaagctcattttatattttttaagaaagctaatgaaggaaacacgtatttttaaatttacaaagcagactacatgttcaaaaacatagagtatgtttgggggaaaaaatcctttccccttctaaatgcaagtaatatatgtttatcagagaaattagaaaatactgaaaaaaaagtaaagcagaaatttatttcataattctattacccagaggtaagggttaagaagttaacccttttttccctgtggatatttgtaatatgtgtttacaaaagtaatacattttgtttgtaacctgtttatgtgacaaagctataaatatgtattactatagatatggaaatacagtacagtctgtggcagaggcttggtattctgttgtacaatatatttaatcaatttctactctagagcttttagattctttttctagtttttttttttttgccataatgaatgattgtttagatttcttgatcactaaatatttacatatattctgtcacaaaatgactcaattggaggcttggggaaggggaggcagaattagctgatgttgctggtgccaggactctccatgaaatgtataaaacagtattatatttcatatcctcagtgaacaactataaacatgtccatggtatacagtggacatggctgatttattgtcattgtgtcatatctgttttgtctccccaaattctctcttttcttctacaacactgaggctactacgatggaatgggtcattttgggagaggtggggaaaaggggggaaactatcaattgcataagttatagggcagctactgagagaaatatatttcagatgttgtgaaatctaagtattaaacattattgaataaacacagtgtggaggagaccaaaagatgtcattaagtaaggctcttctaacagcctaaagtctaccagccaaagtggacaaaaaggcaaaatacatacactccagcaagcccttcttcttgtatcttagcaaagtaggtcagcacacacttacttagttcaaggggccatttcataggggatgattttatttgctaaccagagttggactgtggaattctgagcacagcatgtaatagcaatttaaaataagggacaatttaaaggttaaggcatcaaaagtaatcttctaaaattttctcaacagtagactgaaataaatgtgtaggtccttcagctgaaactatgtggctgttactttaaccatttttgttcttcaaatctataccattttatgaactcttctatttaactcttcaaatgctaaataacaaatctataccttattagatttgtttggagtaaagctatccaaattgaattagagaataattgaacacctatctcatgagtatttcagtgggctacattgccttaaaagatctgttaggttattatttactttttttgagacaaagtcttgctctgttgctcaggctggaggctggagtgcagtgacaggatctcggcttactgcagcctctgcctcccaggttctagcaattctcatgcctcagcttcctgagtatctgggattgcaggcatgagctaccacgcccagttaagttttgtatttttagtagacacaggttttgcccaggctggtctcaaactcctggccttaagttatccacctgcctcagcctcccaaaatgtgtgagccactgtacctgttctggttattattttatggaaagttccacaagatgtaaaaacttttatctgaacttgaagcttttacaaagaggcacttggtctgtttcataataaaataatatcaattcttgatttgtattgccctttaacaaggtaccccacaggtagttttgtgttataaagtttgagctaaatgctacatgtccgcaagattttgatcttcctttaagtcaactgtaagctttcagagtaaagtcatgtatatactccatgttacttttgcttttgtttttattattaaatgtatttattttttgttacatttaaaaaaaatagagatgttgtctcactgtgttgcctagactggtcatgaactcctggcctcaagagattctcccaccttggcctcccaaagttttgcgattacaggcatgaaccaccatgtccaggtgcttttgtttttagaggtttgatacgtgaagccaaaagtttggttcactataagtctaagagactacgcatgtaggactttcatcattcttttgtcattatcagcatttagaaacatctagaatcctgtagtttctcagtactttcttcactgatacgccagcttgtttgttcaatcttgagtccttcatgccttaaaaaatcataaaaattaaattattaatttcatggcattcattttaaaagtccatcgaatcgtcaaggaaagaataaattatattcagtataataatttcttacattttatgtattatgttttccaaagcactgtcaggtacatgcaaattcccttaactaatagaataagtggatggaataaattattccatactaggaaactgagacactggggttggagtacaggttagtgctagaacaagtgttagaattcagattttctgagcaattgccccaggtctcgttgcattgcagtattttgtggtattctgattcttgaaaacttatgttcagtgtgaaatttgcatggtaaattgttaaccctgtcttgtttctagcgagtgccagatgacaaggtagtataatagattatttgtgaataaggataaaaaaaatttataaatgatttatttactaattttggttagtaattttttttttcattaccagaataattgcttttacttttctgtttaaagacctgcttggctttgataattaactgtacatcgtttttaccatgtcatggcatattgtctgatggtttttataatattaaaggctaaaattggagccaaattgaatttagcacatttcttttttactaaattgaggctaaatataaaatcccggtaagcttagaatctataatgaacacgtgctgtttttctctgcttttttttttttattatactttaagttttagggtacaggtatacaatgtgcaggtttgttacatatgtatacatgtgccatgttggtgtgctgcatgctgcacccattaactcgtcatttagcattaggtatatctcctaatgctatccctccccactccccccaccccacaataggccccggtgtgtggtgttccccttcctgtgtccatgtgatctcattgttcaattcccacctatgagtgagaacatgtggtgtttggttttttgtccttgtgacagtttgctgagaatgatggttccagcttcatccatgtccctacaaaggacatgaactcatcattttttatttttttattttttatttttttatttttttaagagttccaggcattagatttattgttttaaaatctatattcattatatatgtgggtgtatggttttgattttttataatttttaaaacagctttattgagatgtaattaacatacaataaatttttttttaatttttttagtatttattgatcattcttgggtgtttctcggagagggggatttggcagggtcataggacaatagtggagggaaggtcagcagataaacatgtgaacaaaggtctctggttttcctaggcagagggccctgccgccttccgccttccgcagtgtttgtgtccctgggtacttgagattagggagtggtgatgactcttaaggagtatgctgccttcaagcatctgtttaacaaagcacatcttgcaccgcccttaatccatttaacccttagtggacacagcacatgtttcagagagcacagggttgggggtaaggtttatagattaacagcatcccaaggcagaagaatttttcttagtagagaacaaaatggagtctcctatgtctacttctttctacacagacagagtaacaatctgatctctttcttttccccacatttcccccttttctattcgacaaaactgcatcgtcatcatggcccgttctcaatgagctgttgggtacacctcccagacggggtggctgccgggcggaggggctcctcacttcccagacggggcagctgccgagcggaggggctcctcacttctcagacggggcggccggtcagagatgctccttacctcccagacagggtggcggcggggcaaagacactcctcagttcccagacggggtcgcggctgggcagaggcgctcttcacatctcagacagggcggcggggcagaggcgctccccacatcctagacgggatgacggctgggaagaggcgctactcacttcccagactgggcagccgggcagaggggctcctcacatcccagacgatgggcggccaggcagaggcgctcctcacttcctagacggggtggcagccgtgcagaggctgcaatctctgcactttgggaggccaaggcaggcggctgggaggtggaggttgtagcgagccgagatcacgccactgcactccagcctgggcaacattgagcactgagtgagcgagactccgtctgcaatcccggcaccttgggaggccaaggctggcagatcactcgcagtcaggagctggagaccagcccggccaacacggcgaaaccctgtctccaccaaaaacacgaaaaccagtcaggcgtggtggcgcgcgcctgcaatcccaggcaccgggcaggctgaggcaggagaatcaggcagggaggttgcagtgagccgagatggcggcagtacagtccagcctcggcttggcatcagagggagacagtgcaaagagggagagggaagagggaagagggtcattttttatggttgcatagtattccatggtgtatatgtgccacgttttcttaatccagtctgtcattgttggacatttgggttggttccaagtctttgctattgtgaatagtgccacagtaaacatacatgtgcatgtgtctttatagcagcatgacttataatcctttgggtatatacccagtaatggggatggctgggtcaaatgatatttctagttctagatccctgaggaatcatcacactgacttccacaatggttgaactagtttacagtcccaccaacagtgtaaaagtgttcctatttctccacatcctctccagcacctgttgtttcctgactttttaatgatctccattctaactggtgtgagatggtatctcattgtggttttgatttgcatttctctgatggtcagtgatgatgagcactttttcatgtgtcttttggctgcataaatgtcttcttttgagaagtgtctgttcatatccttcgctcactttttgatggggttgtttgtttttttcttgtaaatgtctttcagtttattgtagattctggatattagccctttgtcagatgagtagattgcaaaacttttctcccattctgtaggttgcctgttcattctgatggtagtttcttttgctgtgcagaagctctttagtttaattagatcctatttgtcaattttggcttttgttaccattgcttttggtgttttagacatgaagttcttgcccatgcctgtgtcctgaatggtattgcctaggttttcttctagggtttttatggttttaggtctaaaatttaagtctttaattcatcttgaattaatttttgtataaggtttaaggaagggatccagtttcagctttctccatatggctagtcagttttcccagcaccatttattaaatagggaatccattccccatttcttgtttttgtcaggtttgtcaaagatcagatagttgtggatatgcggcattatttctgagggctgtgttctgttccattggtctatatctctgttttggtaccagtaccatgctgttttggttactgtagccttgtagtatagtttgaagtcaggtagtgtgatgcctccagctttgttcttttggcttaggattgacttcgcaatgcgggctctgttttgattctatatgaactttaaagtagttttttccaattctgtgaagaaagtcattggtagcttgatggggatggcattgaatctataaattaccttgggcagtatggccattttcacgatgttgattcttcctacccatgagcatggaatgttcttccatttgtttgtatcctcttttatttcattgagcagtggttttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatataaaatcatgtcatctgcaaacagggacaatttgacttcctcttttcctaattgaataccctttatttccttctcctgcctgattgccctggccagaacttccaacactatgttgaataggagtggtgagagaggacatccctgtcttgtgccagttttcaaagggaatgcttccagtttttgcccattcattatgatattagctgtgggtttgtcatagatagctcttattattttgagatacatcccatcaatacctaatatattgagagtttttagcatgaagggttgttgaattttgtcaaaggccttttctgcatctgttgagataatcatgtggtttttgtcagtggttctgtttatatgctggattacgtttattgatttgcgtatgttgaaccagcccttgcatcccagggatgaatcccacttgatcatggtggagaagctttttgatgtgctgctggattcggtttgccagtattttattgaggatttttgcatcgatgttcatcagggacattggtctaaaattctctttttttgttgtgtctctgccaggctttggtatcaggatgatgctggccttatcaaatgagttagggaggattccctctttttctattgattggaatagtttcagaaggaatggtaccagctcctccttgtacctctggtagaattcggctgtgaatccatctggtcctggactttttttggttggtaagctattgattattgcctcaatttcagagcctgttattggtctgttcagagattcaacttcttcctggtttagtcttgggagagtgtatgtgtcggggaatttattcatttcttctagattttctagtttatttgcatagaggtgtttatagtattctctgatggtagtttgtatttagaacaccattataattttaagaaactttttagactacccttgatacaagcttagatctgtgagactattgaatctatttcagtgggagagccctaaaaagcattttgggtcttggtctagccccaaggtgactctttgctatgtatgagattttagaccaatcacaatctcactgcattttagtttacttatctctaaaacttagatatgaacgaagtatttctgtgctacttctgtgtctcaaattttgtgttattttgggataaagaatttatgcatatttttactcttatattattaccagttctgaaaaatgtctagtaatttgggctctatgttattttttaacattctcccaataatggattcagcatggcttttctggggatggtggcagttcttctctgagcccaggctaacatacagtcttctgggtctagatatgatattttgtctttcccttttcaaaaacaccacagtgtgtgaattcagggaagagtaacccttacctcaccctgtatagctgggctctggggtcttgggggtccactttttagcagtgacctttgaagtactgaatagctgtccaacagttcacttccatagcaatgagcttttccctcttttgcacaatttcagcatcagttgcaggaaaacagcatgtatacctttatttcaagtttcaaaacttgcttggaaaaataaaagtttatttgctcttgaaatttcgaaggctctctttactcgtgggtcagaatgattgggctttaaatatgtcatttgtaagtggcagcttcagtatatatttatgaagtgtcactgtggaccgaattgggcaatagataagaagtgtaggttgttacaagaagaccaagatatacttcctagagtaattagtagcttttattccttttacatgattgaatcctcccagcagtagcagcctgtgtgaaggtaggtgtattagttcgtttccacactactaataaagacaccccgagcctgggaagaaaaagatatttaattggacttacagttccacatggctagggaggcctcagaatcatggcaggaggcaaaaggcacttcttacatggtggcggcaagagaaaaatgaggagcaagcaaaaatggaaacccctgataaacccatcagatctcatgagacttattcactaccatgacaacagcatggaggaaactgcccatgatttaaattgtctcccactgggtccctgtcacaatacatgggaattatgggaattcaattcaaaatgagatttgcgtgggcacacagccaaaccatatcattctgcccctgtccccgcaaaatctcacatcctcacatttcaaaaccaatcatgccttcccaacaatcccccaaagtcttaactcatttcagcattaatccaaaagtccacagtccaaagtctgatctgaaacaagacaagtcccttctgcctatgagtctgtaaaatcaaaagcaagctagttacttcctagatgcagtaggggtacaggtattgggtaaatacagcatttccaaatgggggaaattggccaaaacaaaggggttacagacccatgtaagtccaaactccagtggggcagtcaaatattaaagctccaaaatgatctcctttgactccaggtctcacatcttggtcacactgatgcaaaaggtgtgttcctatggtcttgagcagccccacccctttggctttgcagggtacagcctccctcccggctgatttcatggactggcattgagtgtggcttttccaggcgcatggtgcacactgccagtagatctaccattctggggtctggaggatggtggccctcttttcacagctccactaggcagtaccccagtaggaactctatgtgggggctctgaccccacatctcccttctgcactgccctagcagaggttctccatgagggccgggcccctgcagcaaactttttcctgggcatccaggcatttccatacatcttctgaaatttaggcagaagttcccaaacctcaattcttgacttctgtgcacccgcaggctcaacacaatggggaagctgccaaggcttggggcttccaccctctgaagccacagcccgggctgtattttggcccctttcagccactgctagagtgcctgggacacagggcaccaagtccctagtctgcacacagcacggggaccctggacccggcccatgaaacaacgttttcctcctgggcctgtgatgggaggggctgctgtgaagaacttctgacatgccctggagacatttcccccattgtcctggggattaacactaagctccttactacttatgaaaatttctgcagccagcttgaatttctcccaggaaaatgtgtttttcttttctatcacatagtcaggctgcagattttcccttatcaaactgaatgctttgcttcccttatcaaactgaatgcctttaacagcacccaggttacatcttaaatgctttactgcttagaaatttcttccgccaggtaccctaaaacgtctctctcaagttcaaagttccacaaatctctagggcaggggcaaaatgcttccggtctctttgctgaaacataacaagagtacctttgctccagttcccaacaagttcctcatctccatctgagtccacctcagcctggaccttattgttcatattgctatcagcattttgggaaaagccattcaacaagtctctaggaagttccaaactttcccacatttttctgtcttcttctgagccctccaaactgttccagcctctgcttgttacccagttccaaagtcgcttccacattttcagatatcttttcagcaacaccctactctactggtaccaatgtactgtattagtttgttttcatgctgctgataaagacatacccaagactgagaagaaaaagaggtttaaatggacttacagctccacatggctgcagaggcctgagaatcatggcaggaagtgacaggcacttcttacatggtggtggtaagagaaaatgagaaggaagcaaaagtggaaacctctgataaacccatcagatctcatgaggcttattcactaccacaagaacagtataaggggaccacctccatgattcaaattatctcctattgggtctctcccacaacacatgaggagaatgggaattatgggaatacaattcagaatgagatttgggtgggacacagccaagctatatcagtaggtaaggtagttgttaatcctatttcccagaggaaacaggcttggcaaggctaaaggactttgtcgagaagggaagtagctggatagactctcaaacgcaggctccctggctcacttggctaatactctttctaccatagcacacacataagaccattaaattgtattgtgtaccacaggtattcatggtttaggaattcagggaggagaaaaggattatgaagtggagtagacagctaaggctttgcagagaaggaccttaaagactaaaggaagaatctaaacttcttgatgaatacgtagagaattccaagttatggggaagcacaggggttattttaaggaaggaataattttgttgtcccagttagttaatagaagccattaatttgtctcactgtctcaaagaggccctgatggggctcacctttgcaatattcgagttcctttgttagatatgtgcttgccatgcttgtaatgccagatggatacttgatggaccattatgaaattggctcctagcatttgattttttcctattttaaagttgattgtctatatacctgttttagtaccagtaccatgctgttttggttactgtagccttgtagtatagtttgaagtcaggtagcgtgatgcttccaactttgttctttttgcttaggattgtcttggctttacaggctcttctttggttccatatgaaatttgaagtaggtttctctagttctgtgaagaaagtcagtggtagcttgatgggaatagcattgaagctataaattactttgggcagtatggccattttcatgatattgattcttcctatccataagcatgggatgttttcccatttgtttgtgtcatctcttatttccttgagtagtggtttgtagttctccttgaagaggtccttcacatcccttgtcagttggattcctaggtattttattttctttgtagcaattgtgaatgggagttcactcatgatttggctttctgcttgtctattatcagtgtataggaatgctagtaatttttgcacattgattttgtatcctgagactttgctgaagttgcttatcagcctaaggactttttgggctgagatgatagggttttctaaatatacaatcatgtcatctacaaacagagacaatttgacttactctcttcctatttgaatgcgctttatttctttctcttgccttattgcccttttcctataggactccaatactatgttgaataggagtggtgagagagggcatccttgtcttatgccagttttcaaagggaatgcttccagcatttgtcctttcagtatgatattggctatgggtttgtcataaatagcagggacatgggtgaagctggaacccatcatcctcagcaaagtaacacatgaacagaaaaccaaaaaccacatgttctcactcataaatgggagctggacacagggaggagaacattacacactggggcctgtcatagggtagggggaaaggggagggaaagcgttaggacaaatacctaatgcatgaggggcttaaaacctagatgatggattgataggtgcagcaaaccaccatggcacatgtatacctaagtaacaaacctgcgtgtcagcacatgtatcccagaacttaaagtaaaataacaaataaataaatatttcttaaaaagttgattatctcttgagaggagattatgtgactcttcctctcatcagagaggactgaaataacactttggcctctgtctggtccctgtggttctcagggagtttcctatcttggctggcttcctgtgctgggcaagggggaaatgaagaacctaggtgaaaagcctgtgttcatctcccttgggcctcaacactccactgagaatatttctttagagttctcatacccatttcaagatgttgagggttcctttggctgttttcctaactctgctgagagtgtttgaagggaggccttgggtctgaggccaaggagttccccttttcttcctgaccttctgccagaactcccatttggcatgtgtgtcttcttgacactctctgggcagtactggtggcaattgaaattctttacggtggtttttaagcagtcagagatgtactttggttttacatttctctagagaatgcccatcttattctccttgcgcgtccaaattgttttacagccattttcattgtcaatggtattttcagcaggtttgttttccattaagccatctacacattactaggtcaaaggaatatttttgaagatattgagcagacattgattatcttctgagccctgggcatgtagatctatgggtgcttaacattgtagctacttcacattcactcgtaggctctttggggagtctagacagacacttagtcacaggaaggtgtgacagggaaagtgcacggtactatggatgctcagaagagggaacacccagtttgtttgcaaagtctgaaatatctttaaaagctattattgccacttgattggttgttatatggactgaaaaactgagagtggactctcagagtaagattgggactcccagagtaagatgggattctttctaaagtaagatttgggccagcccgagcaacatagtgagaccccccaccccaatctctacagatattttaaaaattagccagatacagtggcatgcacctgtggtcccagcttctgggaggctgagttgggagaatcacttgcacccaggagatagagattgcagtgagccatgattgcaccacagcactccagcctgggcaatagagtaagaccctgtctcaccctgacaagcaaaagattttgggattcagtagagatgagtcctataggaaaaggggcaaggagtaggacagccttgatgaagtcggcttgagaaatcctggtaaatagtttctttattggaggatttcctggaggttttaacatcctaatgcatactgctatccccaggagagattatagtatgtattcctaggcttatttggctatatattttttaaaagcttggaagattttatcagattattatttcacaaaaacatactcagggaaatagcatttcaagcccttaaatctccagatctttgcaacagtcatcatttgagaaaaaaaattagccccctggtaggtagagttttttttatagtgagatgtagtggacagtggctactggatataatagataatttgagaaagaaaaacaaaaggatatgggtacccaaagacccatctgaaaatcactgcttttagagctaggttatgtttcatgaactttcacatatgatttcttagttaaatatcgacaacaaccctgtgaaggaaatacttgattatcattatcttcattttagaggtgaataagctgaagctcacataatggattatgtatgggagatgctgagagtcaaactgtggtccgtcttctgccaaaggccacatttcatcagctattattatgctttgttaaggagtttgttaaggtcttttatttttaacttttcttgttttttattttgtatgattgtgataaaagtaatatatgcttattaaagaaaaataggtggagaaaagtagaaaatacctacagaaccatcattaagtataactgcagttaatatgtgatatatttctttccagttgttttatacaatattatgtaagttgagtatcccttatccaaaatgcttgggaccagaagcgtttcggatttcaatcttggggatactttggaatatttccagaatgcactcagttgagcatccctgatccaaaaatctgaaatgctccaatgagcatattctttgagtatcatgtcaattctcaaaaagtttcggattttggagcattttggattttgagtttcagcattagggattctcaacctgtgtaccatagttagccatagttacagttatatgtattatatatacacattatacatgtatgtttctatttatgcataaatttataaaattttgaatcctactttaaaatcttccctacagatgtgcatttggttattttcacatagttagtaaaatattttaataagtaaatccactgaactagaactcagaaacttaacttgtaactcttctatgcagactgccatttggccatgggcaagtttcttgacatttctagaactcacattcttcatttataaatgaaggagttggatcagatccttaatttttaaactgtgggatctcacagaacccgagaggggctgagattaagaaagatcaacagagcagtcaggaccttggcccttcacatgggcttcaacccaagcagcggcatttgtagatcttttatctatttgggacctaagcacatatggaaaaggggattcactgattttttttttttaaagaatataaaaatattaaaccagttgattttgaagctcagcaattctgtgagttgctgtatgttatgtacatttttaaacattcttcacgaggtagagtaagcaaatatattttattcttttaaattatctcaggaagcatgtaaggacaaagagaatacctggtctcttgaccaggttgaaaagtgtccaaagcactgtcaagttgcttcttagaaaatagaccattggaaattattattattttttttttttgagaaggaatctcgctctgtcgcccaggctggagtacagtggctgatctcggctcactgcaagctccgcctcccgggttcacaccattctcctgcctcagcctgggcaggagtagctgggactacaggcgcccgccaccacacccggctaattttttgtatttttagtagagacagggtttcaccgtgttagccaggatgctctctatctcctgacctcgtgatccgcccgcctcgttctcccaaagcgctgggattacaggcgtgagccaccacgcccggctgaccgttggaaattctataaaatatgtctcctttgacaacatccattttcagatccaattcaatgtgtgtcgcaaaagactaataaccaggaaatcagtagtccctgaaacgaatacatgtttgaaaactattaagtttaccaataactggttttctactttccttatgtatataaggctttgcgttttgagaggggtaatttggaagtacagcatcttgatattttctcttgctttcacagaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtaagtcaagtaaaagctctaagattcaatgattatgggatttgcactccaaacatctacttattatttataaatgaaatttatcaacttgttgggatcaaaacatactatttttttttcttttttaaacacataccctgttggactaacttactgtctggaagctttaaaagaaaatgttgtttgttgcctgttttatgcaagattcatacaggatgatgaataagatggttagagatgatgctctgttttcacttaataagaaagaaaactctcagacatcttcagacagtacaggctattgaacaacagatcaaccacctagtcttggttggtgttactaacccattaaataaatcgacagttggcctaagcactataaattggctgcatagcttttcccacacagagtcagacatctagagccttagcaatatgtatttaaagatgtttcacacagaattcagaacacctgttccagagtggcttgggttgttgggaaaacaataccaaagggtatgcctttgggtaggtgggaagtggatggacctgaatggattcccaccttctactactactacttaaaacaatatgtgactgttgcattcaaatttctcagagttttaagtaggcaactcccacttagttccaggtgtatccaaggtggctttcatatctgaagctctaaactcaacatggaccccctcagactggctgtttactggggttgcctacattgtcccttcactgatgtttgattttctccttagttaaaggaacgccttatggtttccatgaatgagggttggaaattggtttgttaaagagctgagtttctctccagtggagtgtgtttcatgatccaccatgtggttaaatattaaggaattcatcttacagcaagaaaacaaaatgcacactgagagttcatgctgaatgttctttgacagaaatgataaggtttttcctagtatgttttataacaactcttttttttaacctgataaattatatatctacaaattgaaataaaagcagttcctgacactttcccagggatggacggtcttaactggtataaagaaagccatttaactgatcagtgtttatttacagatggtttgacagtcctagagtttaagctgaatctgaaatagaattgttggtctgggctgcatttaatttggtggaagacgtttttttctgttcctttggttttaagaggctaataaataggaataggctttagaaatacaagatacttggagtttattaaatgcattatttttgctgccaaactttagttctgcttttgcctttttgacttttaaacttttttcctaaaatcccactggaacaaaataccagtactgtacaaaggcaaggtcaactcaaattatgcttcctgagttttccctgatatttgttgttttgtttttgtaagtttgctccttttccggtttttcatcaaaatttttaaattcaggcaaataatttactaccccacaatataactttgagtaagtcttaacagttacgaatcagaatctttcacagaactgtgacttttaagtaattttattcttataaagtatcctcttaaccataaaactaattttcttaaagtatattaataattacaattttcccaacaggaaattttcctcaaatctatttctctttaagctttatgattttgcgttttcctggtacttattgacaatactgtagtcatttatatatttaaattgctcaaagcaagaaaccagttgatttgacaaaattaactcagtgctggaatgaggcctcaggtgtgtccaacttgctgagtggtttgggtggatccttacatctcaggagcctcgtttttctcacaaacggaataatgacgtctcagtctagatgatttctgttgtcatatatatatacaactacattttattagattctaacataattggatgggccaattatattgaattttattagcttcagagcgtttgtgtccagaatgcatccaactaagtcctctctgattttcacctctggcgggatagggatgtgggaaatgaaagcagagtcgtcatgatcttcctaagcatcgtccaccctgtccttctactggggtccatcgctggtttcctgtctctctccctgtgacctctcttcagtgtatctggcccaccagacaggtaggaggtaggaagaaagatacagatgacacatcaagcagtgaagatggataaactaccttttcctggctctcatagagaaggttaaaatcttttgtagtatcagagggaccctttgtttctagttatttagttattgcattatagcagttttgtttatctggcattttggagaaattgatccttctggttatgggatattcttagcagagagttaacttctccctgtttttgtatttgactcttctgagtgttgaccccatccccaatctccactaggaggtgtgccacttaggagcctgttttatacgacttctccaaattaagcctatttggccagtaattcccaacagaatatttttactttgattttaaaagtcctggatcccttaaaaaatcagtctatccttcttatttcagtttcttctactttttagagaagaatcatgggatggaactagaggatcacttacttaagaaatgagatcactagaatttggccaaaaactcccagcaataaaccctttaaccaaatgtttgaggtgctggaaaatcttaatcttgaatttgtgacattgtgacatttggttctatctttatgttgtataaaattgtcctttactattaaacataggttttgattttttttgtacttaaatttttcctcctttcattcttaatgtctcccctgcatatctgtatgtatatatgtttatatatacgtaaatccacatgggatttccatgacctctcaaaatggaaagcaacaataatgcctgtccttgagaacttttttggtttttacaattgtaaataatgttgtctccccatttagaattggactttcaagccactgactaggaaaaattcctgggaaatctctgcatttgtgtcagacttcactgcaaaacaggtatcccttgttttaagaaagcatgataaagaacatattaaacttagagatttgatgaaggctgaagatgtaaggatttttcatgcatggctaaataatggctaacacagtggcacctatgtgtgatacgtgtggctcagctctactgggacatggtgaacacctgaagaagaaagccaaggagcaggactctagagtttccaagtcaccagagaaattatgacttagtgtggtggtcataggttcctcaaactcaacttgcatgaaaccagatttactatatttttcttccaactttttcttcctcgtatctggccagtggcatttcctagaaacctagaactcctcagttccttttatccagatagtcactaagttgtttccattctaattttagatccatttcttctttccatttctatttagaactccatagtgggtgctcagatggagaaccagctccttagcctgaagctcaagggccctcagcatctggtcccagtctctcctgccttatctctagctactccactccacagttttcctcaaacacattaagcccatatcacatttcattctattagttgtatatatgtctccttcattgctaaattgtaagttcctcaaggggaagaactagaccctattcatcattcacctttctatcccagtgcctggcacatacaaagtgcttacctgaaattcattcattcattcaactagtgtttattaagcagtataccatatttcaggcaccgatagaccctggggatgctccactgagtaaaggatcctgatgctttcgtgaagcttatattctggccagtgtaagggaggcagtaaatgaatatatgatattggctagtgtgatggagaaaaataaagcagtgcaaagggcttgcaagtgttggagagagtggggagaggctggtactttagattgaatgatcggaaaccagactcctctgattagaagatggttgaacagacatctgaatcaaatgagagtgaataccatgcatgtgtttggggaagagtagttgatgcaggagacacagaaagtgcagagttctggcacttacctgaggaacggtcaagggtccatgtggctgagttagctgggagagaaccctgatgcaggaggtcagtgaggtgttagccttgtgagccatggatggataaggagtttggattttatttcaaatgtggcagtaagccattaggggagaaggatatgaaaaacctggtgttttaaaagaatgaaactggtgtttaaaagaatgtggctgcattacagagactagggaagcaagagttgaagcagggggcctggttgagatgccactgcaggctgggcgtggtggctcacgcctgtaatcccagcactttgggaggcagaggcaagtggatcacctgaggctgagagtttgagaccagcctcacaacttggagaaaccccatctctactagaaatacaaaattagctgggcgtgatggcacatacctgtaatcccagctactcgggagactgaggcaggagaatcgcttgaacccaggaggcggaggttgcagtgagctgagatcgcagcattgcactccaacctgggcaacaagagtgaaactctaaaaaaaaaaaaaaaaatgccattgcagtagtccaggtagaagatgatcatgacttagactcagttaacatttgtttagtgaataaattttgtggaagggtaatgagaagggctgaactctttctagaagccatgacacttatagtttctaatcttttataatgacagggctgacttctgttgcagtatctttctcataggaggtttttgggggtctctgtgaatccttgatttgtatatggaatttgatggggaaatagcatttactaatttggggaaatctccaactttgtttgaatatattttatttccgagcgaaatgaagtcaggtatatatcttgatatgtgttttctaccatagcttcttttgggtcagacatttgcctaaaaggaatagcataagacagttgtataaggagaaattagatgtcacagggtatattagtcagttggtggtgaaaagatttgaagaaagaaaagaaaccattggacagttgggttatgggttggggtcaggggtagagagagcttagtggtaaaacattctggcataagcagttgcattgatttgtagagaggctagtaaaatggaaatggtcacttagtgggtgacaattttctctgaaaattgatcccatgccaaaagggaaggaagtaaagaagaaaaatgatgaccacagatcctgcttgggacctgccatggcatcaagttttagaactgtttctaggggttttgttaatcctgcaggaatgaacagatacaactttccagtatggcttttctgggattatatgctgagagaactaggatggatttttagaagtttactaacattctgtatttcatgtttggaggtcactttgggaaagactttttttttttttttttgtattttaacctttgataagccttttgggggccttatttgttaagtgggtatcagccaacataagagattatttctatagcattttcctctcttctgtgaatggaatctaatttccaagcataatctttgtactgattggcagttgcttttgtcagatgctaatctgtttttggtttgtgttttattcaatagactagattctccactaacatttatctttcattttaccctattttaatcccatcagtgtttcttttcacattaagttgattgaatcaaactacttaactcctcttctgttcccaaaggtagtttatgacccacagacactgtcaacaatttttccctttttttatgtcttcgatggttgtgattaaagttcttaaaagcatttgatataaagagcatttgatatgaagttggagggggaggtttctattcaatagaatttattttctgagttccggaagaaccttttcttaaggtcatttcactttactatatattagccatatactgtgggaccataattgtagtctttaatggagcttcagaacatttttatgtttagttatttaccaaaaattattggggactgtgtgctatggatatagcagcgagcagaacagttgaatgggggttatattctgggaaatgtttgttcttagagtgacatctcagtttttgaaaatgtgttgtctaaactccatccatgtatgaaactcatgaggacaaaattccctcatattactggtgctttttcggatacttacccattatttaattctctgataagctgtaatatttatctccagcaataaagcaaggtaggtgctcagggattacctctttccctcctttctattccctccacacatgtagctgcatcaattatgtgcttactcaaaatctgttttgttctgttccttttaatccatgtcaaaaattattatcctattcaagaggcaggttccaaactaactgattttagagtagtaagcattaatgtgtattgtatcatttgatacaatcaacccttaaaacaagtagtgttattctcctttctcagtgaagaaaactgagacttggagaagctattgacttgcccagaatcctacagtggcatattttgggcactgaaggctcttcattatacatccagtctataaatttcctggtattataggcatctgtcctttggagatgtatttttttttaacagatttagtgttgtagatgccacgtgcataggacagaataaaaacaaatgagttcagttttttaattatatattttatgtgttgggttccatctgggagacgtgcatgtgtttcaggatggatctgccaactttgatagccgtccatttttgcagttccccatagactgtagaaaatgcccttagctctgtcctagctctggaaccttctaagtgtggaatgggccctactcactactaatctgataaagcttcctttgctaccaacttcagtcacgtttctgcacttaagaccactgactaggcatgcccaaccttattcttttactttctgtttctagtacgttttctctcttcccttgattctgacctattatctatctaggctcagagcctgagctgagatcccattttctttcctttcctggggaccttctctgacccttctcttcccagatcatctggatctcctagcctcttgcaggcctcgctgtgcctcctctgtcttctttttgtttaccgagggcagtttttttggagtggggaaggacactctaaaggctagatgatggattcagtcccagattgtgcctcacctttcattctcatgttggtgaactggtggtcttctttgcttctaccttttctaatttacaattttaggtctcatgacctaaataatggactgagccataggaattatagggaaattgtagatttttctctaaagttagtaatcccagcaatttgacttgtaggcagattagaagataaggataaacaaaaagacaaaccaaattatcatctcaccagagataaatgatgctcatatttgggttcatataacttttgatatttttctgcatgtgctcataaatgagtactctgtgtacatgtgtatttctaaatggtatcattttggccttctcttttacagcatgcccagggattgtctatttccctcctctcaacaaaccatcatggatgtctaattactcatgatctgatttagaagtcaccacatctgtgtcccaccagcctgtcggtgccatgactgtggtggtgaagcatgtggttatactcagtcttacactggaagatcattcttgatttagatccctacagctgcctgctgactgagtgactttggccaagttacttgactattgtagtagcattgtttccttacctacaaaatgaaaattatagtttctataatgctgtcttgaggattgaacgagatgatatgcataaagcacttgacagagtacttggcatcctcctggttcccaagcccaccagtggcatttccattcctcccagtgctcagcccaaatgtgttgggttttgttttgtttttgagatgagatctcacttcatcctccagggtggagtgtagtggcatgatcatagctcacagctcactgtagtgtggaactcctggactcaagtgatcctctgaccttcctcaccacatctattgctggcataggtctaaccaccttcatcttttacctaggttattacctggtcttgcttccttttagtgggcttttagtacatttctcttcttccacctcatatggcattaaagccagtgtcctcatatggtgacctacgaggtcctcccagacctcatgccctgtactcccttgatgatcaacaaacaccgacacacacaagcctctggaattttctcccacagataacctccttgttgacccatcatacagaggtagaccttctctgaccaacttagcccccaattctaacctcccttcccccagtgagactctcacttagttttaccctttagcacttatctaacatgctctatattttacttatttctttacctgtgtattgtctgcctctttcactagaacacaggcaccacaagccaggatgtttgtccattctgttcactgctgtattccgcatgtttagaatagcacatgtatattcattgtgtgaattttaatagacactaaaatttattaagtgttgcacatgctagttactgtgcctagaattcaataaatgttagtgactgctggtgatgtgtctgttatgttttcagaaaccccctgttaaaaaaacagtgttgcttttaaggataatcccttagcccaagagtaaacattaattgttcagttctgctggctgtgactaagcaagcccctaacaatgtgactcaaggtggttaagttttgatgatgggaagaaatgaggagatctgggtgtgtatacgcacacacacacaaacacacatgtatgcatatacacattcgtattctgtgtatatatacactaatgtatacacacatatatgtacacatatatacatacattatttttgttgacagcctaaaataccaacacagaaatctaacaccttttgtctacaattttatttagcagtttctggaggatacttgattttaattctacataactatctcaagtagatagtgttgatgtttttgttcatgtcttatagggtagcatttttttctttacttcctgttacaacctgtatataagtcaggaagtaacattttaatttcattagcaaaaagagcagctgattcaaagtctgaaagacctgggttttgttgtgactctgtcattgacttactctctggctccaggctagtacttaaattcctcatacaatttccccttctgtaaaatgggataatggtatatgctaaacaggaatgttgttaaaataattagtaacaaaggtgtgaattttgtttgagttggattttaaaaagcaaaaacacatagtatatgtacagacacatttctggactggtgcacaggtatgtctcattttcctgattcatgaactgtgccatctaccctgtatgggtacctaggaatattaaatgagttctaaatctcccaggcaagcatttattttgattattttgtctgttctaccatgtttagtcttgctcttcatttgttttactaacctttccttagaattttctctcctaaagtactgaattaagccctggattttcctaaatggagtctgtagccattgagatacctgaggctgtgatgggtggaaaggccttacaggacaatgagactagaaagaagagagaaggatacagaactcacaggccccaatctccaggggtttgcagtcctggttggataatggagcaatctcagcaagtgttttgaataaaaatatgaatgcagaaaggatgcagagtgaagggatagtgagcatcagggcagagtaactctggcagatacataaaagggtttaagcaacaaacatttgtagaaagaagtagaaaaggacttcagagagaataagaattaaagctctagagcacaaaactgtgtagtgttgctggtactgccagtcatattacaggtaccatcataagtctccctgggactaaaagacaagaaagcacaggtcttcttaagagcgtcttctcacaaaaggggtgagacgtgagacatttttgttggtaatggtgattccagtctcactattaaaaaataccatacagtagaaacaaaatttgaaggaattgggaggatgaagtggctctgtccagttggggacatctggaagccatgaggtagatgcataggattatagcagacataatcatgtgagaggccagagaaagaaattgacaggcaaaagcaagaaattgagtttgtgtttagggaacaatgagtggctctttttgcccttggcagtgggattcacatctaggagaagacagaggaggtggaggcaggaggatcatttgagcccaggaatgcaagaccagcctgggcaaaatggcaagaccctgtctttacagaaaattttttaaaaattagccagccatggtggcctgcacctgtgatcccagatactcaggaggctgaggcaggaggattgcttgagcccgggagatggagactgcagtgagccatgatcatgcgactgcactccagcctggatgacagagcaagatcctgtctcaccaaaaaaaaaaaaaaaaaaaaaaaaaagacttaaaaaaaggagatgtcatgttgaagggagttgaagaaagctatgaggggagttgtcacaatccagggaatccaggtgctgtagcaaggaattaaggaaacaggttttagaatttctttggagttagttagcttccacagaatatgggaatgtgggggtgcagaatgttgtcaggagggctgtaaagaaattaaaatagaaggataggatagagaggagcaggggcttccttagagtaggggacctctctgagagatgacatttgaatggaatgtcagtgacaggcaagtgtcccaggagaaggcagaatccaggcagagagaatggctggctcagagatcctactcaaggcaggagggacttcgcaagctgtgttcaaagagccccaaggtcattgggctgagatagagcctggagaatgatagggagggtggccagagggcaggctagagggaggtagccagatatagggcctcagggtcttgggaaaagatttggattttattaaaatgagtttgacaaccattggagggctttaagggacatacctgtttaactgtttcaaaatagatgattctggcggttctaaacagaatggattttaggaagctaccttagtctgttcaggctgcaataacaaaatatcgtagactgggtgagttacagcattctggatgctggaagtccaagctcaaggtgcaggctgattagtatctagtgagggccaagttcctggttcataaatagcgctttctccctgtgtcctcacatttcagaagggtgagcccacctctattgtctattttataagggcactaattcagacctgaggaccctgcccttgtgatctaatcactggtgattaggtttcaacataggaatttgaggggaaggagacacaaacattcagaccatagcaggaggcaagagtggtgttaaggacaacaggtagaaagaaggttactgtggatgttcaggtgagatagagtgttgagaaatggatgacatttcaggatgactgatttaacatacgaggtggtaataagcaaatctaactgggcacaagactacaaaaaataatgaaaaatggacacatgtaattttagatagctatgtgatactagaataattttttcagtactttactaatatagtcattaagtagattttgaaatgtggctgaaatgggatgggatgttggctcagctgtaaatactcaaaattcagatttcttacacaatgtgatgcagtttcctgaatatttttgttttgtttatatttcagcttaaactctctaaacctcacttttcccatctgtaaaataaggatcatatccatgcattgccaggtggtcttaagaagtaaatgacacagagcttggtatataagagaactttggcaaaacaattgctgttggtaataccatgcctggggaaatacctcaatagaaactttgttttttagtagtgtggtcgttggctctaaacaaaattatttcatttttcaaccttatatattaagaaaaatatgactattctgatgcccattcttagtgctatttcatggcctttccagtttttttgtcacccatttctctgattcataagaaagtgatgtctttttcttccttttgctgttgaggaagctaatttctaaggaaattaattgagatggtcaaaggcaccaggtgagcctttgttaaaggtaaaactagcatctatgtaaagatacagctcagtgatgtattgtctgtccgttcatgttttacagctggaatcactaatcagagacctgaatcattactcttccataactgctccagagatttgagtctcccaattctgtgttagttacatgtgctctcccttgtgtattgcctcttagttttgaattgttgcttagttccactgcaccattgtcaagtcctatttatctctaaaagctaatagcttccagaaagagctaggaggccaggtctgggcactgaaagagctgtgtatgtcttcctactgtggattagttgaaagagacaactcatgggaaaacaaactttttccagtattttagttttactttccactatagtaattttttttaaccccttttcatttatttatttatttagggacaggtctgactctgtcacccagactggagtgcagtggcacagtcataactcactgtagcctctaactcccaggctccggcgatcctcccactgcagcctccagagtagctggaactacaggcgcatgccaccatgtccagctaatgtttttttgtttgtttgttttgttttgttttgttttgttttttagtagagacagggttgcgctatgttgtccaggctgatcttgaactcctgggctcaagtgatccacctgcctcagcctcccaaagtgctgggattacaggcgtgagtcaccatgcctgacctttcttcagaattttagatcattgtaccaaatgccaaaaacactctagtgctggtagtatttagtcaagttctgagcaatgtttttaaaaattaggaatataaaaaagcttaataaaatactagcatgtacttgacataacatgctattctagtaagtcttaataatgatctataaaatgttaacacttttattcatatttccttataatcaaattgaacagatacattttccttttctctcagaaaaagtaataatgagcctagtgctctaacacttgggagaaaaatagataaacgcgaccaaacacaagactctgaaatgatagtccttgccaagtgtgtgcagatgggaaactggcttcttttgaatgtggaaggagaggtgtatcccatgtgaggggagcaccgttgtgattttgaaaattgtactgtacatcttcttgttggcatctgcttaatttctagcaatatctcattaacatttcttttgtgagtttttgtaaagcacatcttgaacttttaaacctttaagtgaataagaattctaagtgtatgaaattctttgattaaggaagtgaacgcccagaagtgcatacaatttcttgaaacacttttatcctctgttaaagtttgttgtagaaaatccttgtttaacattatacgccaaagacattctaagcttaatttcaaaaatattaaatgccaaagagcagaaaattcttaaaaacaaccacttctaacttgtcaccttattgttaacattgacagtttcacatggaaatggtcaaatttcagttttcaaagtcatttgactctttcactttaagtcaaatagtaaatgtgactgaatcttcagtattttaattaaaacaattttatgtatttgtcttttctcatctttttatacctcattcttagatttttaaataattctgaaatcacttctgttggtacttacatgtaagtcaagtttgaaatatggaaatagttattggggtggtgtgtgtgtgagtatgtgtaccttttgtgcatcataaaataatcaggcaaagtgattttaagatagtaatctttagcaaaagcaataattttatttttcttcctctaaagagttcagcagatctagacttgaaagtgtgctgacttaggtgtttcttgtatagttcaagtgaaattgcaaataatttctgttcactttagcaggatggctaaggagggcattttcttttaaagaaagatgaccattatgtcttacaatgtagaatttactttggtatttcttttttggtgttcttggcaaagacatttataggctggtattcttctctagtatcgtccctctttatattatttaattgtgctttgtattttacttgaaattagaggcatatagattgccaagacagctttatgctgaataaattcatgtctctggaggaggcatacgcagcttgactaagagaaaataagcaaagatggcttctatcgtaaataattctgacccagtttcttaaatctaggtaaagagaccaacacccaaattctactcataaaacctaagtaacatacatgggctgtgcagatgtggataaaatgctagtataattgtatggttttttaaaattaatttttaatcacacaagtgacatatctttgtttctctttttaaaacagaaaatacacatgaaacaaattttcctctggctagtacacctcagtaggtatgcccatcctgcataagactggagctacactgtatgattataatgattgaatggccaagatcctaagaggaacacctgcccactgtttctaaattttccttgtttgggaaaatctgaactcctcacaaggttaaggaagaggagacccacagggttactcacatgattctggcctgtggtactacaagagagaggtagagagggaaagaatgttcttgttcaaaaatacaccagactttaatgaggttaagttgaacaaacttacatggaatttttatattaggagacgttatctaactcaatatacatgtgtatgtatatagatagatacaaacctacatgtatatatcaaataattttgttagaacctaataataataaaactatttctaatttttgcttatatttttattcatctacttaatctatacatttgatacctaccatttgtacctactatatggtaggaatttttcagacatcatttctaatgttgttacccctattttacttcttaggaagttgagattcagagaagtaaatgtgcatcccaagctgcagtggtagtcaaggaatgggatgagattgaatgctgtttttccataggttcgttcttggcatcatgttgcctcagagaatcagtttctgggatgtacaactaaaattgtttaatgtctttgactcattaaatggcataaaagttttaaattctcattctaatatcattctgattttctgaagatcttcctttgatgacagcaaaaatactcactaaatgtttaaccacagatactgagtgggttctggccaatcagcgtgggctccacttgtatgtccgacagttgaacgtcaactcaagtttaaggcctcatgaagcctaattaatagcaatataaaccagtttaagcacttttggccagttaatatattttttaaaaagcaccacacaacgttattctcaaaatctttgtcttaatctggtattagccatagttacaacattctggtttcaagttctcaagtagtttttggggtttgtttttattgagtcattgaaaaattacagtaaatgaacctacagaatttcttgactgagaatctgccctgtttttccctttttctaggtctattattagcagaagatttttctgcatagttggcacgctgtacctgtatcggtgtattacaatgtatgtaactacactcccagtacctggtatgcatttcaactgttctccgaaggtaaactattcctcgctgtaatttcgctttctgtttgtttcttgtcttgccctggggtcctttgagtgaggttgcaggaaaacgtttcttcagaatacagtggagtcactcctctatctgagaatgttactaaatgatatggccaggcagccccacccttcccagaatctctaagccctgccagtgcctcccaactggggaaatgtgtgttggaagcagttaagctttgtgtagttctttggtttcctgccaaattgttaaaatatcattcatttctttgacacgcatccagaagcttttatatgcttcctctccctcggagggagagctcgatttcaagtgacattttttccattttccttctttctattaatccctacagcagagccaggaagagaaagtattcctatttccttgcagtcctcaaccaagccaaataagatcactgttctctggggtaatatattgccttattgattttctctagtaacaaagaagtctttttaaaaataaactttattcctctcttattgtctctacctttccatcagattcaaatgacactcttcacctcctaacctttaccttggaagaatttttaactagggtgatcgttggaactctgtgaaataattagcagattttattgttaaaatatttatgtacattaaagctctttaatgaatttttaaaagaggctaatttctctccttgatttttggtgggagaaaatatagtatactctgatgtatttgagatcatttctttgcattatacctgtgtgggtgaaacagccaaacactttcagtctcattgctttgtacttttgttcctccagaagagatgttctctttgatagaatctttggaaagagagctgaaaaattcactctggatttttaatttgatcatatgaaattttggatctctttaatttgtatgtctcctgtggctcttttctttgctaaacttacatatgtgcctacagagatagctcatttcttacttaactttttgctttttttaattttttaatttttttaattttttttattttttgctacacactacttccttacctctggaagagctgtcatacaaaagcaatgttctcaacattccactcttctctatcagccatcctgcctccctgcactctccttcttgcagtttctttcgcccttccaaagaagccagcttcacatcgtttttattgtctgtaaaagctctcaagcactcacctgtagctcctgggttatagggaatatcttgttgtcattgaaaatccaaggatatggactcttgctgggagcctggcttgataagcagcatgttctcagcagtaaactgacagtttaggatattcacctaagtttaattcagctccttaaaaaagtctgtgcattgggaaattttgctaccaaggggtaggtagatgtaggttctggccaagcacatgttgaagatggatccagtattgaggggccgtaccatgtagcctttctccctactctggttctaaacttgtttcttcttgaggactactgtagctccgccagttgctggcaagcccatacttggtgagccattggttcttacatagtcagcttgagtcatcaacatatctaaccaaaattctttgcctaagaatagcttgtgggttttcttcgtaaacacagaagtagcagcaggaactgttcacaaaagccaaactcaaacgtgttgctcatttattgtgttgccagaaatcccaactagggccctcattctatgaggatcttctggaaactagaatcttaaacagtaggaggtgaaatattagcacaccttagaaaaaaatactagttaaaactcattaaatctaattactacaaaatctaattttgtagaataagactcttggaagaaaggatttagaatacacttttttattctgaaaactttcacatgtatcccaactgctataaggaactcccataaacccaacactcagattcaataattatcaagatttgcaacatttgtttcctttcttttttctttttgaagtatttaaaacaactcccaggtaacgtcatttcacctccacatactttagtacgcatctaaaaactgtgaacattttagtacaaaaccataatgctattggtgttcaacaaaattaatagtaattctgtgatatcagcaattacaagttgatgcgatatcctgattgtcttaaaatgcttttcctttttttacagttggtttgtataaattagggtccaaaatctttatattacatttacttgttctgtcttttaagtctataattctaaagcagtcctttcttcctttcacccctctaccagtagcctgtagacattagattaatagtcctacagaatatcccactttctggatttatccatttgtttctttgtggtgtcaagtgacttgtgtcgctctatgtttcctctgaatagaaagttggctctgcagacttaattagattcaattttagcttgttaacagaatatttgccaggtggaatagaaagacttctgaagctaggcacaagagttgggaaaggcttcgaaggcttggtgctgcctcttggatggcagatcaagcttaagaaattcagtggtcaggcaagggctagaatcctccactgagaacgagtatctgaagacagaaaagggtgacactggagagaagcctcagaggacagctttgcctactttagaatcatacctagggctaagggaatcagaagtgagaggaaccttattaaaagtcactcaggccaaagttctatttgatgtctgaacatcatcgccactgaatcttccatctctctctgaaccattgtacagagagggaacttaattgcccctgtaaaaatacaaacttacctaatagtaaaaagaacactaaagttaaggttaagacagtcttacacaaccacttactagcattgggcaagtcatttaacttttcagagcctcagttccctccctaaatggcaaagcagagctaatgatgctttttgaaatctgtcttaaggagttataggtgtggaaggagacagtttctaggggctctgtgggtgtaacgcactatacagaagtaagaagaggacttagtattgtcatcatgcttcaacccctagactcttatttatccagtgagaactgatttaacaaacatacattagggacctactgtgctttgggtgctagagtatgaggcatgaggaaggtagatatagttcctacctttgtggaaaacaccttaaaatctgttagtttaaatttgtaacttatgtaataaatgtgtaaaatgctgtgataagggcctcaagctaagctactggccctaaggatggatggagaggaagaaacagacttgagcaatatttaagagaccaaattgatacaacttgataatagatttcatgcagggaatgagaatagggaaagattccaagggctggattttacactggtataatgacatggtatagaggaaatgagagttaatgagttggattaaacacagagtttaaagtatctgtgagatatctaagtggtgatgtccaagatagttagcaatatagtctaaagctgagggaaacatcaggctggaaaataaatatttgtgaatcatcatattctggatggtggttaaagctgtggatatggatgaaaaggcccagaaacaagttacagaaagcacagtgcttccagaattggatattctattatttgagataccaattaaggcctgtcacttggtggatactctgacagttactcaatatcactaaactgtaagggaggagagttgagctttagaatatgacttcctgcttaatacagtcatgtgaacttaaacttggtttcactatgccattaaaatgctgtaattagtgtacttaatgcttcccttaatgccagtactcaaaatgtgcagctcctaagaaaaatgtttcaacaagtatacagtagtgattataaaaattggtcttattgttcattcactcgatggcagtatactcttcacaaaatataatcgctcagagaaataataatcctatgagatgatcaggctgtgaggaaaagtaggcttcccataaatgtttctgcagcaataataagccactgggaaaaggaagtgaaaagggaagtggatgtgttcagtttctagattgcaaatttctggcatatcccatggtggtatacatgtgcatggcttacactggaggctgccaaatttttgataccttgattagcccatgttactctcatcatagctccaaagaccgtgtgttccatcctgaaaacaacctcttctcatctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccctcttctcatctttttacaactgtttatgatactggtttctttagaaaaggggcagaatatttgagaattctttggtgttgtaagcttcccgttggtaaggtttttcctgttttaacaaactccttaaaataaaaaatcccagataaacaggcagcctaatgctaatagaagagaagaaataacttgcactgttttcgactctcattttcataatcagatgagttaatctaatagtgactaaacagtaaaatgagatgcatgtttgggcgtgttttgtggtctccatggtgaccttagatttgaaaacctttgagaagagagagagtacattaagacagggacactcagctggctagtgcattaatccaatgtggagttttcagtgaaatgattctcttgaacttgaaaaacatgttttgttttgttttaatttttgcctctgacataagtgaacacagcccatttttggacagggttatgtctgggtggcatctgaggttgatcgctcagtggatcaatataatacaaatgcaacagcagaacagccttcatattcttctctgccactgtcagcttttctgcaatgcacagattagaaagatgaaaccacctcctttgacttgctgctgaactgtaatgtcaaccatcagcctaacgggtccctatgctggcacaagttcagtcttataaggcaacagactcattgctctttaggatgttatggccttcttcagttctttcttactttcctgagtagcagttagagtattccaggtgccctctacactgacaaagtttgatattctgattagctcctgctaaccttatcagtatttcaggatatggcttgtgttccattaccaaaataacttcctgccatcctgttggatggtgtgcaacttaaattgtcaatgcttgattttggataattttctgctggtcttccagtttctgattgtcattaaaattttccttttcgtttgttctcaattcttttttttctgcttcttgcatatactttccagtaacgtttcccatcctaaatctgttctttgcttttccttttctctcattgctgctgttctcttcctttttcagtgattaaagatagcaatgttctaaataacttctctctgtcacttaaaaagagatgttttcattttaaataaaccatacattctttaaagatatattgaaagactacaaaaagaggaagattttagaaccactcatgaccctatctactattaacaattcagtatattagttccttatgtatgcattttttacatgattctgatggtgctgtctatgcatttattattcatatctccttatatttaacatttgatgtatgaatttttacattattgtataaactctagcctttctaaaggctttcttactaaaaggaagaaaccactttcccagaatgtgagacaggcagattgttgatgtgatttcatttgatagtcaagaagcttgtttatttcctgagcaacgtttctagagaacctgccctatgtgggcatactggtaaattttgaggacacacaatatataagacaagcgccttctccctctgggcatccagaagctgtgaaagagacagaaatgtaatccccagatccccctctgactccctgtagtagatttgcagagccatttgccatggatgcacagacaccggaggcacctctgctgggagcatgagctgccctgtggatgtgcctctgagcccaatctcaaaggaggaataggagtttgccaagtggagatagagggaggaagggttccaggtggaggaaacaacgggtatggaagggaattggggaataaggtcaagttagatgtatctggacatgggatcttatggagcaagtggccagagatgactccagacaggcagtcaatcttgtgggaagattttaaagggccttgacacccaactaaggagtcgtggttctatctataggcaataggaagccaggaaaagttttagcaggggcattatttgatcacatctgtctttagaagcatctctctccattgatagagatagtagggtatttgggagggaaggagggaagtagacttaagtagtatcaaattatatgcacctgttttgtgccagatacgaattcaaatgttgtgtttttatttaatttttataacagtgagtgggataaaattgcagttggttcagagttatgtgaccagcctaatgtcttataggtactgagtggcaaaggcaagaagactagccaagtatctgttcttggtactcacgtgagggagacggatgatgcttctgcatggatttctgaattagagatgaggaaggcctagaccagggcagagtgggggacatgtttgggaggcattgggaaggtgagaaagatgatccacatggcagaagccatctggtatgaagaggtaaccagagtcagaaagcattcactggggaattctaaaaaacctcagagctaaccatgtatgactctaaataactaatatatagttactaatcataaaactaataagagaaattttagaaataaaaaattactattttgcaaccactacagtaataattcaagtattataatttagaatcatcactggatgctaaggcccttgtgtgaaaggttggcgatcataatatttacataattttaaaaaataacagattgcttattaattataaaggggcaaaggtatgtatttagtggagaaatacagtagacactcgcatagtcaagtgaacaaaccagtagaaggacaaatgacatcaggtgcttctgaatgtgatgcactgagagggatacagcatcatctcgggaatactcctgccaacagtgtttaagctggatttaaacagaaggcaacattcagataaaaccaaatcaagcaatattctataaagaaactggattggactcttcagtgtcatggggaaaaaaagactgacaaactgtagtagactaagaagaaatcagggcatgataagtaacctcaatgtgtattctctgattggaacctagactggggaaagaagctctaaaggacattgttgacactatcgagtagtttgaatatggactgttttttaagtatggtagtattatataattgttaaatttcataagtgtgattttagaagagaatgcccttgttactgtgtttagatgtgaggtgttttaatttattcgacttcttcccaagggacccaggaaaaaaagtgagagaaaggagaagaaaatgtgatacaatcttgataattaatgagccaaaatgaagtgtctacaggtgctcacttgctactttttcacatttataatttttcaaactaaaaagccaagggcaattttttttttttttttttttggtggcaaatctcacttcctgaccaggtagactgaaggatcctccaacacttaaaggagatgtgattttgttaaagggaaatcttgcctgactgaaatgctggatttctttaatgtgacaaataagaatatgggtaatagaaatccatagctgacctttatttaagattttatcaagcctttgataagtcttccggttagagactacaacaaaatttaaaagttttttttgatggagggaaggaggggctggtgggagattagtgttttattgctgataattgcttagagacaccccctatccctaaaacaagtctgcctagtataggaattgatgagtacatttgagaatggagaaatgtagacagccagattcttcacagccgagtgaagggaaaagtctattttaaaagttgtatgtatgaattctaagaggagtaaaatctcttgtcctttagatcagttgtggtgggcataatatttgtgagtaaaaaccacatctttccaggagtggagtgattactatatgtatagagaacacataaaagtctcttgagtgatcaagagatggccaccagtgagcgtccggcagggatctatatttaaggagaatcatccagatttcacttgctgactgttaggcattgagttctcccttaagaaccccccaaaagatggacctaacttggattgttaagtaatgctgcctgaaatttgtataacactttattttagcaatcacttttataaacattgtcttgctttggtgggtagaggttgaggatgagaaaatgttcttgccattttacaggtgagaaaactgaggctaggatggtaaaatggtttgtctagagccacctgcatggtagcccaaaactgcagtttgaagttggattcatgctcattgttgttcctataaaagtgagcttggagaccagtatagcacaatataaagcaaggaaagttaaaatcaattgggaatgctttgtttaagaagagagaaggcagaaaatgggcaattggtttgtgaaagaattccacagaaatgatttttataggccgggcaagttggctcacgcctgtaatcctagcactttgggaggcccaaggcggtggacattgcctgagctcaggagtttgagaccagcctgggcaacacagtgaaaccctgtctctactaaaatacaaaaaattagccgggtgtggcggcatgcacctataatcccagctacttgggaggctgaggcaggagaattgcttgaacccaggaggtggaggttgcagtgagccgagattgtgccattgcactccagccggggctctcaagagagtgagactgtctaaaaaaaaaaaaaaaaaagaaagaaataacttttatagagacaggggagcttgatttaaataaaaactaagcttacgaaaaatagttagtgaatagtgaataaatgttgttttagctattcaatcgtgtattaataaatgacatatttaaaattggttaaatttcattagaacaacaacaagaacaacaaaaagtaaacctggagaaattgtccagccttgggtattgtccttgttatttggaaaggtgtttgcaacaatagcaggtgttttccagggacctaaaggcaagattgtttagctcagaggtaagacatttgggctctgaacccaactgagtcactctgtgtgacctcatgtactggtcggtaagccactcttttaaatgggcatagtaacaactacgctcaccaactgacaagcttgtgaagatacagtgagataactgatgggaaaacactgctaaaatgttggaatctgtgtacaaacaaaagatattgttttattttgtaaaactaccctgtaagtcatgtttttactgaccaacagtaaaataaggccggagaaattgtaagaggcagctttgagcctcttcattgctgctttgaaatctaaagcattcatcacactttcaaacacattaccttcctggtggggactacaaagtcaggctaaaggacatttcataacttacaataattctgctgcttgattcctttatcagatctggtctttgatttgagtgtttaagagcagcatttttggcatttcatggatgaaatgaattttctgttcatgagcacatggtgttagcattgaaaaatacttggggaaacctcttttttcatagccaaaagctcactagttctaagtgtcacggttaggagggctgttacatgccagttgaaattggggaagtggcatagttttgctgttttgggccacttgggaagttgatgttgagggacaccacagtgtgtaaggtgtgtttctcagttgcaggctgctgaagatgcagattgatgaggattctaccattcctcctcctgatcctgttacttgattcgtgtattggatttggtctttggtctgagtgttttaacagcagcctttttagcattttgtggatgataatgaattttctattctggaggaagactgctctttgggaacagaacaaaataatttaccttaataggagggagagagggactttgagaaaatgtctggctgttcatggtagttggaatagtataatattacttctgcaaggtacctaggctgctgaaggaaaagttcctttgtatgtatcaagttcctggtttatccaagcttgtgagggccaagctgtgcacaaggcagcatatagttttgtaaatagcacatttaaatagtcagaggacttggattctaggctcggctccaacactggagacctacagcagatagggtctgccttgctgactttcctgggctgctctaggctgcagcattagcgattgtcaatgcttattttaaatcgcatttctgctccttagtactcactttcagctcttcaacaaagctataccaaagctgtcaaagctatgaaagccattaatttgtgcagcattatttgatgggttttagttctaggttacccccttcctcctaatggggctgaagtacagtcagtgcccctgctctgcaaatgtagttagaaaaagccagtgctctaagccatctgcaaactgaatgatggcaaactgactgtcatcagtacattatgttagcactgaaaaaatactgggaaacctgtgtctttcataaccaaaggctcactggttctaaatgtacctgatagtgtgtctcattcaaaagcctttccctcttccttctgctctttttttctgtgctttggtattgtgtaagtgatttggccaatttacctaatttcttggtagttcattagaatttgaagaatattgcctgtttttactggttattggttttctgtgaccctgggaaaccataatgcacatagtggtgtagatatgagactttcttgtcacagctttgtagtatccactgaaagtttttatgtctcccttaaattatctctgctttcaaaaatagacattcaaaagctactgataggcaaggtttcaattccagttataatggagtaagcacactccatctttctttcacactgaatgcagccaaaaaacactgggcagaatatatggatcagctatttgaggaatcaaaagcaaatgatagtgggcagatggaggaaggaaaccaaaatgcaaggtatgaaagacccagtccagagtttcctgtttcattttgttcttttcttttcttttttccattcacatttcctgcctgatttcaaaggcagtgcacatcccagaattgcactctgggtgcagacagagctccaagggaatccctctctttctggccaaaggaaaggaagggaagccacaccaggacagagagtggaagaaagcctaccaatttccaagctaaccctgttaacatttaatatgttacattctagactttttctgcacatagtgtttgtaaaacagttataattataccaaacattgtgtttcctgtttttttctcttaatagaggaatatgcttacaatctagacttactatacagtcactgtaaacttatttttaaataatttggtaaacagctgtaggctggttcagggcttctcaaatcttaatgtgcatttaaattaccttagattctggttcactggtctaccttgggacctgagaatgcatttacagcaggcaccccatcttgccaatactgtccctagaaagaccaggttttgaatagttatttaacagttcccatttaggttgtttccagttttttgctttcttttttagagacagggtctcactttgttgcccaggctgaagtgcagcggtatgattgtagctcactgtagccttgaactcctaggctcaaaggatcctcccaccttagccttccaagtagctgggactacaggcacatgccaccacatccagcttacttttacattttttgtacagacagtctcgccatgttgcccaggctggtcccaaactcctggcttcaagcgaccctcccaaagtgctgagattacagaaatgagccatcacgcccagcctgttgcttttgtgattagtgttacagtgggatatttttgcacatagaacttttcttcatatttggtattatttctttgaggtagactcctagaagcaatgtgactgggtcagaagttatgactgtttaaattgctggtaaactattggtgattattttctcagaagattttgccagtgataataaatatattcttcccaaattgtagatgaggaaatcgaggcttagaatggttcagctgtataaggtcacacagcaaatcattcgaagagctgtgattttacccgcagatatctgtttcgtggcctgctcttcccctgcactactttggagacagccactgcttccccccatcccctccatttaaacaagcctcgccgtccttgtgcttgcctcaccattagctcactcttttttcttttaagctttgctaattcaacatgggaaaatgagctcctgttatgttcatttttatttatatttgtttgacagaatttatgcctctatgtggtcacatcccttgtcctttgataagttttgtttcctaagttggtcttattttacttgatttctctgtgctatgtaaacaatatagatattaacttgtttctgctgcaactgttttgtaatttgtcttgtattttgtttgctttttttaaacataatttaaatttttctttctctttttctatttctcactaagcttaaagaggttttccctttgcagaagtttgataaacataggaagatatttttaaaaggaagcttagggtctctaagggtacctgtaagaaatacagcattaaatttttgcctttttcctcagtgccaggtttacttcataatttctcctttctgcccaaacacattgtttcaccacaaagattttcttgctcaaatgagaggacaaagtatgggtgatgctgccttgagaatatgatttatcatttttaaaacacagagggaattttagaaaagcattatgaaataatgtaaaatgaagaaatacccaagcttttttgccataattttcttctacattttatccattgttataacagaactggaccaaacttttaatttgaaactttaaaaaaaattataatgtttatgcaggcatgcaatttgaaaactaaaatggttctacacaactcgatgtgaaaaaacagtagtctcctggtcctgaccccaacagcgccttttcctattctccttcaactcttttagctgaaccttgtggtatttaactctttgtcattcactcttttttttagattttttaatgtgtttacttttgtgtctccacgtgacatgagatattgttactctgtaatttttgaatataggcattcaccgttactgacttctgctgtagaaggcaaagctttagtgtccgtctgtgactcctccttcatgatccctaccctccgaccccatctccactacacacgttcaagtttcctatcctgtctttgctgtgcagttctttgtccttcgtttagctcaatatgcagtgcttacattattacagttctgtaaatgctattcatggccaagtcatgtcgtttcctagaattactttccttctctgcacaacattttgtttcctgtagagttagtaattgccttggttttttgctttagtagttttctttgcacttactcacccccaagttatgaaactcctctcaatacagccagaggcattgggtattctgttgggctcatctccatgatgacatccctccagagcattctggctgtttgctttccagcccaaacttgtgagctactgtgaagtccttcatctctccttttttggcatcgtagtgagtcccatttcttcttttctccatgtttactcccttgttttggagactgtaccctctgtgattcctggaaaagagtatataagcggtaaatatttttaaatcgtgtatatatgaaaaaggctttaatttatccttagtttatccttcagtttatgcttagtagtaatatggctgggtacagaattctaagtgggaaatcattttcccacaaaatctaaaggcattttctcaaagctttctgtttttcagtgtggcttttgaaaagtcttattctaatgatccttcatgtaaagcttgtttttaatctctggaggctttagagtctcttcttagtccccagattctaaaatcccatgatgctgagtcttgatatgtagatctgttttcttccattatgttgagcattcagtgatctctttggatttggaaatttatatcctctgtgtggtgtgctccatctgccattcttttttttttttttttttaatttctcacacttcactgatgtatcatccttccatccttaatcagaagtcttgataattttttaaaaggaaattataataaaacatgttgcccaaagctagattcttataagttaaatattgaaatcatggtaattaaattggacaaccagaatttaattaaattggatcatggtaattaaattagacaaccagaatttaaaagagtactaacaagcataaaatatagacagttacacattttacttgaccgagcaaataaaggttgtaatgaatgagttgttcaagctatttattactccggtgtccagcccagacttgtatcatagacaggtaaattaatttataatctggaaaattattcaatgttacctacataatttgagaagattaaaggcacatcccttgtttcaacatgatccctgaacatccacataccaaaaatattcatatatttgactacccaaaccttcagctgctttagccaagtgtagtaggacagttgtcttctaggccaaccatgataaaaatacatctttaaatttttcctagactacagatttaaattttatttttcccaaatgatagttatactaaagcaattattcagtcagtcagatagaagtactgtttctctgtcattgtaatttttgaaaaactggggaaacatctactgacacgtgctttaaaaagtgctaactgtgaaaagtcctgaagccacgtgattcatttgtaggaccatcccacccccccgccccaagggctactcttggaatggtaaacactgagtgggcaaacttcctggtggggattttatgtttcttaatataagcttaattctggatatgaatagtaatcttcgcacattttcatgtgggctcgtaatgaatcttctttttcttcttttctttttttctgccagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtgtaagtctaaaagacttccattgtaatttcctcacctgccatttctcatgaactctggtcctctggtaaagctcattttctggaaaatctgctgaagcaagactggaggcttcaggaggcttgcagcttcatctcatcgccatgcaactggcacccagggaaatatgtggaaggacagaactggtcttcctgaggacgaggtgtcctggagtgtcatctgtagtactggggtggaggcagttccaagcacagcctgcagggtgtgttatgagccagttatacagctgctgtaaggagccagatggaaatctcaaagggacacagaaatccagtatcaagcctgattgggtgatggtagattatgtgttgatgcagcaactattttttcagcacttggcactatgctacatgcctgagggtacagtgatgggtcagactcatccctgtcctcaacaaggccatgggctcagggctgaggcagatactaaatgggaaatttcccttaagaaacgtacttaaaatattttattgtgaaatcacaaaataatattataaataccgcatacatggctcagatttaatatatattagcattttgtcatatttaattcagataacccttttagaaaggaaatgaaatgttaatatatgattaaaaccttttcattcctttcctatatcatttccatccatttttttggacttgtgtattattgttttgtggttttttaaatttatatacataaatggcatactgccatttatattcttctgccactatttaccctcaaattatgtttttgagatatgagattttggtccattcactttaattgctattaatattacagtgctagaaatgaactacacatatttattcatttctctacttatggaaaattttattatgctcaatatcacattgttagaaacagtctgataagcattatacaggggggtttccatgaagagcaatgagtagaaccaggctgctgtggtatcacagaggagggagatgctttgccttctggaggtgtcttgggagcatgtggtactctctggaagtttaagtgggtggaattcagagtaggggtaataataagaatggacaggtaagtgggaaccagatcacagggggtgcttaagccacaagaagagggtctgaactctcagctgatgtagatcgggtgcccattgaggggttgtaaccagtggggcagtgtcatttgtctttgaagagagaaaaatcactcttgcagcagcttgcaggatggactggatgggggaccaaactggagaccgggagaaaagttaggagattgctgcagtaacaaaggaaactagcctgatggcatcagggatggagagaagtgacagacactttaagacattaataaagagagtcagcagataacaggatggattatggggtagagaaaacaggtagtggactgggtcgaaacctagttttgttcttgaaaaactaagataaggaaatacaggaagggaagagagatgcacttcagggcactgagatagaaaagggagaatagatgttccagtgcttatacttagtacgtgagcagatatagtgagttctagcaagatctgttcagaattgtcagggcataatctagcctttggactggaatgtaactggatgtggacagtaggaatcacataggccagatgtcagcacccctgggggagggattcctggctcctgctgcctgatacctgaaattctttaacggggtcaaggcttatccatcttgacaataaggcaatgtgtcatattgagaggcagaggcgttggtactatcacttactagctctatgaccctgggaagaaactttaacctaagtcttagtttcctcatgtttagaatgagatattcacatctgcttcatcgggtgggaaaaagtttatgaacattaaaattagatggcatatatggatactaatagagtcacacagagactgaatggtagctgtttcttgtttttgtattgtcaaggtatcaaatacaaatattactagaatattcctaccctaactgctccatttaaaattgcaaactgcccttcactccctatacttctgatcccccttatccagctcaactttattatttttccacagcctttaacacctaacataatgtgtaaattatttattataagtattgtctcttatctctcttccccactaggaagggatcttcccacaaaggcagcctccttgccttttttattcattgatccaggtatctagagcattgcctgtccctggcatgtaagaggctcaatgaatattggttgaatgaatgactggttcttggacccattgagaatccaataaaagtctgaacctgtcatgctggtgtagagagtatagatcatattcaaacaacattttgcctaacactgcagagcctctgaatcccacaattgagaatccaaggtagaaaggcctgcactaatagaaattttgatgtttttctcaggtaatttcccaaatggggatacagacaagtatttatctgacaccattcgacctttgagaaggcacttgaactagaattcccaggcgtctggatgcttttctgcttgtatttgagaaatgaaaatctcaaagactttcagattagtgtatggttgcagaacttggaaagcagtacagttaaatcagttatgactgcttagtccttgtattaggctctgtgggccaaaaggtattgatttttgtgtagagcatcaaccccaaattagctagaggtaaatttaaatgtcaatggacagtttttaaaaacgaaacatgatgcattaacctgtccttatttgattagcctcatcttttaaactctatttatgattgtatgaatcaagtaagaaccaaatatgaattactatcactagtataatcacatcataaaaagctgtttctgttctaaccttggttacagataaatgacagcccttagattcactagatctgttttcagaagggaagactcaaggtaattggattcagaagcattagtagaggcatagttgggtgcccttaatgtcatttgaataatgggactattgcaaatctctccccctttcagattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgagtttccccgcttttgattttagcttctgttgtttctggcttgatgttgctggcttggacagggtgcaaagaacctgtggatgtctgaagtttctctttcttaagtagtaatcaactaagattgtattgtttttttgtgacattgattctcttcagaattaagaataaaaagtttattaatataatgatgtgaggaattacttccttctagaataaggaacgcactttcattgtccttgaaaaatgaaaaatattttctaagcttgtgtccctccttgcttgatttgctttcctatcctcttctccctacccggggcacatcacaagcttaatatttaacatttaattaagtgttaacatttttagcatagaagaggaatacctaaaaagctaactgaggtgtttatttataagcaagagatgagtgagccataagttctccttgccctcccagaattggcgttgtttttctactgggatgtggctcagtttgtagatgaatgtggagtgtagaatggtgatgagagagagaagctgggatatgtgggtggacacgcagggcaggtatggagtcctttgggaattttagcgtggcaagtatttgaacttaaagtgaaagattgtaagaaatgtgtttatgtttctttgttatcctaggtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcaattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaataaatggctgttatttctactgtgttcacattcttcacagaagtcataaatggagccattaaagcaagatagaaaatcagtttcagaatttcttcatggagtgtttctgcttgacatgggacttttaataattatctggatttttttccttgggattccttaaaatatattctaatctttagtaaattctagagagttttttaatatataaaaagagtcacatgtaagttaaattcaaactttagaacaatgtttactaacattttgaattctctaattctcaaccaaattgttttttttcctatatctggcagtaatatagcttctccagtgtagatggaaaggaaaagtaaatccaaagtgagaaatagagtaatagtactatgataaaccagtggtaatggaaaataactatttaaaaagaataaaaggttattattatttctgatgtggtgactaaaggaaaatgtcaacagtggagatgtgtctttgataaaggatgtgttaaggaggctagaaatgtaaaaccagaggccaggtgtggtggctcacgcctgtaattccggcactttgggaagccgaggtgggctgatcacttgaacccaggagattaagaccagcctgatcaatatgaaacccagtttctacaaaaaatacaaaaattaacctggcacggtgatacatgcctgtggtcccagcctctcaggagacaggtgggaggagcgcttgaggccgggagacagaggctgcagtgagccatgaccgtgccactgcactccagccccagcaaaagagtgaaactctatctccgaaaaaaaaaaaaaaggaaattagaaccagtaaaacttttcctgtgtggggctttaaacttgtgtatcagacaggggaaatgtggtggcctctttaggcaaatagagccaaacccttggataggtctttatttaactgttatagcctttcactaactttgactatcagctgctgccatattgaagggaaagtaaattgagtaagtggaaatgatatattggcacttgctaaaaataggattttttccctaaaaaactagaaatcattatataaaaatttgttatgagtttacatgccacatatgtatcaagaaatccactgctgattgttcttcatggctgactacactgattcatgaattgacatatcttctgggtctctagtgtgcaaatcccaggaaggacaaggagaaagctcattgtattctagagtatcattgtacacttggtaaggattgcctgtataaggacatgtgctttctcaatgtctttttttttttttttttggctcacttaagttagacattttacatgtattagttaaccctcacacatccacaaagtgtaattattattgccattttacagatagaccaaccaaagtgactcagatatattaaataacttgcccaagggcatgcaactggtaactggtaaaagtcctattggaagccaagtttcccccctcccccatcaatactgtgagctttcataaactcttcagtaagagtctgcagtgagagaaacctatgcctatggtggtaaagcatactctcaccatggactgaggagcaagaaatttacaccataaggtgtgagaggaaaatttgactgatttcctaattgctatatgttttatttgtatcccaagcacatgccaaattttgatcaatgtgataaatatctcataatacctcatacaatggaaatgcatgccaaccttaatttgaccaccaatatacaaaaagtcaaccagatttctgaatttactagaaaacaatatgttgcttggatcactagatattgacatcctttatttttttttctccctgtagtcaagaaacaatttgaacaaatcaaagctgttgacttggtattctgcttatcagcaccttaaaatacttatccatctcctagtttacagtacaagtcagaaggaaattaaatgacctttcacatttaaagtgatagttgatataactgaatgaatatctatcatgtttgtaactcttttctgtttgttgcatttgtcctctcttcatcccttcctttttctgtcttcctttagttttgaacaatttatgattctattttatctcttatcataccagttattctttttacgaatttttaaatggttgccctagagtttacaatataaacttttttccaaatacaagcctgccttcaagtgtagtgtaggcattttataacaacacattcccaatttctcatttctgcccttagaacattgatgtcattcatttgacttatccatatggtataatcactcaacacattattacatttattactttgaacaagcaattaccttacagatcaattaagaacaagtaaagattttgttcatcttcacttatttattctctgatgctcttcttatgtagttcaagcttctaaccaacatcattttcattttgcctgaagaacttcccatttcttgcagggcaggttggctggcttttttctttcaacattttaaatatttcactccactttcttctggcttacctagtttctcacaagaagtctgccataattttattcttttcttctataggtaatatgttttttctctgacttctttcaaaaatttctcgttgtctttgcctttctacagattgaatatgaaatgcataggtgtagattttttttggtgagggtggtatttatttttggtgttctctgagcttcctgggtctgtggtttggtgtctgtcattaatttcgaaaagttgtcagccattattacttctttcttctctgctttccctttcttttgtttctgatactcccgttatgataagttacacattttgaaattgtcccacagttcttggatgtttgcctcccacttttttcagtttgataggtttctattgacatatcttaaagctcactgatactactctccttggccatgtttgttctaatgatgaccccatcgaaggcattcttcatttctgttacgatgttgactatttctagcagtttcttttggttcttagctccaaattcttctgctgtatttgtggccctcccttttgacttgggcttccctaagtagtcctcctcagagagggtctgtgtcatgtatctcttttaactgtaatccactgtttttcttgctggagctctattggtgtggtggttagatgttggatagggggagagtttaaccatatgattgaatctcagtttttcaagactttttttgttgatacacaatatgggctacatgtgatatattgctacatgcatagaatgagtaatgatcaagtcagggtatttaggattatcacttcaagtatttactgtttctgtgtcttgggaacatttcaagtcctctcttctagctattttgaaatatacattattgttaaccataatcaccctataaacattagaatttattccttctatctaactgtatgtttgtacccattaaccaaactgtcttcaccccacttacccttccctgcccctggtatccattttttctctctatcttcaaaagatcaactccttttgctcccactaatgagtgagaacatgcagtatttgtattttggtgtcttacttatttaacataatgatctccagttccatccattgcagcaaatgacatcatttcattcctttctgtggccaaatagtattccagtgtgtatatataccacatcttcatacatttgtccattgatgaatactgaggctgactctatattgttgctgttgtgaatagtgctccaataaacacgtaagtgcaggtatctttttcatatactgatttcttttcttttggataaataaatacccggtagtgggattggtggatcatatggtatttttttggtctttttcagtaatagtcattctaactgtggtaagatgattagcaatgttgagctttttttcatatacctgttggccattgtatgtcttctcctttgagaaatctcaattcatgccctttgcccactttttaatgggatttttttttttcactgttcaactgtctgtgttccttgtatattctggatgttagtctcttgttggatgaatagtttgcaaatatttttctcccatttagcaggtggcgtcttcactctgttgattgtttcctttgcttcccatttagcaggtggtgtcttcactctgttgattgtttcctttgctttgcagagccttttagtttgatatagtcccatttgtctatttttggttttgttgtcaaagttttcaggtcttagctataaaatcttatgtttaagtctttaatccatcttgagtttatttttgtatacagttaaagatacaggtccagttccattcttctacatagggatatccgattttcccaggaccatttattgaagaaggtgtcccttccctagtgtatgtttttcacacatttgtagaaaattaactgtctccaaatatgtggatttatttctagattctctatttcattacattggcctatgtgtctgttattatatccaaatcatgttgttttcgttactatatccttgtaatctataccgaaatcagataatataatgccttcagctttgttctttttgctcagaattcctttgactattcaggctctattttggtttcatatgaattttaggattgttttttctattactgtgaaaaatggcattggtattttgatagggattacattgaatctgcaaattgctttgagttaatatcattttaatggtattaattcttctgatccatgagcatgggatgtcttttcatatttttgtatcctgctcaatttcttacatcagagatttgtagtttttcttgtagcaatattttacctccttagataaatttattgctaggtatttcatttattttttgtagctattgtaaatggaattgccttcttgatttctttctcaactagttcattattggtatgaactagttgttactgacttttatatgttgattttgtatcctgtaagtactgaatttgtcagatttaagagtttgttatctttaggttattctagatataagattatatcatcagcagagagggacaaattgacttcctcttttccaatttggatgccttttatttcttttgcctgattgcttggactcccagtaccatgttgaataagagtgaagaaaatgggcatccttgtcttgttccagttcttagaggaaaggcttttccccattcagtatgatgttagctgtggatttgtcatatatggcctttattatgttgaggtatgttcattctatgcttggtgttagactttgtatgatgaagggatgttgaattgtatcaaacactgtttctgcatctattgagatgatcatatggtttttgtttttccttttttcattgtgatgtatcctgtttattgatttgcatatgttggaccatctttgcatccatggaataagtcccacttgatcatggtgtattatctttttgatgtactattcgattcagtttgctgatattttgttgaggatttttgcatcaatgatcatcagggatactggcctgtctgtagtttttctttttttgttgcatccttgtctggttttagtatcagggtaatgctggcctcatagaatgagttggggagaattccgtcctcttcaattttttagaatagtttgaggaggattgttgttaattttccttggtaaatttggtagaattccacaatgaaactgttcagttctgggcttttctttgttgggagactttttattgctgattcagtctcattacttcttttttggtctattcaagtttttcgttgtttaatgattcagtcactataggttgtatgtgctcagaaatgtaccatttcttctggattttctagttttttagtatatagtggttcataataatctctgatgatcttttgtatttctgtggtgtcagttttaatgtctctttttccatttctgatttcatttatttgcgtctttgtctcttggttagtttagcaaatggtttgattttgtttaccttttcaaaaaaccagtattttgttttattgaatctttgcctttttggcgggggggggggattctattttgcttagatctgctctgatcttcataatttatttcatactactaattttgggtttggtttcttcttgctttagtagttccttgaggtgcatcattagattgtttattttaaatctttctacttttttgctgtaggtgtttattgctatacatttccctgttagcactgcttttgctgtatctcataagctttgatatgttgtgtctcaattctcatttgttccaagaatttttaaaaatttcctccttaatttcttccttgacccaatggtcatttaggagcacgttgtttattttctatgtgtttgtacaatttccaaagtttcttttgttattaatttctagtcttatttcactgtgatctgaaaagattcttgatatgatttcaatgtttaaaaatttgttgagacttgttttgtgtcctacatatggcctattctggggagtgttccatatgcagatgagaagaatatgtattctatacctgttaaatgaagtgttctgtaaatatcttaggttcatttgttttaatgtggtttaaatccaaagtttccttgctaattttctatctaaatgatgtgtctaatgctgagagtgaagtgaagtccccaactattattgcattagattctattcctttagatctaataatacttgcttcatatatctaagtactctggtcctgggtgcttatctttagaatggttatatcctcttgctaaattgtcaaaaatggtaaatagttacaaagaaagtcattatctagtgataaagggattggccttttggtttctatttgcatggaatatcttcttccattcctttgcttttggtctatatgtgtctttacactaagatgagtttcttgtaggcagcatatagttgtgtcttgtttttttaaatcattcagccagtctatagcttttttttttttttttttttgagatggagtctcgctttgtcccccaggctggagtgcagtggcatgatcttggctcactgcaagctccgcctcccgggttcatgccattctcctgcctcagcctcccaagtagctgggactacaggtgcccgccaccacacccggctaattttttgtatttttagtagagacggggtttcaccatgttagccaggatggtctcgatctcctgacctcgtgatctgcccatctcggccttccaaagtgctgggattacaggtgtgagccaccatgcccggcccagtctatatcttttaactgcaaagtttaatcattttcattcgaggttgttattgatgtgtgagggcttattcttgtcattttattcattaattttggtagttttgcatatcatttgtttcttttctatatcattgtggcttggtggttttctgtagtggtaatatttgagctctttctcttcctcatttgtgtgtttgccctaccagtgagtcttatccttctgtgtgttttcatgatggtagctattgtctttttgttttcacatgtaggactcacttaagcatttcttgtaggaccactctagtggtgtgaattccctctactatgtttgtctggggaaaacttcatttctccttcatttatgaaggatagctgtgctaggtatagtatcctttgttggcaatttttttcttttttttgtgcttctttgattttatttctttttttttctttttttattattattatactttaagttttagggtgcatgtgcacaatgtgcaggttagttacatatgtatacatgtgccatgctggtgtgctgcacccattaactcttcatttagcattaggtatatctcctaatgctatccctcccccctccacccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggttgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgaggtggtatctcattgtggttttgatttgcatttctctgatggccactgatgatgagcactttttcatgtgtcttttggctgcataaatgtcttcttttgagaagtgtctgttcatatcctttgcccactttttgatggggttgtttttttcttgtaaatttgtttaagttcattgtagattctggatattagtcctttgtcagatgagtaggttgtgaaaattttctcccattttgtaggttgcctgttcattctgacggtagtttctcttgctgtgcagaagctctttagtttaattagatcccatttgtcaattttggcttttgttgccgttactaagccaaaagaacaaagctggaggcatcaccctacctgacttcaaactatactacaaggctacagtaaccaaaacagcatggtactggtaccaaaacagcatggtactggtaccaaaacagagatatagatcaatggaacagaacagagccctcagaaataacgccacatatctaaaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaactataaaaaccctagaagaaaacctaggcattaccattcaggacataggcatgggcaaggacttcaggtctaaaacaccaaaagcaatggcaatttttttctttcagcacttggactattttcaatctctcctggactgtgaggtttctgctgagaaatccctgttaatttgatggggattcccttataagtgactaaatgcttttcctcttgctgtttttagaattctctctttgacttttgacagttttattataaggtgctgtggagaagacctttttgaatgataatatctgtatggggatctgtgagcttcctgtgtatggctgtctaaatctcttgctaaagttggaaagttttcagctattatttcattaaggacattatctaaccctttcatttgttcttcaccttgtggagcactgaaaatttgaatcttcggttgctttatggtgtcccatatgtcacataggctttgtccattctttttaaatttttctctatatttttgcctgactgggttatttcaaaagacctgtctttatgttctgaaatgttttcttctgcttgatttagcctattgttgaagctttcaaattttgtatttcattaattgaattcctcagttccagaatttctgtttggttattttttatgatatctatctcttttgtaaatttctctttcatatcctgaatactgaattgtttttctgatgtctttgttttgctttttgagttattttgtatctcactgagcttctttagtatcattttgaatttttta

SEQ ID NO: 293 - DNA, 3555 bp, Homo sapiens
ctaggcctgctgtgtaccacatcttgggatcctctctttaacacctttctgggcatttcttatatcttgcctatgtattggattcccagtttccctcattgcatattctcttctttcttggtttactcccgtatttgggaggagcacattttctggaagtgtcctagaaaatttcatatgggaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccgtaaaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcaattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaataaatg

SEQ ID NO: 294 - protein, 413 aa, Homo sapiens
MKEVVYWSPKKVADWLLENAMPEYCEPLEHFTGQDLINLTQEDFKKPPLCRVSSDNGQRLLDMIETLKMEHHLEAHKNGHANGHLNIGVDIPTPDGSFSIKIKPNGMPNGYRKEMIKIPMPELERSQYPMEWGKTFLAFLYALSCFVLTTVMISVVHERVPPKEVQPPLPDTFFDHFNRVQWAFSICEINGMILVGLWLIQWLLLKYKSIISRRFFCIVGTLYLYRCITMYVTTLPVPGMHFNCSPKLFGDWEAQLRRIMKLIAGGGLSITGSHNMCGDYLYSGHTVMLTLTYLFIKEYSPRRLWWYHWICWLLSVVGIFCILLAHDHYTVDVVVAYYITTRLFWWYHTMANQQVLKEASQMNLLARVWWYRPFQYFEKNVQGIVPRSYHWPFPWPVVHLSRQVKYSRLVNDT

SEQ ID NO: 295 - DNA, 134481 bp, Mus musculus
  misc_feature (1)...(134481): n = A,T,C or G
gtctaagcaaccaagctctatgtactgatcactcagttttgatcactgatccatagccaatctctgctcataggtagcctcactcactacttctattcttttaaaattaatctcattatgccatgtcattcgtaactattgctgtatggatttctgaaaggcactgtctctttttaaatacctataatagagagccatggtggtgtaagcttgtgatcccagaactttaaaagcagagacgggagggctatgaatttgaggccaacttgggttatagaggagatccaaactaccttaccctccagagttagagctggtctcagaaacaaatgaacatgtcagtcaggctaagcaggtgtggtgggatgtgcttgggatcttagcacctgggaaggaaggaagacgactgtgcgttcaaggctgggctgagctacatagcaaaggaaggaagactgtgggttcaaggctgggctgagctacatagcaaaacccaccttattaaaaaactgtttcaataggcaaatattcttctatttcttttattagtgtttaaacttaaaaattaaaaaaaaagaaaaacaacctgactaccctgacttccctacaactgaagtattttcagagactagagctcagtggttaagagcttgtattctaagccgggtgtcgtggcgcacgcctttaatcccagcactcgggaggcagaggcaggcagatttctgagttcgaggccagnnnnnnnnnnnnnnnnnnnnnnnnnnnnnnnnnnnnnnnnnnnnnnnnnnnnnnnnnnnnnnnnnnnnnnnnnnnnnncccccccaaaaaaccaaaacagagcttgtattcttcctgcagagaaccctagtcccatgccagacagctcacaaccacttaaagcttcagctccaagggatccaatactttcttctggtctccatgggcacccatactcctgtgtacataaccctcaatatacatatcattgaaaataaaagacccccccctttaaaaaattaataataaaatatattaaggcaacaaacaaccaaactgtaaggctgttctttataacttgaggactcctggaaaataaaaacagttttctttccccccccccccctttgggccattgtcttagtcagggtttctattcctgcacaaacatcatgaccaagaagcaagttggggaggaaagggtttacacagcgtaaacttccacattgttgttcatcaccaaaggaagtcaggacaggataggaacctggaggcaggaactgacgcagaggccacggagggtgctgctcactggcttgcttcccctggcttgctcagcttgctttcttatagaacccaggaccaccagcccagggatggcaccacccacagtgggctgggcctggccccgttgaccactaattgagaaaatgtcttacagctggatctcatggaggcatttcatcaagagacactcctttctctgtgatgactccagtgtgtgtcaagttgacacacaaaacctgtacagccatcatttcattttttttattccgtatgacccactcccctccccccaaaagaagacaacccctgtcacaggactatgtatgaatagtctcagctccttcttctaactgtgtaagagaactgagctctccccccccccccccgtgtcttgaagttagctctgatcacatgacttgttctggagaatgtgtgtgtgtgtgtgaaagtggaagtagtgaactgtcagttcttgtcagaaatgccagctgacggtagaaggcaccccggagccctccctgctttctgctggggtggtcgaggttattcctgaatgaatgtgtgttcggagagggaaacactgaaattcatcactgcggtttccgtcctggtttgctttctattgctgtgataaaacactgaccaaaaacaacttgcaggggaggggccggatatatttgctttatgggtccagcattgagagaagccaatgcaagaacttggagacaagtactgaagcagagaccatggaagaatgctgcttactggtttgttccccatggctcgctccttgtatataatctagcactcctgcccaggggtgacggttcccataggaggcagagctctcttgtatcaactattaatcaagaaaatgccctagggatttccccactggccaatctgatggaggcaattcttcagttgatgttttctcttcccgggtaacactagtttatgtgaagctgacaaaaactagtgagcaaaaccatcctccacaatgcagataaaaacactcaggctttagttgattttagaaacctcgagacaacaattgagcgtgttttagtgaaaacccgactggggagtcctttcgttcaccgtgctgtttttgatctgtttctaatgatttattgaatgtgaactggtgtttcccttgcttgtatgtctgcatgaggttgttgggtcccctggcattggagctgcagacaatcagaagctgccatgtggctattgggaactgaaccccagtcttttggaagggcagccagtgctcataactgctgagccgactctccagcccctcattcaccttttaggatattccttttttctttttttttttttttttaatttttggtttttggtttttggtttttcgagacagggtttctctgtgcagccctgactgtcctggaactcactttgtagaccaggctggcctcgaactcagaaatccacctgcctctgcctcccgagtgctgagattaaaggtgtgcgccaccacgcccagctcttatgatattccttaattgctcttttgccatcatttctgtagggcaagacatttttaattctttcacctttaataattataaaagtactttgccaaataaaaccccacagacacacaaacctttccattaattggccctgaagacggaacagaaggcatgaccctagaccaggagttgtgtctctgctctgccgttatcttggaccagtcctagaatttctgggcctggtttccctttttggcaataatcactgttgtaacactgttactactgagtgcctgtttgcactactcatctccttgggactaggtccattcaggccttacaactaacctattcacttttttttttttttaaatcactgttaagggtaggaaatcgtggaagctgaaattgagtaaggccaaatattagtcacggccaaagtgaaaagggtgttctcaaagccagcctcactaaacatggaaaagtagttcctgccatttgtttttccccattgctagaggtatttcttataacgctccagggggctctcagtgatcatggtccaaactagcattttctcccacatacatagcaactccgtgttttccacaaattgtcaggacatactttatggagatcagagactggcgcaaagcctccaacctttctaacagctgatggggactagagttaataatagcttacacgctgaagcctgcgaaggggatagattgtaagtgttcctactcaaaaaaataagtaagtgtgtgaggtaatgctgcgtgtccattagctttgggaagtcatcccacaatggatacatcgttacaaattatcttgtcacacgtggtaagcaaatatacattgtgtttgctaatttaaaattattaattatgagatcatttctcaccttctaagcaaactgtgaagaaaacttttttaaacaaagcactcccctcaagaacttgcacagatcatttgctgagccttttcctgttaatatttatttcattggttgtttgggggtttttgaaatagagtattactagtaacactgaaactggcctgaaactcactatgtagactaggatgaccttgaacttgtgacagtcccccttcttctgcttcctcagtgccctgccagcccgcctggtttcaaactcttgttaacctgtggccattgcattagttgctttcctctgatattatttctgagttatatgtttgttagtgaaggtgggtcctgggcatggttgtggtcatggacaagatcttagttcatgagggtttgtaaattggaaaggaatttgatttcattgaggaatatataaataaaaagatattcagataggagcccagcaccatagcttctgcctagaattccagcatttgggaagctgacacaggattgtcatgagtttgaggctagcctgggcttctaagcaagactctgtctcaaataagaacaacaaaaacaataagtaccattgttcagataggaggaatcactgttaatgtggactgcagcgtgcggtcctctgcagaggatcccacctatttgccctatcaagggcatccgtagggtaatttacataattgaacaggctcaaagcttaagctttatgaattcggcttttctcttgtttaaaagagtaacagtcatggcaacccaccaagtgggggaacctgtttctccaattttgccttatcctttggaaggtgtcctgtatgctgttgttactccaagaaaccaatcagatcacaaagtctagggcttagtctgagcagatggcactgtagactgaagattagagacaataggctgtgtggctgctcactcagtctctccattgctgtgggctttgttcatacaacagaacacatggacagagacaactgaagacaaggggagcagtctgtggtgtgctggtgaggaggcagaggtgattcgggtagagggattacctagaaagtaggccctggggtgaccagcatggcagtggccagagacacgattcacaaagccaggaggtgagaagaagggacagctgtcaaagaccatggtgagacagattgtgtagcttttggagccatcagaagctctttggctttgaccctgagatgggatctctgcaggagtgttaagtataaaacacaggccacccaaactatacagatgcatacaaatcaaaggcacttgctggagaagcagtttgtgagttgggaaaagtcaaggtttcctttagtgatggaaagagggaagacggagggagggagggtggtccctggtggttatgctaattgaggataaaaaattccgggtaggacaaaataacaatgacagatccttttgctcgcaggactggaacaagtctgccattggatcaaataaggacccatagtggggtcactcagagttctggtacgttccttgatcagctccagttggtcagaaccaggtattgcagcagcgcattccaaggtgatgtctcaagggctgaggccagtagtaggaattttcccttttccaggtggatgaggagatctatcctgctttagctgaaatgcagggagatggcagagcccgtaaaggagcccggcaggagaggccacaagcagtttgggactgaacagagtgcaatgcctagtttgttttttttttttttttttttcactgaacaacttgagggctggagttgccctggagataaaaacagtggtgggtggagtaggcttggggaagggaagattagaggtcatcccagtttaagatgactgtgagacaagtgcgtggaaacagcagcggcaggaggcaggctggtatgtaaagctgcacctggaggtgtgggtagcattgagtggcagggaaccgtgtgcaagtgtgcatcatttggggagccagagacacaggactccagggatcccaacactatcttccttcctgcttctgtctttgtgcgtgtgtgtgtgtgctcaaatatataagaacactaatacacacatacatacacacaaggggggtaatcaatggtgtgttggtgaggaggtggaggtgcttcagggagcagccagagacactgagctacaccttgcctagaggatgcaggaggaacagccatcgaggaccatggtgagcctggatgtgtggagctgtgggagccatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacattttactcttatttaaaatacaaacaacctataatttgggcctgagagagtgctcagcaggtaagggcaccctgctgcttatctaaatgaccttatttctgtccctgacatgccagaggaggggagaactgaaccaaaggtatgttctgacctctacatgtgcactacagtaacacactccctccgcaaaatgtaaaaattgttactcttggggctgtgagatggctcagcaagtaaaggcactttctaccaaaactgatgagctgagttcaagtctcaggacccatggtggtaggagagaagcaactttcccaagatgtcctctcacctccacacacacacacacacacacacacacacacacacacacacacacactaaacgcaattaaaaaaagaaaaaagaaaaagaaaaactctagctattgacctttccaagctgtagacattagcatgtaatatttttggacatgcattgatcaagtccacccacttttctgtccttcctcccacctcttccaaactgttttttcttacaacatactctgcttaattttttaacttattaggcagttcataatacccattttacagatcagtaaacagaagccagcaaaactgagtaacattcattagcatcaatagtgctaatgaagtggagggctccaatgtaaaccaacatgaactggaatcccttgacctgctgtctccagtggtgattccctaatttgggtagagaacaaaattgaacaacaaaagattcagagactccacaacctcaagtgctaataaatggtgagttttctgtttggaggatgcatcaaaaatcacccagagagttgatgactgagcttatcctgtttagaatgttacagaccttgggtatagcaggataatttgtattggcaacaagttgcctgatgtggcagatcccagggataagaaccagtggctcaagagttttccctgacttttaccagcaagtagcctccacctgcaatgttccagatcttgctaacgtccaaaggttactctagtacattcctcctggccttgtcataccctctgggtatgatgctgccaatgtctatcaggcacagggaagattttcacagtggtgagtcctacgagaaccatcttggcaaagataatctaaaaggctcttgaaccactccctttggcaatcagactattcaaacgatggaccccaaggaattggaatttccccagaaatatccctttgaaggaagtgaaaggctgaggcctgggtgccagcctcaggagaaacctgtctcccaggaagagatttgccacaatttggatagctcctcagatcacattgcaaggagactacagaaagaaatgggcaggggcaagccttgatcaagactgcttatgtatgactacctcttgccctccctccgtttaaactgaaacctgtgttaaacactgctaagagcgggctggggacctttaaccctcctcttcccactgtggccacactgaataaatctccttgccctgcttttcacttaattgtctctttaattggtgttagtgacaggccggcctaagactaccttgcctgttagggctgcccctgcccaaatgctgactctaaagagtcaggtaaaagcctgttcaagtattccaaggagccatttaaaaaaaagaacacagctcaaaaatacacagttaggtatagggtcttggaaagaacttgtgttaagaaaaagggcccactgcagaggcagtagattcatgagaagctgacctctgctgaacatgttcctatatgttcaagtgccaatgacacatgcaaattgtttcccaaggggcttttgagcctagggttaatatggaatgtggttgatgcctgctttagagaagtgaacttttcaaggttggagggacttgcttgcctcgagtttggcagtagaggaagggctattgccagcaccctggaagctaaactatgacccagtgaagcacttacatttccttgggcttaatttctcccagtgttagaaaccttccatataaatctcttaccttaggcacatttcaaaagccagtttagagataattattgagatttcattacattaagaagaaaatttaagccctgggttggatacccagcactgaaaaccattaacttaaattcagtgctagtattcaaaaaatgttctttaaaacagcagtcagggatggtggcacatacctctaatcccagtattctactgacttttaaggaacacaatgagttccactccagcctgggctcacagtgagttctaggtcaacctaggctacagaagaatgccttgggggtgggggtggggggcaaaccaaaagccatcgggggtgaggacgccttcaaaatgtattattaatttacatgtttgcttcacaaacaggacgacagcagaaggaagaacgttgagtaccttttaaaaaaggttttctgaaatcccattttcttttctagcttgttctaagacatgcaataggcaaatgtggccttttaaatagatcgactaactcaaccaaaagctgagaaaagcaaaaaaagactctggggctaggctctggggggaagtgaccaggctaccaaactgtgacaatatccttccttccccttccccaaagggcctagattaagacttgtatcgagcaaacagacacacagaaaaacacacacacacactcaaactttaacctgggagacatgaggtgcttcttacaggagactaagacacaccatctttgattttggcctttgaaaggagtatgcgcatagaaacatattgatcattccaagacagagaaaacccagtctgatttctggcacacctcgccttgttcctccaccccgccccaactaatgctttttacacacatggtaagtttccaaatacaagcaagcaaagaaactgcataaaaagggcttcctgtgaacaagaggtacgaaggttccattaagtccctcttgggtacgctttggaagacacaaatgtaaagagggcgggtcccccgttcttaaggaagcactgcaagaaattgaatcggaccctgaacacttcccacgtcaaagccaccgagaggcagaggtgcgacccgagaaatcactggcacggactgtcggcgctgggctccggatgcgcactcagccctctgaaaggctcggacattgcagtaccactagacccgggtttgtcccggcgtcggaggcgcggccgggccccgcccacgcaccaaagcggctgcgcagcgtggctaccctgtctcccacgtgactgccgtcattgcctccgtgaagctccggccgccatcttaactcctggccggcccgggtccctctccctccttctcccgggccgtgcggcagtgacagggtgcggttggccgccccggcccgtccggtcggtgaagcccgtgtgattctgagggcggggcgaggagccggagctcacggagtccacggggagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggccgggctggagcccccggctggccgaggcgggggtcctcggagcgcagccgcgggcctcctgggagcgctgcacctggtgatgaccctcgtggtggccgcggcgcgggccgagaaggaaggtgggttgccggcggcgggcggcgggcgacaggcggcagagggaggcccgcgacgggcgccggcgcgaagttgctgggtcgagccccgtcccgagccggcgactcggggttcggcgagctgccgcgtcggccgcgcgccgcggctctgccgctgctccgtgattcctttcccctcaccgagccccggtctttccctcgtctgctgtcagtgcccataaaacttcccgagctctcttgtaggttcttgccacttggcccgctatgcgaggaggcaccccgcttttaggcttcttggtggctcctgctaggtcgatcgcgggacgcttttcttgttttccctttgtcaggttttaatttgggcatgcggaccgagctcactttaaaatgcggtggttaaaaaagaagaaaaaaaaaaagcgagactggtggaaaggcttcaatacacggcttataaaatttctatttgctgggacatctctttgaagaggctcttgtttccttagtatccttcttcactatccctttgcggtatggaggatcgtttgttattagccctaaatagactctcatttgcctctagtaagctactagctactggaagccggtttccatttctgctttaatatcctcacgtaattcggtgcctttctctttgatgtgtgagcccttagaaacgaatgtcaagttcccagcttgcacacccttcacctgtaactcacaattgaagccgcactccagttttaataactcctctaatattgtaaggttgtaaaactggtactttgacaagatcagaaattactttgcagtcttgaagactaatttgggggtgggggtgttctggactacctgtttctgaacgtgagcccaaggagaagtgtgagcagtcacagaaccttcatgaattaattcacagtgaatgctgcttttttttttccctaagaagaaaactagttagattatttttgtttttcctgtataaagtcgctgttactggctagcagctgtaaagtaaaccagattagccttaaagtgcaactctgtgtcagtttattatttattttccttagaaacattatattctctcacttaactctataaacagagtcagcctggttaacaggcaagcagggatttggcagaggcaagattattttaaacattaaaaaatgctgctttaagatggtcaggcctgggattgtcatagttcttattatttatgatcccctgttagtttagtgttgttatgggtggccatggtagccaacatttgcccatgtgtgttgagtgaaccttttatagtgtgataattgaatgggcatgtgtacttgtgtgcttcactgtgacctagaggggcgctggctttgctttgctattgattgccttgtgtggtataggcgcctagctaggtgcttttgagtctcacgaactgggaactgaagtagtgattgaatctaagttttcattatccttctaaagtgtattatttttcaattgtcattttatacactaattttgggggtacagttaagtaaataaagttattgtttgaagacattagtctaaaatatatttgtgtatttccatttgcataatttacgtgtccatgcacctctctaatattcataaatatatataagggctgagcctgtagaatagctgccagcgtgttaagtatgaaaggaagtgattgaatcagccactgggcctggctgaatcagacagcttttgtggttatgcagtatcagggggaacagtttgtatggaccaaatagttatttaagtaagatattaggagtaattatattaatatagatcatatgacttagtctctcataagtaggtctggttttaatcacacgttccaaaaacgttctcaataaatgttctactctcaaaacatgctgcttctagatcaaattccagtcatgtttttattttgaataagtagagaaaatggaattgattttcacccaggactgtgacacaatgtctttggcctctgatgtggcactaatataacatttgccccagtgctgttgagtttttggtttttgtttcttgttttttttgtttttgtttttgttttcaggaagtttggtcagacttataatgatagctaagcttagtttatctctttactccctgaggatcttctgtgtcaagtaatatagcttgacctttccaagaaggggtctaccagcaaattcagtggtagttctctgggtattttgtgtgtttgtatatttttcccttcattgcagtagaatttcctagaaaatcaagacaatgtagaagtccctgtctcctaagggaaagctgcaggcaaagctggatcgcccgatggggttctgcgtgtttgaaccacgtgaccacaggagccattcctgtcttaagataggacgagtatcttagcacacatcttaacagatctgtgaagtgtgttatctctggtctagaggaaagggacctttgattgcgcttgaatgtttgtaaagactttgagatagttgtcagacagaaagtcactataattactacagataacttggttagtgtcacgagttttcttgagagtaacatttacatactgaaaacagaaaatctctttctgtctgtctctctgtatgcacggtgaaggtacatatatgttatgacttttgatggaatcttttttttttttgattcgagacagggtttctctgtatagccctggctgtcctggaactcactttgtagaccaggctggcctcaaactcagaaatccgcttgcctctgcctcccaagtgctgggattaaaggcttgtgctttttttttttttttttttttgatggaatcttgatttataagtcagtcattatggtaagcaagcattttttttttaagttttatgtgtttgaatgttttgcctgcctgtaagcttgtgtgctatatgaatgctctgtgcttgacagaagaaggggtaagatcccttggagctggagttatggatggttgtgagatgtctgatgcttgtctttagacctgaacctgatcctctgcaagagcagaaagtactctttccctgctccgccctcacatgcccagctgataagttgttttgtctttttgtccgagacagggtttctctgtatagccctggctgtcctggaactcactctgtagaccaggctggcctcgaactcagaaatccgcctgcctctgcctcccaagtactgggattaaaggcgatgtttttaaaatatcttattcatttcattgtaaagtggattttggaaggtgtggtgccttttgacttactctaaatttaccatttacttacctagtacataaagcttggggctgatttttggactgcttcattcggtgacagcttgaatctgaaggcctcgtgtgtttccattaattggtagttaaaggcaaggccaagtttgtagtgttattaagacacttatttattttctgcccatgtgtgatagtttcatgcataacttttgttttcagctgtatttgtgtcatatacagaaaatggtattctctatgcaaagcataagaacccactgcttaggactgaaggcccgaagaagggagataaaagcctgttagtgatttgtctgtcttgggctcatagaatcgattagagagatgtgcactttctaatgtaaagctacattttaaggagagtgggtgttttgtcctctgggtggaatggctacgttttaatttagagcctgttaaatagggtggtacagaacgagcactctatgagtgagcttgttttgctttttctaaaagctgtttagttgtcagaaacatcggagccctatagtagggaagtgtgccctttgttttctgagaagcatcttctcctcctttcagtatctctccctaaattcttacagtgagtcctcataggcacctctgaagagatgagctttggaggcagttgtaaagtcatctaatttgttacccagactcttgataaaacatgttcctctcggcggcacagtaaatttgtctttactgggttctcagtatcttagaaatgctctcccttgtggcttgagatttctttttggcttgccaaaccaaggggtcagaattctctattttgtctgttgagagcgcttgtgccttacgtgaggaatggacttagtacttcttggttgttactgtgtcctagccagctgtcactgctctgcatgtgccagttggatggtgtctgtctgcatctgtgtgtctggccaacagcatacactaaagtctaggcaggattagcttacactgccttccatttcccagttgttattagtgccgtgttattcttcggccccattgaactcagtcttgaccctttactaggtgccaatgcctgtgacccctcctttggtcagctcttcctacgacctccattgttcggctcagggtgcctgagacacagcctcctgcctctcagtgtttgctgttcgtgtgcagtcctgttcttttcaagcatgtggtatctattcattcattttatatcagcagtcagttaagtgatcccgcagcctccttctcctggactagactctgtgaggcacccgcagcacggacatagttctgaatgaagatttgcatgaaatgatctcaccttcctttttttttttttttttttaaaaactgatgacttggagtttagagtcaaaaataggtaaaaaccctcagatgtagttgtccttaggaaacgtgacagtaggatattgggtgacaccatttttcctttcccacgtgttgcttccgcttatgactagaatgagttgttatacttatctgacccttccttcactcctggggctggagagatagctcagggttaggcatgtgtatactcttgtggacccacattaggtttcagtcacccacgtgggaggctcccagcttgctgtaactcctcccctgggagattggatgctcccctgcattcatgcacagcaccccacacagatgcacagcaaacaaatgattaaagtaaataaataatagaccatcgctgccttgactccaggacttttaacattttcagatcctcaaaatagtgagactggtgtagtactcagggaatagctggtaactggcgaggctaggattcctgcaagcattgtttccctgagccaaaccatgtggttcccagtgagcacgcatgcttgcatgtgggatgctaagttctcactggagaaagagcgagcatgtcagtgcaccagttagttggttttgtcattttctacgacgaggtctccctgactgtcatggaactaactgtgtagactggtcttgaactggagtagattgcttgtttctgcctcccgagggctgggattaaagctgtgtgccactacacccagctaattccttgaatttcagtagtcatattctgtcaacttggtgaacattaaaatgctcatagcccattctggatcatcagaattcttaaaaagaaactttcctattagtggatagtccagggtattgaatatttgctattggtagctactgattgttgtatttgatgagttagaagcctgtttttgttgcttgagttaaacaatattgcattctgcaaattctccctgtctctttttggaatgacgggttgatctagacctgggcattattcttggaagtttgtcctagattaaaacgtactaaagagaatccaaaggctgggagtagtagaatttgctgtgttgttcactgtttgactttgagatagagtcctaactgtgttacccaggttggcctccaacttcttattctcctgcctcagcctcctgagtgctgggattgcaggcaggcgccaccatggccagagatttttttttctaaagatttatttatttattatatataagtacactgtagctatcttcagacacaccagaagggggcacccaatctcattacagatgagtcaccatgtggttgctgggatttgaactcatgacctctggaagagcagtcagtgctcttaactgctgagccatttctctggcccggtcagagagattttgctttgctagaaaactagataacgaagtctctttgagacgtgagtttgaaccccagggtttcagcagaagcttggttctaatgctttggtttttctttttttctttctttcttttttctttttttggtttttcgagacagggtttctctgtgtagccctggctgtcctggaactcactttgtagaccaggctggcctcgaactcagaaatctgcctgccccccccccccccccccagtgctgggatcaaaggtgtgcgccaccacgcccatttttcttagcttcactttgcttcattcagcttgctaccatacatgggacaaaggtttgaaaaatatctaagatctaagaggacccttgacatgttctgtcatgataagagtgtaaagcttgcattgtttgtatgtctttttgtaatgaaatcccacaaaatttatattaatcgttttaggcattcagttcaggtacattaagtttatttgcatgttgtgcagtaggtccccagaactctttcatcaagcatcattggaaaccctttgcctataaacaactcccatttctctccactactaccccatcctggccacagtgtctgaatttgatgagagctgcataacatataagtggactcccacagcactgtctttttggcttgttttattttgtttggcataatgtctgtgaagcttgtgttgtagcatgtgtgggaatttccatttctccctgtgtgggccaggctggcctcagacttaggacctcctttggagactgtagtgctggacccctaggcaggcagccacagtttctccttgctttcctcagtactagggattgaacccatagccgtggtggtgctgtgtaagtgccctgttactcagctgtaccctggctctttttaacttgtattttgactgtgtcagggtctccctaggttgtctaggttggacttgagtgtgctaggtaacttagctaagccttgaacttggaaccttactgtttcagcatcccaaatggaataggtatgattctaggcatatgacattatgtgtggcttttttttttttttttaagagacagaatctttatagcccaggctagacttgaactcagcaatcttactgcctcagcttcctgagtgcagggataatatttgtcttcagccacgttcagcctggtttctttattattcagtttttgagtgtacaaaataataggtttcattataacatctttaaaaaatatttattaattatatggaagtacactgtagctgtcttcagacactccagaagagggcatcagatttcgttacggatggttgtgagccactatgtggttgctgggatttgaactcaggacctttggaagagctgtcagcgctcttaatggctgagccatctccccagccctcattatgacattttcatacacagatgtcatgttaccttgttactatttactcatgcacaaccctccctctccctccttcccctctgcttttatgtcatgtgcaggaattttagtactatgtattgttgatgccaatatggtagagaatacatagtatatagaagagaatacacagtatatagtagaggatatacagtatatggtagagaatacacagtatttgccttttctaccctctctttaccctctagcctgtttttttgttttggtttttttttttaagtatgtgcagttatgtatgtgtgtggatgtgggcatatgtggatgtgtgcgtgtagaagttagatgacgacttcaggtgttatccttaggttccccaccctgacttttttttttccctcctttgtttgtttgagacagggtctcactatgtagctctggctgtcctggaactcactatgtagaccaggctggtctcaactcacagcgttcagactgcttttggctcctgagtgctgggagtgtgcactagtatgctagtatgtgctcctcttccagacaccaagctgtctgtggtttcttaaccttcaaaggcagagtaacactccttaatgtggacatacgtcctgtttcatctgtcccctcatccgtggacacttgggctgcccctgccttttaggtttcatgactcgcgccacgaggacaggtgtgcagtacctcctccagcttcctttcacttcttcacgtgtacccgaggcaggctctgcatcataggccagctttatttttaattttttagtgaatgcactttttttttgtacctaggtactaatttcagcacactggtggtaactcattcattcattcattcattcactcactcattcactcgttttgaatagtgaccattgtagaaagtgtgtgatgataggctattgtgttttttattttcacatctctggatattagatctgtgggcatctttttatgtgcttgttgtccttttattcatattctctagaatgatgtctaattaagtcatttgcctaggctttgatgggggggtgttgttttgttatagttttgtacatattacgggtattaacttttatttgacagatgacttgcaaatatggtctcttgttctacatgctgcctttgcattctgttagtgcttcctttgatgagctggacatggtggtgtacatcatggaagcaggaagattactacaagtcaaggccagcctggtctacatagtaagttctaggccaaccagggctacatagtgaaacattatctagctgtctcaaaaaaacaaacaaacaaacaaacaaacaccccaccaacaacaacaacacaaacaaaaatggggagaaagagtaagagtgagaaagagaagagagggagatggacaggggctggggaccagagaggagagatgcctgcatgggctgtgtgccccatgtgtgtgcagatgcctgagggccacagggtgtctgatcccctggagctgcagttccagtcaggagccacctggtgtggaagcaaggaactaaacctgggtctttcggagagcagaaagtgcttttaactgttgagttatctctatagccctagcagatatgtttttaaaaatgaaattttccatatagctataatactacatttgtggcaaagaatgcactagctaaaagctgcctctgcggaaaggtttgggagtttgtgtgaggtaacttcagtgtaactgacagagggggagcagtctgtactgaagacatagtaaggactgacagggttttcttggttgaataatgatggtaaagggagcgatacatttttagagggagtttgttaatgcacagatgtgctttgcatatcttacctgcatttctagatgctttgagatgcagtttgtcattccaaaattggttgagcagggtgctttcaggcagcactcaggtaaagctggaccactttttacattgctgctgtggatccaggttcctctgaaatgctgctccttggttagcaagtggaatggtcagcacccagcaggccagggcatggtctagatgcagagagtttctttctgggagtgcagtagtggacatggttatgttctagatacagggagctactttgtatgcgcacttgtggttagcactgccagcaggcaacagtggcgttctaggtgcagggagttactttttgttgagtagctttggttactgctcaggagctttgcttgggctgttgtctgggcctctgagaaggttattaagaatcgtgccacagagggagatgtgagaaagaagatagaggctgggattcaatcccgtcttactggaatcctatagattcttataagagaacatttctgaattttgtcaattctttcctgactgcatctggatgtatttatagttagagagtattgtgggcttcttgaggttaggatgtgttatcactaccctagccctttaaaggggttccccacacccaggcatggtggtacatgcctgtagtcttagcactaagaaggctgaggtaggaagttcacattggaagccagcctgaggtgacatagtgggacagttggcctctgtgtttgtgcaggcatttgtgcatgtgtcgagttctgcattggagtaaatttttgttactctaacaaatacttgagataagattatagataaaaaggtttattttggcccacactatggacattttggtccgtggccatttagactcattgctcttaggtttgtggcaaagcatggtgggaggctgtggcagagcagagctgttgagcacgtgtccatgacacaccaagagcacaggtcccagttttttccactctttgttgcaccaggggcgctgtctctgggacctggacctttgcagcacacctgaatctaagctgagggagaagccacaaaacagtgactattcaaggtggcccagagtgtagagaaagtgcttctaaatggatgctctctttacacacttgcttttcagcgctttcgaactgtgtgtcagttgaacatgcttccctgatactcctgcttggtagctattcaggtctcctgagtcctttcttgctctccagtgtggtgctgtttgtattgcaaacctcagcatatttagtcctcacaagatgacagcctccctctctgcttcatatttgtttagccttggctagagtgtacctgtggtgtaaggcccactgcagtgctgctggagggacttgtgacaatttactcaagattctagctttccataaggagaggtggtgtgatatgtgtgagctctttccatgctttacagcttacagcttgactttgggagttgcatctcccacacccccacctcccagacagggtctctctgtgtatcctgtctgtcctggaactccctatgtagactaggatagccttgaatttagagatctgcctgcctctgcctccctaatgctggaatcaaaggtgtgtaccaccactgcctggttgtttgttttttgtttatttgtttgttttcttttttaaaaaattaaacaaaatttatattgattatataactaaaaacagatcatcaaataaagtttaataagtggtgaaagattggtttgcttcctttccatgagagcccacaccttactgtatcttccgctttcttttttaaaaagatttgtttttatgtgtcttgagtgttttacatgatatatacctttgaacgacttgtgtgcctggttctcacagcagctagatgagggcatcagatccgctgtaactggagttgtgagccatgagctctggaattagtgctcttaatctctgagccatctcgccagcccctctgtttcccacttcaaaagtgtatattgccagattgcctatgaagaaaactattgtttcaacatactgtatgagggcagccacttccacatactgactgttaccatttttttttaaatcactaagtcacattgtgatgaaatagttactgtagtaagagtgggcactttaaaacatttgctggctatttctatttctatctgattgtttcttttgttattttctccattgacatttggttttttttttttttaacttaaatgtgtacttaattaaagacagtgtttttccaagcttctatttgttttggaattattttttatttttctattattttttttaatctgtcaaatctgcagctcttgtttttctagctttgttgttattcctcaaaagccacacaaagccctgtgtgtaacaattgtgtgctcactagaatttcatcttcatgcatctgttttgtgctgcagatcataaaattcgtacacacgtgtgtctgtgtgtgtgtgttttaacttgtgctataggaaactggcatttttataggtacaagtgattaaatagcatagcggtttctctacctaatattgatctgtatttttgtatgaattactgcattggctagagtttgagaacagtgctggatgtaaggagttaaaaaggcaccttgctttattctagtcactaaggtagtcacacgccttagatgtctcacttccaagtttgattgaagtatttgattaaaatcagatgttctcgatacagtgttctgaaatactttacttaagcattatcaggagtagaggttacattttatctggtgagatggtttggtagtttgatagtagtgtgggccctgtgagggacagcaagcagcagcctccccctgagctcctcctaagactgtttcctctggagaacctatcagcctttcctttcagtagaggtgtgcccaggctgggctgcccgtgctggccgctgcagcttacattttcacctgctcagtgcgcttctccgtatagtgtggctttttaagcaagtgtagccttaaaatagttccgacactgcagggagctatctttagtgttagcagcaacaacaaatgcctgaagaccaaactctaagaaccaggaaaagcgttcttgaaggacataatagactcagtgaaagacacttgtgcgctaggaaacacaatttaagatcagttctctcttatttaatctgataaaacttaaacgtgtaaacaactttttatggcattagaaaagttgataaagtataagtagaatgtggaaatgctgggtgggtgctgaagcatgacggagttgcaagggcgtggtgggcacaagcaggtattgggcctaagggatccattagtgggctccagtcaggagagtaatggaccgaagtctgggtggttcctgtaagatgactggcattctgacagaggtgtccatgtgatcagctctaaatgaatacctttgaacccattatcagcttccaatggaagccttgctaggttatagtttcagctatagtggctttaaacaacacaaatcattctcttatggtgctttttatttgttttttgctttttttttttttttggtttttggttttttgagacagggtttctctgtatggccctggtagtcccagaactcactttgtagaccaggctggcctcgaactcagaaatcagcctgcctctgcctcccaagtgctgggattaaaggcgtgtgccaccactgcccgttcttcatgactccttttaaacatgagccatgagtccctcttcatcctgcctggcctcttgtttctgtccttttctctttagtttcctgtcaccccttttcagactggggaagtttggcttgatgacagcttttaacttctgttgtgcgtttggagatgatttttctcttccagtgaggggtggttaatatgaattgccggcctggcagttcttgcttggtcatcagggttatcctttaagtgtattgttgactctgtttgattcacatttgtttaggaatttagtgtctggttcccaggctcacgtctgttttcttgtaacaacagtttgaacaccatagagtcagactggccccgtagtccctgttgacagggttttgttttgttttgttttgttttaatcatttactttggagcagtttgtagtaccacgaaagttatctagccctgggattttcttctgtggatgttttaaggtataatgtaaatttttagaacatagaactatttagtttttttcctaccttggatgagctttggtgactgaacctttaaaggaatttggatattttatttaagttgtcaaagttattaacaaaattagtcctaatatttccttatgtctttttactatttacaaggcctctcttgcccttggtgtttatcattgttctcttgatgagtatcattgtacaagctgcccttgaagaccccttcttgaagagtctgccttgaccttctcagtgctaggcttatttctgatgcatttttattgtttgatttgcttttttttggctatactttgctgtctgtattttatttgtattttatgggtttgtttgttggttggttttaaggtgaaaactgattttcagcctttaggtatttattgaagattttcttggatctgtaggttaacagttttttttattaactttaacacaaattttatttcttaggattgcttcctgtcttgcccctccctactccattttagaagctctgaatagccttgtagtagacaggatgaagttgacctccagctgacctttcgggttgggctctgtgctgagcatcacagggctgtgctggcttacctgctcgctggccttactttcctagggtctgatactgttacatccaatacactgttcatctatagaaatactgttttgttgtggtttttctgtatttgatttctcttgtatctacttctttttccaggctagggctcagcccaggcccttggcatgataggaaacacttacgcagagctacaatcccagcctcggttttctactttaaaaattggtttttggacagaaggctgagtccagggtcttgcatgtactatttcaactttccactttgagatggtgtttcagtgagttcccaactgaccttgcacttacagtgttgcacacctcggtcagttctcagtgagctgtggctcactgctcttgtatgttttcctgtgtgctgggtagccttgggctgagtgctgagagtgggggaggcctacattggtaggtactgttatggcatcttttattctcctatagtgactgtcatctccaaggctcactgcctccatctgctgacctaggcctagtcctggaagcttctcgtctccatacaatcttatccaggcttagaatgtcagcctgtgaaacttattgctgaataagctcaccctttctagttctttctgagctctggctggttggttcaactcagccgttctggcccaaactcctctccaagctgactgattgaatctgacttttctctgccactcctgaatggctctgcttgacctcaaactaactttgtcaatctgttctaatcttctggctccttctcattttctggctcattctgtcttcacctgtgtccagcttgttctttctcttcaacctgtctctgtaccactgtcccagtaaaactcttctccgtctctgcactgttctctttagtagcctccctttcttctctcttatcatgacagttgggcatatcttcttctgtcaaatctttctctgatttgtcactttgccattcagttagacatcactttcaaacatggctgcttccttctccaaactaactttaccttcattgtcttggattaaagatgtgtgctaagtaaggctgagctgcaccacaattggaaagaggtttttgtttgtgtgtttgttttagtaaataacacaatcttggggttcacagtgcaatcagatatcttgcaacaagatgctggtatctttattccttgtaactgttttgagctacggtggaagatgcaggaaagtgacttggaaatgtcactccattgaggtcttgcttgttcttgttcttctgtgcttgcttgtttctggtgatgttggccttggataagcaggctctggccctttgagctgcttccccggttccttgaggtctgcagctgggcgcctcaggtttggattgttctctagcaacaaggcatgacttcttggtctaccctccagttttctgtgagtcatagggcttagttattgttctttagtttcatgggttggaatagatggtcttcctgactcatgtgaacgccagacaaggtggcacgagtcttctttatcagttacttccccagccttaggtacctcaggtacatatgtgatcagcattttgctgagagcccagtggagaaccccaccctctacccctttagagaacatttgttactttttcacatttatttttattatttctaaggggtgtgtgtgtgtgtgtgtgtgtgtgtgtacacatgggtgccctcagaagccagaggtgtcaattccccttggagctggagttagagattgttatcagtcaccatgtgggtgtcaggaatcatcaaactgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtttctcctgccacattgtggccagcaacacaaggtgagcgaactccacctcatgctgtttcttgcttccagttttcaaggtcttgagcccacccagacaggtcagatgcatcttaaaagcatctgagtagaatcttggtttctactgcaccagtggttgccgctcctcacatgatctaccacattcacagggtattgagataatggcggaacctgccagggaagcctgtagacattatcatgttctctacagatggacagcttggagcacctatgtcctctgcctcagacattttcctctatagaataaagaagtatgatttttatagagaattttcttactctgcatacatgaaaccgtattagaaacagcaaggctgtaaacctgcttttcagtatgatgattttgtatagattttcctctgtaaatataagttagggttctttatgtagctttcactgtcctggaactcactgtgtagaccaggctggcctccaactcagagataacacctgttgctgctgctgcctcccaagtgctgggatcaaaggcgtgtaccaccacccctggctggacgtatttatttaaccaggtgtaactctcatttttatgttgagatttttctcagggttttgtgtttgttaatttctacaaatttttcaagcttatgaaaaaagactaccacaaatacagtttcaggaactatgtcagctgactttttcctcttagaaatcatataaaggttgcttccgcttatcacactgacttatttgttgcttttgcttgtttatcaaacagagcaagtgcttatgtgcctgggccgtttcctcgcaggccttcagcagtgtgccacaggccagcggttatagactctgtagcaggtgttgggattgtaggtcacacaggctcctcttcgaaggctctgtacactctctatggacaagatgatttatgtgcatttctaaacagttaggttctcacagctgcttccaccgatggcattgtcacgtgtcatttcacatagttgctgctgcagcgatctctgggctcagtgtttgacctctgtcttcaaatgtttatatcacagctgataaaactcttaaggcagacctcacagtgcatggggagtcagtgatgtcagtcagtcattctctgtcctcttgtctttcccccatcagctgcattacaaacttgccgcatcagagagggcttgagagggctttgttgcgggtcagtgagctggagggtggcggtggcggtggcggtggcgctggggctggggctggtttggaagtgcgcaggtgttggtggcacctgctgctgctttactttcttgtgctttgctactgcatgtccagggtgaaaatgagccacaggcccagaagggcagacttttggaagctggtcaaaatgcttgatgatgctttgtctttgtggcagaactcagtctgagttgtcatcctctctgctggccctagccctgggacccagtcagcaagcacgtgtccttttatttcacccggctggtttctgcctaaattcattgtctgctgaataggtcagaggttctcagatgaatgctcttatatattagtttgtcatttactaaccatgtagttccctgcatggaaattccaaatgtgggctttccttgactgaaatggacgtgcctatgcttcttgtattctcaggcactttgtctaggttgaggaatgttagtgtccggtaactttttacgtagagacattctgccctttgttctgtcttcactatactcttaactttggcttgcatctctacttacatctttttacccttttttactcagtcaagctgcataatgttattgcataattcatcggtacctttattcttattgaacagtcacaggcagagtggagctaaggatggaccccagtgaatcggtaggcattgctttaaggtggtattttatttgaatagtgtatgccaacttttcattccattcccttgcatagtgttccagtaggaaagcaagtttcctagtgtatcccctggaggacgagtctcttgctttctacttttagcttacagcagcacttttcctggcaacatttcagttctggccatagctgcactaggatagtcattcccagtccacaggaggagaggtggaccacaccagccgcccgggatcttggattgcagaggtgactggcctggaggcagatgccccgacccctgcagagctccaccccagacagggtgtttccaaaggtgctgagcagaatttagagcagtgactaatttgcattatatgataacatctggtaggtagctctggaatcaaagaagggaaaatatgagccagctacattggggagtgtgaacttggagcattctcttcctgcttctggtcctggtatcttgaagatacacacattaggttgttttcctgtgagcagactgtctatagagaaggatggaacagtcttcaccaggtgggtgtagagatagattctgactcactgcaggactgcactcagactcaatggcagcctatcaagaggcgtgccagcccagagataagcattggagatagcagagaaggcttgaaaggctcagtaatgaggatctgtaaaggaaatggttttgaaaacataagataggcatttaagtgtctgccttaagagaagggggaggtaacaggctagcagaagccaggaaacaggacccaaacaaaggcagcctggcctagtgcctgggaggacctggtgctagaacagcagtgtttgtttatccaggcacacactgctgctcctctcaaggggctggctcgaagtccaagttctgggtgaccctcagtgcctgtagcattggagataaaagcttaacctagatatacccagtagttacaaattgttccttagtgagtgaatttatcagctaactaacattaaatgttgccatatcctctttattgtaatggggagttccttagaaaactggttttgagtggagagctgtagatggcctgtagtccttgataacagtagccaggacgcttgctctggccagtatctgtctgcagcatatgggacaggtggaggctgttgagagttccccttgcctcctgcacttcctgtaagccagcactgcttgactggttgtgaagatttctgtttgtatctaggcagctcctctgagggtgggacttaactctcagaggccccattgcagtgagatagagggcctgctagtttatctgtggtacacatggcccatggcaagggctcagtaattctgcttaaccacaagtgggactggctcatgtcccactcatgttcacctcagaacttttcgctgctatcttaaagtcttaatatactaaatatacttaatattaaaatgccacctgaattttcaattgacttttttacatttactttgtgtgtatatggcacatgtgtgaaggtcagaggacaacttgtgggacttggttctttccactgtgtgagctctgggactagaactcagtagttaggcttagcagtgagtgcctttaccagatatttcatcccactggaccttttaaatatattctatttgattatatacagattctgtgagcccctatctagtagttacatctcattttttgtcttgattttttttttcttttttttctttttaaagacatggcctcaggtagctcagcatggcctgtgtagtcagagatgactctgaactgctgccctctttgcctctatctcctaagtgctgggattacagatgtgtaacaccataccctgtttatttggtgctgggacggaatggagggcctcatgcatactaattagacaacactgtaccagctgaattgtttccaccccttttacatctctctattcaggctccagccaggttagactggaccctggtaagtttattcatgaagttttattcagtagtaccatttcctaagctagacctggaaacagtcttttatctgatggctgaacagattctaggcagacacttgcttactggtggttgctgtgatgggcctggaattgggggcaggagtgcactggggacgttggggaaggcacacctcaggacacactcagtgtgagtcagtctgtgtgtctcctataatgattattttcttataagttcagcttttaaaaaagcttttgggatccccaaatacacaaatgccatctaaagctgtcattgttcaggatgagtgacccatttgggagcttaggcagtaagacactgtatctttgttacaaggcatctttgtctgcagactcttgaatttcttttttttgccttctgcctcctacctaaaaaggacaaaaccagaacaaacaagaaaagatagccacaggaaacagtggtggaaggcattgctgcaggaggtgggagagagtgtgttaggattagagacagcagcattgagactccaggactgactgacttcgaccaatcaaggatcctgagtctggcttcccttagactaaatgggaacaactttagtttaaagattctctccgctacccacctttaccttcttctctctccactggcaactctctcgaaaaggttctcaatgcagtattttatttagcaggtattattttttactataatctaagtacttatttaaatacctttccatttaatcttactatttttttaaaataggtgtttgtgcgcatgtgcacacatatgtgtgtgcgtgcctgcatgcgtgtgtcagggtccacagaggccagaagagagcattggttccaaggaacaggacttagaggcagttgtgagctgccccatgtgagtgctgggaaccacacttggctcctctggaagagcagcaagcactcttaactgcagagctgtttcgatgcctttatttttatgtttcctctttttgacctggtctggaactgaaataaatggaaccttttcagagagctgacttcatggccacatatgaataggtttagctctcacgctgtgtaatgatccacatcatccttaccccagtgcttttaatatgctgctgttcttaggtagaatgtaaggaagacatatagtcattagcttctaatatgtatataacctatatattgatcagcttctaatggggagaatagtcatggtgaaggacttagggtggaatcaagctaactcagttttgctgagtcaaagtgatctgggactcaccatcttcctgcctcagtttccctaatactgggattgcaggtgtatcccaccatttccaactataagtatgccttgttttgttttaagtagtgggcagatctgtgaacagtctgtggaaagcttggtcagagcaagcatgttttcctgataaatgattcccttactcttgtgtaggagacaggctcttatctcttgtagagactaagcatacttgggaggcgggcttgcctctgaccttgggcaagtgttgtagccctcttgtcacacctacctgatctgcttgggtgggtaccatggagtactcaccttctgaggtgttctaaatgatggtgaataggcttggcaggcagcaggaagtactagatctggattagctgttacatattcatagtatgtttcagtgggaggtgcttatgcaataccaggcaagtcacattgctgttattttcagctggacgagaccagtttcttggtctgaagatatcccatgtattcagttgagcaaacattcattgaggatcagtgtgctagacattgggttggtcatcagcaccccagcaatgaagggatccccaacttctaggaacttgcattttctttgtggtgttctttgtcttcccaaagtgctttcaagatcaggacacaatttgaaaagcaggagaaattccaaaaatcgggggagccatccacccagtcacccagtcacctacctacctaccttcctatattccatatgtattggtgttttgcctgcatgtagtctgtaaaggtgtcatcccctggaactgaaataacagaaagttgtgagccgccacatggttgctgggagttgaacctgggtcctctggaagaacagccagttttcaacggctcagccattgctctctccagattccttccccccccactccccaaagaagacatttaggatagattaaagtacattgtccctcctcagatgttgctgttaccactccaggaagattctgtctgagttggatgtgggattccatattggcttattcttgctgaatatgctgcggtgaaagcagccaacttgcttcgtaaggttaacatgttttatggatgtgttgtctgcttcatgacggtgaaaaatatatttgtccgtatcagatagtgatagcaaagaaataaacttggtaactttacatttaaactttttaattttttggagtagggtgtagtagtgttgcctatgttcccagcgtttcagagactaaaacaagattgtacattcctttgcacattagactacccagtaggatttattctcttcttgcagtggtagccgccgaccgaactgttacgtctcctcttcaggggtttggatgacaggtatggatctataggagcagtcttttttttttttttttttttaattaagaaaaatttgtatctgtatgcatgcatatgggctcgtgcccatctgagtgtaggtaatctaggaagccagatgacgtgttcaaatcctctggaacgggagttgaggctgacatgggtgttggcaacagaactcgggtcttctgcaagagcagtacacacgcagctgccgctcttaacgccacgccatctctgtggcccctgctgttcttggtcagaatcttccttttcactgggttttcttctcagagcctgctcttctcctaagttgtttttgcgtggcccttctttctgtactcattaaagttttaagatctggctaaaagaaccacagggcggaggtcctgggcaactgccatcgactcctaactcatctcaactcagaatcacacttagatcatgtattcatagcaggcagaggacagaaaatatggcagctttttaggttagcctaggcgaagactagtttatacactggagaatttctttcatactgtttagaagcagttttaaataatctacgctgtttgggaggttagtggagttgtgccagtctttctggtttgttgttgttgttgttgttttaattaatttattttttaagacaggctctcactgtcttgactgtcttggactcactatgtagaccaggcctgcctgggcctcctgggtgctgggattaaggtgtgtgttatacaacgcctgccagttgtgccagtcttgacccagcattcccattgtccactacatgctcagcagagggttccatggccatccctgacaggagtacttggtaggttgtagctctctcctgtgtcccagctccctcatgtatgtagatgaggacccaggtctggccaagagccagtgttttccctagttttctttgataggagctaatagcaaaaggtaaacttactatcagttaaccaccccaaacccaaaactgaaaattcagaatgctcctaattttgagggcttatatgctgccacaagtggaaaactttatacccgatttcatctgagaggtcacaggcaaacctaggtacatagctggggtgcggctcagagatggagcacgtggctccctcactcatgttagagcttgtgctcagcgctgtaaaccacaggcaccgaatgcatgcccactcagaatactctctgaaatttccttcaggccatgtgtattcctatatgtaaaatgtaatttttttgtttgtttgtttagacttgggtctcatccctaaaagcattccagaatctgaaaaaaaaaaaatctgaaatctaaaacagtctttctgtttgtaattgtttgcagtatgtgacactcagtttgtacttggtagtttattcctgacttaggaatttctacccttcttcccagggaattaagctagtgtatactctttacccagcagcacagagagcacatagtaggtgctgctagacatttgtgttcgtgttaatttcttctggtttgctgtgaaggtggagataaggaaaagactctacagtggaattgacttagaaggacatgtgtctgctgtatattaaaaagcttagtggataaaagtggacctattcttagctacatgggattcttgttttcctcagtaacatttattcgactattttaaggaaatcatggaaaatattgacttccttcctaatggtgtcccctgaggcttcctgcactgccactgagcttgctccacacgaatggtatgtgactctggacctagcttcagaaatgggaaatgacttgagcaacaattgcaaggaagtagaggtcagaggtcagcattgagaaaactcagcgtaagagtagaatgttgtagccgtttcccacattccttagcagtgttttgggcattgaagctcttttaattgagaaaggaaacgaggtctttgattggcagctgggtgatggggctgtgcggtggaggtgcagggaggcttctgtctacagagaaacttccaggaatgaacactggatttgcaagtttcttagaagtagattggactatcagaatgttcctatacgcaggctactttgagcttgtggggagagaaatggattttggggaaacattctaatttaaaaaaatgttttattctttcagatgttacttcaatcctatgcaaatattttgaactttaagagtaatgtaccacatgtacttgcataggtctagaacttgtaagaatgtggtatagcattagcattacctggtattcattcattcattcattcatttatttttatgtatagtcccagctggccttggaatttgtgatcctcctgcctcaacctcacaggttctggtgttagaggcatgtactaccaaccactcctaattcgtttttctgattccaaactaatgttctagtaagtatagtttcattgtgtttcctttcctttcttccttcctcttttctttgtgtgtgtatgtgtgcgtgtgtgcgtgcgtgcttgagtgcgcatgtgtgtgtgtattggagtctgaactcagtctccatacattttactcatgctctcccaccatgcttccctccaacccttcagtaatataaagctgactaggtactgggatcttagggtagaaaagccgttgaaatacatacagcacataagagatcgtgaacagaccaaaagtaaggggcagctgtgtttgtcttcagagtgtgaaggctgtggcaggggtgttaagagctgccctctgtgctgggcggtagtcgtatatgcctttaatcccagcactcgggaggcagaggcaggcagatttatgagttggaggccagtctggtctacagagtgagttccaggacagccagggctacacagagaaaccctgtctcaaaaaaaaaaaaaaaaacaaaaacaaaacaaaaaaagagctgccttctgagggaccttagcacatcattttatgcatgagaccttcttctaggggaaaaatagtatgttgactgagttttatggattgcatcccaccaaactccctccgcttatttgcttcataggaatacttattgtgcagtaagcttcaccagttttaagtattctcagattaattttaaaaacgtgcagctgtggaaacaggaacgttcattgtcttgaaagtccgtggcttcttcttcacagttagtatctccctcagtgggccaggcagctacttgtcgtctttctgtcacggactcattgtcttgtctagactttcagataaatagatcattttgtatggagtccgagaggtttgacttgattcacatagcttaagctttcgaagcccttgtgctgcgtgtgtgtggtaagcgtttattgccgagtggagagatccctctgtatgatgtaatggtgtgttccttacctactggtgaacttaactttgcttttctccctattctggagccgtgatgtttaaattttttatgaatgtccaagaagccttttttaaaggtattgtttctttcttgaaagcacctagaataggttgatgtgtctgattaggtggtgatgtttaattttaataaactgtcaagctgtcctcagccatgtgagagttctacctccttgtgtaggatatctttgttcacattcgacattagtcattttgtaagtgggtagtgctgtgttttgttactgttactagaatttgtgaagtggctaatggtaggcaagggccatcttctgttctctttggccatttgtagaactccttttgttttcagtcagatcttctcaatttttattgagctgtcttattaatttttgaaagttctttgtgtcatagatgcaaatgtttcattagatatatagtttatactttttctactatatagtcggtgttctcatttttgtctttatttctaaaaaatggagatggggctagagagatggctcagtggttaaaagcactgtctgctcttccagaggacctgggttcaccaaatcttagtacccacatggagagctacatctctttataactccagtttcagagagtctaatgccctcatctggcctctgcaggcaccacacattcacatggtgcacagacataacctgtgagcaagacatgcatacacataaaaaattaataaacaatcaattgttggttgttgggttttgagataaagtatcactttgggtctcacattctcaatcttgtccttgtgactacaggcacacaccacacacctagctataaacaatggcttctgagaataaatgttttcaattttaatgaagtacaaattaaattttttttcatttttgattctgtactttttgtgtcctataagattttttcccctgaaccaaagtgacaaaaatttacaaaggtttgtgtgtttgtgtagaatacacaggctaggagtagactgttgttactgaggtctgaaatgcactctgagctaatccagtgttcagtggacatcaacagtcattatttgcatatgcctattcatctgtttcagcacaattaatggagactatctctcaccaaattgctgtggcactctttttgaaaatatgtcaatcatatgtgcacatggcagtgctttagattgtcagtgctattctttttcgggtggaggtcaaacttattcatgtgggcaggtattctcccacagaccacatcctcagctctctgtcacacttgtcctttgtttgttgcagctcatcttttgtttattgaaacaggaatatgtcatatggccttgaactcttgtttcttctgcctcagcttcccgagagctggcgaggattgcaggtggaaaccaccctacctggctgcttttctaatttctctgaatgtccctgaattttaaacctatgaaattaaagcttataactgactcacatcagtgagatcacaaagtagcctgtcccttccctatcatctgagctagctggtgcttctgtttatagctaggagcaaacaccaacaatggtactctaagcttgtacagcaacagcagactagaggggagtgatgcattgtgcctgctactagacaggacaatacagtgatgcttgtatgctcacaaagcaaaagctagagactatgaaacttacaggaacagtaaaacctgctgttcagagagacaggaagtacttggatttagcccaacttttggtttggggtcttagattagttttagacactaagaacctgcccaaacccagtagtgtctttttttctctttgtaaaatctctcacatatgactatctggttttatgttaagattctgttgaatggttcttctaacttaaaatttatcagagataagctgttaaagactggcaatgagtaaaactattgagccatgtgtttaaaaagtatgtttaagggctggcgagatggctcagttgttaagagtgccgactgctcttccgaaggtcctgagttcaaatcccagcaaccacatggtggctcacaaccatccttaatgaaatctgatgccctcttctaaatacatacatacatacacaaatacacaaatacataaatacataaataaataaaacaatttttaaagtatgtttatagcattaaaagtttggtttaaactatgtactaaagaaatatattctttaaatctctttttctaattatagtacactctcaatttaatattaaacctacagaataaacctaaatgaggcccatgtttttctaactacttggagtcattaatttcacttaaaaccgattttactttataaatgtctgcttgtgcttactgcaagcctttgctgtcagtagcattctgttctggggctttctttttaactttaaagagtacagttcttacgacgcttagacgtgattggtggatgctgaaggaaaggagtacttattgggtgtatggtctcattggtccccgtctggaagatttgagtcatgagcatgtttgggtacattaaaatgaagctttacctccttggctctttattaaaacttcatttttaggtttttgggttagtttgttgttttgatgttttgtttttcacaacagggttttctctgtacaaccttagctgtcttggaacttgctctgtagaccaggtagctctcaaatcagaactcaaagatctgcctgcctctctgcctctctgcctctctgcctctctgcctctctgcctctctgcctctctgcctctctgcctctctgcctctctgcctctgcctcgagtgttgggataaaaggcgtgtgccaccaacgccctggcacatttttatgttttgattgttgagcagttttcttcctcactggtaagaaacttacctgactcttggcaggcagaggagtgcatgtgctgtacacactcggctgtagcgtctgcatgcctggcgcccgcacactatgccccactcccctctaacctcaacttgtagtccatctgggaggtgccatgacctcaaacagaaaattcctcctaagtagtgacagtgactgcttttgcattctctttccccccgaagggaaatggcctccaaataggcctactctagtaggtgcagtagtgggaaaatgaagggccatgatgctgttagctactggacagatggttggagctgtagaaatgcagaagagagaggagaggtgaaattcagtattgctattctcaggtttgactaatgttttaatggaagtgtgatacacatttaaaacacattttaggtacatggcttttgaattatatgtgaaaatatcagtgaacactcttaagtaaaattttatttttaagatttatttgttcttattttatgtgcatgggtatttttatgtatggatgttttgcttgcatgtatgcttgtattacacatgcattcagagcctgcaaggaccagaaagaactggcattatagttgcgtatagttgtgagggttctgggaactgaacctgggtcctttgggaaagcagtcagtgctcctgaccactgagccacctccagcttcccaagtaaaaattaatagactatccagctttgccataatttttcattggaaaatacattagtaaagtaaccacctttatcagtagttattgtcttggaaagtacatggatatgtgtgttttcttttgtgtccttgtgctgaaagtttgaatattccacaagtaaatactttctaacttagtgactgagggtggatgccatcacatggcatacttctggttttctgaaggggcgagtacttccaaatagtaagccaattggatatgtggacattgtgtattgggagaaaatgcctcctgtagttgatgtaagacagttacttggactcttcctaaaacttttgcataaaaacaaccaaagaaatcctgtatagaatgtgggaaggaatattgactttataaaaactgatatatcaaaataaagttaatgaaggacgtttgaagtgtgtagttggagctggcacttgtgactgccccagtgaggttacagagatgagtatcctctccagtctctttgtcatcttttggcaacaggtcttgcctttctctccttgtgcttacttagtatattctaactttgtaaattaacatagtaattatgtgattcatttgtcagattgtatgtgttgatgattgcttttcttactgctgcacagtagtctgttgtgggatagttatcacacagttgccagccacttgcccaggggcggaagtgtggttgtcacctgtaagcatctatgtagaagtcactgtgtctgtcttgtagagatccctaggaatggcatgtgtaggtatagacgtatacttaaccatttcagaaagtacaacttgtttttcagagcggctgcgccagtgtacactcgtttccacacggtgagcctcagtcaggtgactataaagtgctgatgtctagcttggcaggtgggtaagctcatttgtcagctcacaaatgactagctttagttgattagttcagtcaactaaactagtgtggccttttctctagtgacgggggatctttgttgttaacttttgagacagtgtcatgtagtccaagtcttgggcagtcctgcctgggctccacgtgctgggatgacagtcatgtgactagcaacggtgagcgtcttgccctgtgctcactttgctgccattcagactgtctttacctaagtgctcatcaaatcttctctggaggttcacggttgagttttcttaatttagttgaaagctgtatttacatattctagatacatttgtatctaatctaaatgtatctcaagtttgttttgcaaataccatttctagtctgtggctggtatctttactatagtctctagaaaactttattattattattcactttaatcatatctgacttttctttcagtttatggctgtgcaggcttatgttcctgcattacagcttcaaacctcaggctcactaacattttctcctaggttgatttctagttttagaattttagctctcacataagctttagtgttgaagttgatgcctataagtactgagctctggaaatttccttgtctatatggctattcatcttcgtatggttcattgaaaagattattttcccctattgaattgctacatcttcatcaaaaatcacttgacctcatgaggtggggtttgttttctgaagtctgtgttatctgttgtgtttatatcagtgttacaactggtcataatgactatggctttaagaagccatgagaagagttaagacacccactctttttttgacttttttcaaaattcttttaggttctttactttcccacaagatagaatcatcttttagatttctaccccccaaaaagcccgttaagattttgaaaataaattttatgttatttattatgtatgtgactatggaggagtgcgtgtggctcctacatggaggtcagaggacaccttgtggacaggccatcaagccatcaaacaccctaagctctgagcgtctcactgcttcccaaagctctgaagtcagtactgcatttctaggtaacaggtgctcctggcgtttacatactggtgggctgcatttgcatataggattgcacagatgtggcagtgaccccagcttttcttgtgtctttggatgaatcattgattcagaaaggggttggggactttgtattcttctggcttctagtagagttcatttagatgattttttttttcttttgagagagggtctggagagagagctcaacagttacgagtagtactgctcttcaagaggacccaggtttggttcccagcaccctgtggtggttcacagcatctgtatctgatgtttccttctgatctggaaggaaacaaggcatgcacatagtacacacacatagacacacacaggcaaaatacttaagacacaaagtacaacacttaaaattaaaaaatcatatttggagaaattcatcatgagtcaaagtaggcctggaggtagtttgtttgttttgtttgttttgtttttctgagaaggcttttaactacaaactaattgtatttggtatatatgggactattcaaaataaccccttttttttttctgagtaacctttggcattttgagtctttgaaggaatttgcccatattgtaacctgagttggtgaccgtattgacagaattattgacattgctgctggtcagccttgtcacaattgtggaagtatagctgaccctggcttcccttccttcgagcatggcgtgtgtcttttcatttccactgtccagtctcctggaagcttacccactttatcactcttcccaaaccaaaagccatttgtaacatttgcgtcttctgttttccgctgttggctttctttttgtgatgctgaacattgaacattatggtaggcatatactggcctgcaaccaagcccaattgttatttatattatttcttctgttttgagtgtaagctactcttcatttctacttcttcagtcatttgtggagggggttatagggaaaacatgcaggatatggatcatctcatgtttagaatataattttacatattgtatcctgttcatttatgtaacatagatattacagctctagaacacatgtctatttattattagatattgtataacacaataaaatccccctctagtagctaaattgacataagtggatcatttaactgacactttctgggttttgttttgttttgtttttaagatgggctctcttatgaactcattgtagatcaggctggtctcaaactcaaagagatcctcctgcctctacctccccaagtgctggagttagaggcatgtgccatcatgtctgactttaactgacattttaaagatagctgtaataccactattcttacatatatgtcaaaagcttattatttttaactttttataaaactatttatttattactatatctaagtacactgtagctgtcttcagacacaccagaagagggtgtcagatctcattatggatggttgtgagccaccatgtggttgctgggatttgaactcaggaccttcggaagaacagtcagtgctttaaccattgagccatctctccagcccctatttttaattttttattgtgaatttcccatcaagcaccttaatcccactcatctccctgcccctccatatccaccttccacccttgcaatttcctcccacaaaagaaataaaaataaagataaaaacaaagcaaaatgtcatgtggaagctgtggtgtgtcacacagtaaaccctttgtccacacttctttatttgcagaagttcattgcagtgggtccctggtttgctttgagtcctctggcttctgctacaccatcaataccggttcttcactgggattcctcccagatttcctgttgccctttgtcatggaggtcccacagctttggatctgcagtcccaaacccttcacaggctctggcagttcatagatggtgtagatagatgttggggtgaaacagttcagagtcctggatctgggcctgggtggtggctgagctggtcagcctgccagctctcctgcatttacacctccagggcctgctctccagcactgctccaatgccccactggctagctgggccagcaagagctgtagcctgctcttctgccctcatgccctcagggccagcatacccacttcccccaccaccagggtcagctctactgtgctgcccagtgagattcggggttcattctcccaagggctgctaccattgacgggtgggaccaaaaagtttattattactgtaacagttgtggtagcagtaaggacactagtcacctttgtaaccagcacttctcacatggcatacttaagtgaatctactgcaccttgatatgccttgtaaaaacacatgtagctatctagtgttagattttttttatgtctacataagtgccttttctttttgtaaatgtttttttcttcccctatctttccctgttccccccttctgtagcaagaatttgtaatcctccccttcagcctccagagtgtcgggaattacaggtgtgttatactattacacctggtctaagcttgtttggaataatttcaaacgttagaagtgtatggggaggagcatgctgggcaagtagatgaccacggttggcagttcccttagcggctttgtttgcgcctcacttccctcaccacacatgcaggcagtattgacagattgtatgggctgtgggcttggtgagctgtgccttgccagcatgagactataagtcactcactccccagcactcatgtaagaaagccaggcacagtgacacacgcttgtgatcccagcaccagagaggcagaggcagatctggagctcattgccaacctggcttatttggtgggctccaggccaacgagagaacctgtctcaacaacaaacacccaaggtgcatgtctcccgaggcacaccatctgaggctggcctctggcttgcatgtacatgcagacaaacccatacaaaaagaatttttacacataaaagagctgttaagtatgaagttctgggatatacattatcttaccccatgcttatatagtattgaaatgcaattaaggtagattttatagaaaagatttagaaaacagaacaaaacctggtgctgtccttttgttgttgacttaaaattttgagaggcttgcgctgccactcagtggtaaagagcttgcctaacaggggcatggtctttagtttgaaactcaccaccaaacaatgtcatcccacccaccctctctcgagatcaaacagaacttccttacacatacttgtaatcccagcacttgagaggttgaggcccgaagatcatgatttcaaggccagcttaatctacaagatgagctctttcttaaaacaaaaaagcaaaacaagcaaacaaaaacaaaaccccaagggccagtgatgtagtccaaaggcaaagcgagctggattcgctctacctcttgggttctggtcgcctgctcccagagagccacttccttgatgaaaagttgctgcagtgtgtatgcccgggcaggtgcagtgtgtatgcccgggcaggctgtgcttacaggggtttgctttctgaccttggcttttttcagggttcatatattctctttttactcatggtcttgttttaaaatggagagcagtacaagggggtgggagtcgtgggtggagtgtgtgtgtgtgtgtgtgtgtgtgtgtgtgtgcgcgcgcgcgcgcgtgtgcctgtattgttttgagacagggtctgtaggcctgggtggactagaactcatcctcaccatgtagagcaggctggcttctctacccattcctctgccgagattaccagtgtctggcactgtgccccatgactgtgttgtcaaggctctcatttgtaccagtgggaggatcccctccagccctgagctcacactgtttcttctggttcttctgcatccttcagcacttgtgatgttctcagcttcagcctctggtcctcttgctgttgtggcttccagggctctgctgcacagccaagcttgtgtaaactgcaaaactaaacttttatttccttaaaagacaatgattatttgtgtttcttaaaaatgaaatggtcagaagatttaaagttctggaaggcctatgatgtcatgttggagttacagcaggtgatgggcatcaacaaaagctctgtactgcctgagggcctcctgcccaccacctctgttctcaggcctagcctcatagggctctgcagggtctagggagacataggaatacgctcgcagccatcctcggtcaggggagctgtgtgctttgagaattattcccagggtccgtttggagccagctctctgcaggtaacagggatgtgtgtgcggaggaacagcagccaggctctctctctgcctcctttttaggcttgttgctgtgtcgcagtgttttacaccagcaaaacaaggctcagtctttagtaaaaatgtcagaaacttttccctaatagttatttgccctacaggatgaaatcggtttagattaaaagcaaacctgaaacaccttgatctctctgaccaatgttcctaggatccaaactttctatagatagacagctctgtgtcagatcaaagctgtccaggtggagcctcacagggactcagcgtacaggtcacgtagacagctctttggaagtgaacctttgaaggcctgccaggccttcctgcctccctggtgactgccaggctggttcccactgtggaggtgactggtgatagagttgccacaaagccagagagaagagaatgggagaggagccaggtaaatgccaccagttccgctgggtatttttggtgtcttttagaatgtgagccagcactctttcaattgttggtcgctttttgtgaaagaaaggctttccagagctcttcaatgataccattttcatactcgcatcaaaccttttgaaagtcaaaaaatactgtcaagttagtctgtatgtacagaaagctgtcctgagattttcataggatctaatgaaaagattggacatatttacatttctcagccaatgagtatggcatgtttgcccatttagaccttttatttgtttgttttgttttgttttgtttttttcaagacagggtttctctgtgtagccctggctgtcctggaactcactctgtagaccagaaatccacctgcctctgcctcccaagtgctgggattaaaggtgtgcgccaccactccaggcagtccatttagactttttaaaagtatttttccatcggaaaatattttctaaacttgtttggtttcttgcatgtagatagtgcccttcagtttctttcagcccctgtcgtcattgctctcgtccaccccttgcaggtcccgccaaactctttcctcctagcaaggccgttgtctcccactccccgcccgccatgcccatgcccacgcgcaccatatcttgttgctttgtggcccaccaagtagagttagggctactttcaagatgggtggtgagctattactggagcagggcagcttgccagtagctgcatcactaattatggaggctttggtttcctttgtcatctttttgtagattttagtatatgtgtgctatacagtacctaagtatttcattaaatttggataatttctcacatatttatgttaatatatagaaatatgattctatttgggggttgagtttgtatttgcaaatttgcgaaacttacttattctaagtaattcactttttcttttctttttttatccctctttgttattacaaacacaattatctagtctgcaaatggagacagttttatttctttggggaaaaaagttgttttagtcttcttgtgtgcagggtttctggtagtatgttgaacaaagtgccgtcgagagcctgtgctgcacaagccccagagagtgcactgaagccttgctcagggccgcctgaaggcgagcttggggcagtctcacctccccgccttgcagacagttctgctgggaatgagcacagggttgttccggactctttcagttcttctgacgatcgagagttacatgttaggatggttgagttctaagttttgagacagtttgtatacctgaacaaaagccttggttattgcatggaatctatctgtctacattgctagattcagtttgttaatattttgctgaataatatgttgtatacattaaaattaatttgttctatagattgttaagtaacatttaattttacacttgtaagtattttaagatacatagtctggtaacattagtgttacatagacagttgctaggaaaccatcagtatctacttctaaaagtttcatcacccctgagactaaataagactaaatatttgttaagcaattaacttacccccaccacccagtttctagtacttttatatccattaatttgcctgctttagatacttcatgtaagtggaattagaatatttgaacttgtgtatctggcttatgtcctgtacgtaatgttttctgacccatatttcctgtttctatgtttgtgtttttgttggtccattcatttttggtggacactttgactattcctgcttgcttggtgactttgggtcttctgttagtcccttccttagcaggcaaggagcctactcacctcacaggtctgaagctgctgttgtgggtggtgggatccgtgattttcaaagccactcgagtgccacacggtgccgcttctgcccctgctgattcagctcctggcagggtcagggaggtgtaacagcctaagtttctgtgtgctggtgattctcctggttagggtgctaaaagtagtggttttcaggaattcattttatatattctaaattaactttattgattttcaaatgttaactaaatactttaaggtcaagtgaaaattaaattatgacatttaacagctataaagctattctgtaacacattttggtttgggcatgttcttgctgtgtagccagcgcaggtctcatatccatgatttttctgtctcatccttcatagtgtgtgattgcaggggttcactggaaacgtctatttatttaagttttagatgtattaaatcctgtacatactcattatataggattacatattgcattttagtaaacaatatagagaatcgcctttctttaagaagatggcaatgctgagggttttgatgtggatttcataccctagctatgtgcatatgtaacagttcaatctcgtgcaacaattgatgggtgggcccgcagggaagtgagcggtcagcactcacactgggaccctgatcccagtgcttatggatgaactttacggtagcacaggtaacccaggctcacagatagtcactgtgctacaaacccaacacagtagaccatgtctgtaatcctgacactcaggaggcagaatcaggagaatagcaaatttaaggcccgtgtgggctacttatagaatgatagtcaaaccttgtcccaagagtagggggttaggaagatagctcagtcagtgagaacttgccacacatgagaacctcagttcagtctccagaacctgtgtggaaaagctggagtgtggtggcatgcactgtgtcccgattagggtttttattgctgtgttgaaataccaaaagcaagctggggaggaaaggtttcttctaccttgtagtccattattgaaagaagtcagaacaggaactagagcaggggcagggcacacacacaatttacacaaattgaatttgtactttaaaaattgtttttattattgttgtgtgtgcatgtgcatatgtacatggggaatgcacacatgtcagagcacacacgtgaaggtcagaggacaactttgtggagttacttcttatcctacctgtatgagggaactaggaatcaaactcaggttgctaatattgatcctgagatttgctggagaaaaaacaattccacatttttggaccaagctttattacacatttttgaagtaagctttattaaatattaaatactgaccaagagatggactttggtcaggacaactccctggaactttgtgctgagtggcctcaagacatgtgttgcaggggtttataaagagaaacccataggccaccatacttttccatgaggcttttgttattttcccagaacttcaatttccagcatctcaagcaagaggttacctggtccttgggtgatggggcttgcaagttaattttgggtactagattccccccttgtgtcttgggtcaaatccttggctctgtgatgtgtgctcatttattttggatctagtgaccgtcagcttaacagtacccagtagggattagcatttagctattgtgtcagtgaggtaagagtcactgtaattagcaaaagcaagagggccaacgaccctgcgatggctgacatcagagctactgtctagaaagagcctggaatgggtggaacaccagtcatgtgtctcggtctcctttttatagtgttaattggctacagccatattataatcctgaaggtttgtacaaaaacaacaggttttttaaaattatttatttcatgtgtatgagtacactgtagctgtctttagacacaccagaaggggacattggattccattacagattgtcatgagccatcatatggttgatgggaattgaactcaggacctctggaggagcagtcagtgctcttaactgctgagccatgtctccagcccccagaaacaacagtttaaaaagtcacattatacttctttgttctatagaacacaggccaagtgccctataatattgtaggactattttagttaacaaacctaccagttgacaaatccaggcccacttttctggtatatcagttggcttacaggtagccattttgtcttgtatgtcagggagtttccttttgtcttagcatttcagcctatggtggtggggggatgattactctctttggtaactacttccagctgacattaggacattgttgtcagagcccaggaaggcaaggcaaaggctgggcaatggggcatttgtcagaagcatcagatgagctgatccagctgaagagactgagcaatcacacaggctagactggtttacatcagctttctgcaaagtccagagctcagcacttcgcagtccacaggtgatccctggatggagcctgacagcaagtgaaaaatctgttgagacaagtagactagggacagagttagtcttctagtaactggggaaagggagaactctcaggaccagtgggaaatcccgttctcaggactagacaggtgcagaaacttaggctgtacttaactggagactgacctgtgacaggtgcatcaagtcttaggacttctttctcccctgaaggtttacgtgggtttttagtttacaaaaagagatatcttagtgttaaattgtactgaaatctacattgtagaaaaggctgttaacaggtgtttgtaaaacagcaggaatagacccaagccgtgggtcttggcaaaagctatagctttaggctaaaaagcatgaacatcttttacactctttcctctctccagagagcctatagttggacagagatgttttagccggatgaaaagcatctttaagttcatatttaaaagacaaccaaagaaaactgacactgtgtgcttgtgatgatccgcagcagcctgtgctccatctccaggctgcagagctctgctggtgagtggtagagctctgaacctttgcacctcagaggaagagaagtacaggaaggcaaggatggagatgcttttatagttactttacatatcttagagtatgtttgagacttattaagcttttattgtcctaaaaccttcatatatctcagaacaatttttaaaaatctaaccatttaccagagacgtgaatagttattattgaaaacagtcattgtaaagcatgttcctttagtggaaagttacacctgaaacctgttgattctttaaaatgaagcctgtgagcaaggcaaaactgtatctttctcttagagacctagtaactttaactcatgaactaacaagatggctgcagccttgagggatggagctgacagagctacagtcatcttagccatcaatgtgatcagggatctaagaaggataaattataatcaaaatgacctatgtgtcaattaaaatgatagactaatcattacctacacagtcatcccaggctcctgtggtctccatgacattggggcagtctgatccactggttagcactaccacattccttgcacagtcctttgtaactgtgtcctttgccttcttggaaaccttgggcatcactgttaggatctggaaatctgtcatagtaagtttaacatgttaaatgccatattcggcagatctgacaggtgtgagggcagttatttatgaagtgtatctgagctaagcagtccttgtttgtttccaggtacttgctttagggtataccttgaaaacatgcatagaaagatggagctcttttctgtaattaattacatcaatacttagcacgactataagtataattctgagcatatcaaagcttaatcatctttaacagtttataataagatagcaatttttgaattgaagctcttcctgtatcaagataagagttttaactcataagcacagttcatagaggctgggaacttttctaatcctcccatggtgtaccattataaaatacagcagtttacttcatgactcagcttgccaaaatagctagagcttattaacaatgctgcagaaggaaggaggttgggcgtgcatccttaagtcagtctctgttagcctgaatagaccttaagtaaggagaaacattctcttagctagtgcttctcaacttttgtgtgactgtttgttgtgactgtttaacacggtttttcatgttgtgaaacgtccaaccataaagtcgttcttgttggtatttcacaactgtaattttgccattgagatgccattgttatgaatgtcaatgtaaacatccaacatgcagacaaccctaggctacccctgtggaaagtgttctttgacttcaagggatcctgaccataggctgagaacttgttcctagttctttgtcatcctgcttaaggtcattgtcttactgtaacataagatagaaatacttcagtttctggtgtctagctgtagccttttgtaaaaataaatctatttattaagatcactttttttcgagacagggtttctctgtgtagacttggctgtcctggaactcactttgtagaccaggctggcctcgaattcagaaatccgcctgcctctgcctcccgagtgctgggattaaaggcgtgcgccaccactgcctggctaaaagttgtttcttaaagatacccagttttaaaaaataattttctgtgaaactccaaaactttcttttaaagtttaaaatctctcaactgcatgctcttatacaaataaagtacctttttaaagagtaaagacacaaagcacaatcataattttcagaattcaagaccaagctctaacagtacaaacaatttaatgtctctaaaatcaataccaagtgggttactcttacaaagttttaagacaggacagaaattacataaaaatcttttgcaatctaaaagcatctctgggagaggtttcctttgttggcccatatcatgtggctaccctagtannnnnnnnnnnnnnnnnnnncaggggctgctgtccatggtggcagcaagccacgtgttgtttatatcccaggaatggaatgatgtcacatagcccctttaagattatctaagcacagacttttaattaccaaccacaagttacaaattttaagttaacaatttgttacagatattagatttttaaccatatacaataacttataagccaataattcctttagtttctgacgccagacacagactttaaaatcaggccttggtctgaaaaggggtgagccataacctagttccagagccagcttctcagtaaagtagaacagacaaaacaacttttaaggtcacacagtcaaacaaatgcagtggctgactgtaacagtagcagcatagctgtaaccaagacacaaggaacacagtaaactcaggcattcaagggagaccagtcagaaacaagcatgcagcagccatatacgtttctacatttaactgagcctgatgcagttctcacttagctccatgtttgcaagaaaacgtacaggcacatcagaagtcacagatctatctacacatagaacatgagcagacaaaacttttcctatctgctccactgttggaatttcaggggaggagcgccttgctagttgctgaatcccattttctcatgcacagtgctgctgtagcaggattggctgctggcttccctacaggcactctgggtttttgttttgttttgttttgttttttttttaaagctgttctctggtcccaagcattgcattttgtgaatctcatgcccccaaagactccaccaatttaggagtgacttttccaagagcagatagttaggcccagcctgacactagtgagacccaggcaggaggtagagccatgggtgcgggctctcttttgccccaagtcagaacacataaagagaccagacaagacatgaccagacatgacagttaacagttggagtcctcggcttcagaggttcactagtccttgttgactggtagggtaccaagctttttgagcacaaaactttcaaaacttcgttttttgtcatattttggctcccagtctcaccagggggtcaccagggagggactctggtgggtctgactgaactccctaattaaccagaaataaccaggagccatgaggtcatagacctcatcaggccagcccatgccagattgggatccaccagaaccggaagccaggcagacaggtgccatagaaggctaagataaccaaaggctttcatgacttcctaaaaagggaggcctccattaaaaacaaaacggtgtccacaaagtggaaagcacttccctgaggtctctgggtcagctaggttagttatctaaccagggttagcactcctgggtagctcatcccataatgataagataagtcttcataagtgaagagcaaattttgggtagcgttatctcactggggcctccaaatgagatttgctggagaaaactgaactctacctttttgggccaaatttgaaagaagctttattaaatattaagtactgaccaagagttggacttttttgtttgtttatttgttttgttttgtttttcaagacagggtttctctgtgtagccctggctgtcctggaactcactttgtagaccaggctggccttgaactcagaaatccgcctgcctctgcctcccaactgctgggattaaagacatgtgccaccacgcccggtggactttgtgtagaactacttcctggaacttccagctgagtggcccagaaataaacacatgttgcatgggtttataaagacccataggccaccatactttcccatgaggctttgattgattccaagaactgttaactccccggatcccaggaagttacctggtccttaggcaggtggggcttacaagttatttttggatattacattcaaggagtagtcctgaccaaagcccatctcttggtcattatttaatgttcaatacaatttgcctcaaatttggaccaaaattgcggaattggtttcctcagtttcccactgagccacttcatcagtccagctttgtattaaatatgctgagagataagtttgtgttttatctttaacataataaaggactcactactgaaggagcatccttcctaccgaagtgctccacacaaaccagtgaataaacatttgtgtttgcccagccctttcttgaagcaaaatcttgaacaaacagaacttttaagaagctcggaaggctattcacagtgagtgtagcaaaaagccagtttctgccagccgcagctttcactcttcaggttgtccttggggcacagggttgattaataagcaaactagggactggcagattgcggtgcgttaacaacgggcaggcactggggctgccaactgtgtgtgtgaatggaggagacagtcctgtgacaggcaagatgggctcctgagccctgcatgtgtggcttttgtcttcttggttttcatagaggatttaactcccctcttcctcttcagccaaaagagaccatgatctgaatgtaaagactgctcagcatatacttgtgtgcgcgcacacacagtttgtgtctctggcggttatttacattgctgttttcatcaaaaatttagaatgtattaagaggtaggtcaaccaattatcagttgcaatagttgggaaatttttccttcttcaaaaattatagtaaaagctgatgatagtggcacatgcctttaatcccagcacttgggaggcagaggcaggcagactctgagtttgaggccagcctggtctacagagtagttaccaggcctgtcatggctacacagtgaaaccttgtctcaaaaacataccaaaaaaaaaaaaaaaaaagacttgcctttatagcataaatgtcaccctcccccttcaattctgggaattaaaccccaagtgtgtctaagaaatttgactgaggaagagccactcagaatgttgatagcaccaccccgagctgcggttccagcctaggaaggggagaaaggacagtgagtgcttctctgccttctgactgtgggtgaactgtgttgggctacttcatacttctgtggccgggccttgcctgccacagtctaagtctaagtctaagtctgtctgtatcccatccctccctccctccctcactccctccctacctccctccctcccttcnnnnnnnnnnnnnnnnnnnncttaagttgtttcttctcagacacttacttggtcatagcagcaaggagagtaactactattgcatttccactgtgctgctgaatatgaacttattgtccccccacccccaaaccccctttcttttgtctttttccccccactttaggagacaggtttcttggctagtccaaaactcagtatgtagacttggttggtctcaaatttttagaaatctacctgtctgccctctgagttgtgccaccacccctgacactccagagtgcactttgttttctcgtttcttggtgttttgttttgttttgtttgttttgttttgtttgttttgttttgttttgagacaagttctagctgtgtagcccaagctagcttcaatctcagagtactcttttctttgcctcctgaatctaaataaaataaaataaataaaataataacttacaatggcatcatagtatctgattcataacttgaagttcaataacaataaatgctgataatctaaagttactataattggtcacctagggccaaatatcctaattttgtttcattaaataataaattctatgtagttctttataattaaagagtgttgattatgtgtaatacaatgtttttcttttatggctattctagcttctgctgttaattttcccagttgataaaacttacagtgttcttttaatctcctaattaaaagcatagtgtattcaggttactgctgctgtgttcatgagttagatggttgtatggccctgttgaacagttgttaaccacaggctccagacctagaggccccatgtcttgctgctctcctctgctgacgaggtgtggagctgttaaggaagctcctgttgtgtgcacatttggagccgctccctagttaagccattcttaacgagtccagtgttcttatgtcagttaagtttgtcttcagaaatataacagaaataccttctggatggtctgaactcacctttgtgttaaccagtgagaggcttgaagaatggagtgggtaagctgggcacttatggtgctggagaggtagctggtagcactgctgggttcattgtgctttcttctgaagggtctgtcgcgttattcaaaggttcttgtgcagaatgcatggatatcagttctgagatgagattataaactaggactagagggaacgtaactaggaaaggtcgactgtgccagcacagactccagcactgccacccaagccaaaagatgggtttcatctgcatgattaatatttatattggatttgtatttatgctgaggactggaagaggtgatcagaaatagaacagtttggctctgtgattgaaaaaaaaatgcagacaatgcctggggtttcccaaaataacatctttgagattgctgcatgaaggagtctggagtgctcagggagcaggaaacaccaccatcctggtaggcagtgtaatcagctaatttcttatactgcctggcttcccttttgttctcttatagaagctaggttgttgaggtttggtcttgctatctattgtaatgctaagtgagggccccccaatacctgggcttggagtgggggggatccaggaaggggagagaggtgatagtggcccccttctctcttcccaagtatttatttagtatagtttccttgttttgggtgttctatgctgggttacagccctgtgatacttggtccactgcttagactgctctagccttggtcacttgggactctctctgttaactgttacttctctgtacagattctcatcagcatgttttaaatagttgtattgtttttgttttagtactgtctactttctgaggatgctctgctcctattgtgtatgtcttatcccaatcctagaaatgggcatttctctagaagccccaattcattccattggaatagtctcagaacgtgggctgtgggtgaaaatgtggtcattactgctggggaggtcactggttaagtgaggaagaagtatatttcgttattctaacagctctatacacatctcactctctcccttagggttgttttgttttgttgttttaagatttgtttttatctttctgtgtgggtgtttgcatgtttgtctgggcactatatatatatgcagtgtatacagaggccagaagagggtgtcagaccccctagacctggagatccaggtggttgttagctgccatgtgagtgctggaaatccagcctgggttctctggaagaacagccagttctcttaatgctgagccatcttttcagccccatacctgcgtttctatttgtagcaattagtctatctcgactttatgctgagcctctcccaccctttgcttctatgtaaactcttggcccagcatactttgatatactgacatactttgcttacatcttacttagtcattcagttccagtgtacagtacagtggcatcagactcgctaactcctatggaagctgccttcatacatttataacacagcataaaagaatggttatgaataaaactgctataaggaatgtcatatatatatatatatacacacacacacacacctgtggacagctttcagatgattttgttacatgctaagatcatcattggcatattgtacaccacagctactggcctttgcgtctgccctcaagactgtgtgccttagtcatctgccttatttagtgtgcatcatttcttacagtagagtaagctttgtttgctagtgcctctatgatcgcttaggtggaaaacaaatgcctgtacacaacaggatcatgtgcagccggatgatctgactccacctttctcacaacagcaggcgtagataggtattttcaaggcaccttgcacagctgggttattgaagctgtcttagtattgatcatgactacatagcaaagcatttcagagttgctaaagttctgaagcattcgctgtattttcctcgtaaccattactctcatacaagcagtgtttccttggcttgttctggatgccagtcttgacctcagggccctcacaaatgctaattactctacctaccattggtctacattccccagtaagcaatatattaaaatgtaaaattgtatttactgcaaggcaaacggtgaaattgggtttctgttcctatcagtgatgtttggtttgttttcttgacagcattcattcagtcggagagcataatagaagtcctgcgctttgacgacggagggctactacaggtaattctcttgagtaatatgactattcttctttcctgccttggaaaccagtgtaactggttttcctgaagtatgttttatgaactgtagacagtcagtggagttattgcatgaacctcctactagaattactttttagagtaaacatttttctaaacagtggactccctgtgtagtatggaagctgtaggtaagtaagtcagagtttgtgtcctgtggctgtgagggtatgtaaaaaaaaaaaaaagccaggtcaaatgaggttgggtctgtgagctctctggttgttagtgctgagtgaagcactggctcagtgtgtgtagcttcagcatttacctagaaaagaacttctgtgcacagtgcaaggtttatgtctcgtctggctggctgtcacttgccatgctaagctatatctttaactgtagtaagcatgacattagaatgtggagtctggtaatactctgccttttctttcaagcctagttcagatcctctgacaactcattcattcgtcagctagagaacaagaactgcagagctgaaaggcattgtcactgccatctgcctcaattggctttgctgagaagggtctggtcttctggccttgtcttgtccgtccgtccttccttccttccttccttccttccttccttccttccttttaatagcccagtatgccccaagattgggatcctcctgcctcagcctcctgagtagtaggagtacagacatatgcctttatatccatttcagctttctgatttttctttttagattaaatttgttctttgacatttgcatccctgtaagcagtgcattctggttgctctcacccgaaactgtctatcgtgtgcttcctccaaccccattcttgttctcaagggcggaccctttaattcttgtgtgtgtttgcccaaggccatgtccgtgagcacgggtgtggagaccttcactggcatggtgcgggattacatacctgcactgcctcttatggcataggttatgagtctaaagctgaaatgtttttcacattttgttctgcatgtatgcttgtgtggctgtctgtggaagtcaggacaaccagtgggggtttgagctgtttctgctgtgtggttcaagtgggcctgacggtagatgccttttcctgccaagccatctatgtctttgtttttaaaagccagtgacagtagttttccaatttataatcccatcagagggaatttcttgatttatatttaaagaccttggcacagcccactagaagccccctcctgtctctgttgtatcctgtcactgttcttacttgatgcgttggtcttttgacttagataattgtgacttcaaataaacagaatttctttattcatgaagtttagcttgtcagctttttgttttgtttagtatgtcttatgtctggctgaagaaccaggttatgtggttggaaagatagctcagttgataaagtgcttgcatagcaagcatcagaacccaggttagatccccagcacccacgtgaggaagttgagcatagctgagcaaaatctcagagctggggaagtagagacagaggatcctggggctccttggccagccagcctagcccatcagtgagcttcaagtccagggaagagactatctcaaaaaaccaagtgaatgacttcctagaaataatacacccagggctgaccctcggcctacatacatgtacacttccacacacatatgtgctcatccatccatccacaagcacactatggatgatcgtaatttagaattttatttggctgctctccttaggtacagctacagttcctaaaataactttcagtggaggcagagggcagagctcccttgttgctgttcagttgtttcatgtcctttgctgggtgtcctccagaactttgttacccacttactctgaagtgacagtgtctcctggtcgactgctggtgtgagctggagctggctttctgggtgtcctgagcctgtttgtctttgcaactacacttttgaaagttttgattctcatttccttcctcttagatagacatggtccttgataacctttccatgttgtgctatccatgtgcacctgtaaactctgtgtgtgctgggtggttcttacactcgatctgaagatcaggttggagagaattacaactccctgggaaattaaatcagttatactgtgcaaaatagtaatagcaccctgacaagtacagtgtgcagaacattgtactagtgctaagggtagatcacaggaagctactaacacctttcttactcctgagtcttggcatgtatcattcctgtagggcacccctttcctatggtgatgggctatgtgcacagagaggccatgtctaagcttccagctcgcagccagcaccactctccctcctgtgaatgagcttcatggacaaccaatgaacacatctgacgcttcctacagatgtagcacaaaggcatgaatgagaacgagcaactgggatgctcgttcagaggagatgaccacctacaacccacagaccaagccactctgcttgggaaatgaaccagccccaggatgggcagtagtagtaaactgccttaagccactgtgcttcagaggcctgactttgcagcagtggataaccagagccctgctgtgatctgaaacctgcctgcgttgtactcattttttccccattgtttcagaaatccccttttgtatatctttgtaatgagactccagtcaaagctctgcacaccagagcagagctatgttcttggtagatgaacctacatggcagggaagtgagtgtcctgatgacagacaccacagatctgtgttcaggtcactattcctttagcaacaaactgaaaattttcagtggagtgttgttctgagctctgtgagctgtcctggtgaataagagagtcaggggatcattgacagccttgcatttatagctgatttgtcagaaatacaggtggccaaagtgcacaactgtgtatggagtgagggcacagccagcatctggattctcacctgactctgactgcttagatagtattagaggatagtatttgagtccaccaggagtagtatttccattatgtctcatgtgaagatatgttacatgatgctgtcgtaggaaaggctgccgtatgtagggatttagtggttttggaagtggggcactatgatactgctttttaccatctaagcaagaagttagcaatcgttctgtaaggatcagacattagctgtctgagggttcaggtgctagcagtctccacttaaccactcatctactgttactgtggtacaaaagcagccgtctatccctggtacctaggaagcaagcataaaaccagtagcagagtggcttggtctgtgggttgtaggtggtcatctcctctgaacagtcttgggagtgggctctctgttctgttagggaaagggaagggagaaggagctaggatcaacttttatgaaggctgagaatattcatctctataaagagacatgtaaaagtttgcagaagtttggaaagcatagaaaagtaatactattgggtattgcctaggcatgctttatttgttattgtttttgctctggaaatcagtctaagagtcttgtgtgtgctggacaagcactttgttgctgagctatagcaccggcctccaaattcttaagtgaatgtaatagacttaggcaagcagcttaatgtacagaaatcagtaaattaaccaagtaagcaactggtgagtgacagaaccgagccttcctgtaaagcttccctcttagccactgtgcttttcgcgtagactggagagcagcgctctgatgtgatgcagcctaatgcctgcattcatttctatggtgcctgttctcactaagcatagttttgttttctcgcactatagacagttctataacatagcaattaattttatatcacagtagccattcatcaagtcaggggccacaggaaatattcataattggtatgacagctgaacactttgaattatagtgcaagaagatgctactacagataaaaattaagggggccggaaggtggcttagccagcaagatgcctgctctgcctgaggacccgaactgggattctaaggcacccaggcatggtgcacatgtaacctgagccctggggtaggggaaacaaacccttggagctcactagccagctagtcttggcaaatttgcaagccccagattcagtgagaagagacccttgtctgaagagataacatgcagaataatagagaaaaacattatgtgcctgtgtgcacacaaataaaaatgaaaactataattagtaacatcataaagttcaggaaaatttacatcttgagccaagtagttcattgtttggggagtcagggaaactgtcctgtgcactttagaatggtcattcgtgtctttgttttcttgatggtaatggcatctgctttgtaacaattcaaacatctcttaaggtctggggaagtagtttagtggtggtgatggcctagcatgtgcagggctgaactcaggccctagacctttacgctcagcccacagggatccctgtgaccttgctgaggaagttgagctattgtgagctgcatttatgatgagaactgacacattacataagtgctcctgcagaggccagtgtggtggattgaaatagtctgctttcctcctgtgaatcctattgagaggtggggaaccgtctaaaaagttgtgttcaaattggtctggaattggcagcccagtggtgagcactgcatgcatgtggtgtgaattgcagggtgggaaggagtctgatggcctcttctggagtggcaggacagaaggataatctgggttcatttgggcattaccatgtttctctgattctgagaactttctttgaaccactagtggtagtcatttgtgatagatggtttacatgatatagatagtttctaggacccagaattctgctaagctctgtcgtggaatgtgatgggccaaatgtcccttcaatcagctggtaaaattgatttctctgtagagatgtcctctttaaggaagtaatctcttttcagacagttgtggcccatttactttttccctcacgcgtgtgtaggtgcaccacttgcatgcttcatgctgtgcaggtcaaaagcaggcatcagatcctccccacactggacttagggatggttgtgaaccatcctcagcaggaacaagtgctcttgacctctgagctattttctccagcctctgctttcctggagtgaatttcctgttcttgttctttgtttacatttcagtccccaccccctttcttctcactgctttgtgagagaaactttcccattatgaaacccctcctggtacagttactcagggcagggcatttgcttgctctgttacatggttttgcggcttgtcttgtgtctgttcctcctgacatgacttgtttgtggttaagctctagattctgacacttttaaaatagattttgatttgaccttcagtgtactgaaggcgaatttggtctcttccacctaatttttacactttctgttgtgctgccctgtgtttaggcccaatgttaagatacacgtaaagacaagtttaagattttatttctcagattacctcagagccaaaatagcatctcctttcagtacttggggcacagtgtttgcctgctgtgagactttattatagctaaatgattgttttgttgtgtctgccttatacttcaataagaatttatttgttctaatcttatttcttattgaatatcagctaatttttcataagatgttgtcttagggcttctgttgctgtgaagagacaccatgaccagggcaactcttataaaggggaacatttaactggctggcttacaggttcagaggttcggtccttcactatcaccatgctgggacatgggcatatgcaggcagacatggtgctggagaaggagctgagacttctacatcttgaacctcaagcagcagaaggagactgtgtccacactgtctgtagcttgggcttctgagacctcaaagcccaccctaacagtgacacacttcctccaataagaccacacctactccaaatgttccacacctcttaatagtgccacttcccacagccaagcattcaaactcatgaggggctcttcctagtcaaactaccacagagggtttgcagtttatcatcctgaatacttttgcttttgtccttgggatcttttgctacattgtctttatgatgttttattcctcaaaaagtacgcagggcaatagatttcttgagttttgcttctgtttatacaggagcatagctccttatgctctgatgttttgatcaccctttattcatctatgaacagcatacggtgtagatgtctaaattacacattgaaaaggctgcatgctgttttatactgggagatcataactacagtccagtagtgagcacacccagctcccttaagggtttcctgtgctcttattctccatctctaggtgacctctgctcagcttccagtcactgggttccaacattcaccatcataattttgagatttacttatgatatcatatatattaataatttgtcttttttgctgagaaatagtctgttatattagtatgttacagtttatgttcccatttacatgttataagaactttgggttgttctagttaaaaaaaaaggctgtgtgaacattcaaatacaagtcactatgtagataaatacttttatttctagaagttccatagagctattatatttccttagacatttctttccgaaattaatttgtgtacattatataaaatagggtaaagaaaggttcctgtttcctcgcttcatcatctggttgttgtgtcttttgagcagacattgcgttatctcttgaatgtcatcgatgcctttgctgaaaattaagagattgtatacatgtccatttctagacttgccgagtttcattaatctgtctttatgccactactactgcattgtcttgattattaaaggttttttatatgtattaaacatgggacttagacatagaattgccatttttaagtatgcagttcagcagaattaagtctgctcacactattctacagagacctccaccatctaattccagagcttcttccttccaagtggaggttcttattgagcagtggttcccagtgcctggcatctgtgactattctttctgtccatgactgagactgggtctctgcatctgctctcatcagctgctggaggaagttgtgacttcttagcaaggtggacatcctctggctcccaccttgccttgcagccttattttctgcggtcagtgctttggatgtcctgtgttcctcctctttactatccatgtggcttccatgtcatggttgctatcagttcagtgtaagcatcatcagctcttcagatgctctttccttgtgtgcatcacgttggaactcctttcagcatttctgtaaccagttctcagtgtgtaagtatttgttacttaaatggtttgccctttgattcccactgtatcttcagctcctccataatggcagcagctagagataccagcaccacactggcagttgggaggaagggaacactctggagtgtatgaccttacatcagagattataaagacttccctacaggatttgtattgtttgccaaacgttaggaaaccagtagcattagtttgtggtgtacgtaagattgaaccaaattgttctctcattctaattgcatagtgtgacctattcttttatgtgatttggaaccaggtctaacctgaaaatcaagggttggaatgggttgaaaataaaagacacaataaaatatgttgatgtttcttctgtctgtaatgtgcagctttggctttagcagtttcattcttgttttcttcctcttacagactgagacaacacttggcctcggttcatatcaacagaaaaggtaagtaggactcacgtggcatcatcaaacatgcttcccttccttggggtcctgataaacacgcagtgttgaattataaagacattttgctgtgtttttcttttcattctgttgttacttgttttgcttgattttggccaagatcttactatgtgactctggctgtcctggaactctctatgtagatcaagttagcctcagactatctatgtgcctctgcctcccaagtgctgggattaaaggcgtgcgccaccacacctggttttatgccacatctttgtaagtactatgtttggaaaaccaagttgaagtgaattcccctgtggtacagtaataagcacattactctggaatagtgtccgagactgtaaccaagacctggggtaatgaactggcaaagagaaaaggtctgtttgactcacagttttgaaaatcgcactcccagcacagcatggcaacaccaactcccctcatcagagagatagaggtggagaaagggccacggtcccacaggctccttcgagggtgtgctcctaatgacagaaagccctctctctcaccaagtccaacctactacagagtctggggaccaagctcccaaacatgagcctttcagtgacatataagatttaactgtaggtctgtccctgtcatttataaagggtctttactcagaacagaggtacccctgtcttgcaagagtatcataaggtttgcaagtcctttgggagctctaggcctgacacatccagaaaggcacacccctattctagcagattggaaattagctgtggaattatactggctgtagttatggagctgatattcatctggagagctggctcagtgtaaccattaagagcacctctgctcttgcaaaggaactgggttcagctctcatcacctacatggcatagtcttccgacttgacagtccagcattgtattctctttgatttgtctcataatgatatggaattttgcatatttactgtgttttctctgtggccagctttcctagccctcaggaagcaggggcagctagacctctaagtttgaggttagcctggtctacagagcaagtttcaagacagccagggttacacagagaaaccctgcctcaaaaaaacaaaacaaaacagacaacaacagtgtggagggggaggggatctacttgaggtgttgggaaagaaagctgtcatgactgagaggaactggtaaggaagtgaggtgagggtttatcagcctgctcgccatatcttagcatcttctatgagctgggttgtagatgcccctctttaggatcttggaggatagcagagatacagatctgaaagactctatctagcacactgggagaaagtatggaaatcggtggctgccgcctttgctgttagagggtatggcactgaaaacacaaagctctaaatggtatctgtcatccgcacggttaacctctgacctcagaacctgtgacctcgtactgacttactgttgcctgatgtgagggcacttgctatgcatggtctgctgttagggtgcacagcctttgtgggagagtaggaatcagttcaccaagctgagcaaaatttttctttaccaactgggatagtgaagtcaccatatggcatatattgtatatagtgaaaggcagtacaaccataaaaggctgttttgaaatgaaataacaaacatttatgcaggtactaacagcttgcaaactcaagcagctgactgaaagttgtggggtttatgattcattcattcacccgttcagcaaatatttattagaattcttatgtatagcagacattgttctaacctctgacactcattctccattgtgtataagaagttatcaatactctagcagtcttaaaaacaggattctttgaggtcagagtcaaaactggctatcatccaaagctgcagactagagtttgggcacgtttggtagcccatctgtaacacagtgcttctgaacaggtgacaggatatctgaggcaagctgactagccagattagtcatattggcaactccaagttccagtaagagactctgccccccatacacatgcacaaacaacacacacacacacacatgccccaaactcccaataaggtgacatcattgaagtgtcacatggaaaaactgccattgtaaaataaactttaaaaatgaagacatttccagacagaggtaagaaaaatgtgggcaagacagaaacacttgtctagcaaactttaggaaatgttagaggctgaagggtaattaagccattccaggtagaaacatttaacaaaagaatgaagagcatcagaaaagtaaaatatgttgatacatagagaaatgttttcgatgaagattttaattagcagatgtatagaaacaaatagttggatgttaggagactcactgcatggcatgtgtcctgtatgtaacagtagaacagaagactggagcgagcaaaagagtcgagctctttatagacagtgataagatgaatcctgcaactattaagactactttaaaaacaaagacatagctaatacacaagtcacagagggaaaatggtaactgagaatattcaattcttctgtttttaaaagatagaacaggagaacaaagggaccaaaaagcagtcagaaaaaaacccgcaaaaaacaaacaaacaaacaaacaaacaaaacctagaaagcaagcagccacgtggtagagtggagcagggtgagtgatgtacatgacctgtctgagcaccaggcgtcacactcactgtgcacttgctctgcaactacagagttgctttaaacttatactcaatactttaccttttaacaatagtttatttttggagaatttcacatagtatgttttaaacatgtttacctcttgtctaccctcccattctttcccaccctactttgggattattatttctttccccctccctttccccacggaatctagtttgtgttgctcagctggtctggggagtggctcttgccctggttcaaggtatatacccagtaaggaccacatcataaagagaaccgactctccttccccagcaactgtcagatgcccctagctcacctagtggtgggattctgtgccctccctctgcccacctctgtgctgtccacctatcagcacagagcttgttcagacctgtgcatgctgtcacaatagatgtgagtttgtgtctgccctacagtgtcttcagacacggtttcctttgttttctaccacctctggttcttaagatctttctgctcccctttctgagatctgaactcgatcctttgtgtttatgcagccagtcctcatgttagcccttgacatgtaattcttggatacgttaagtcagttgtcacattaatgtctttccttgtgtttcttttcctgactcttaaatggaataaatgatttgtctttcttatttttataaatgactttaggaaaaacaaatcaaataaaaagaagcagtgtctccctttagcccagaccaatctccaactcatttattatggacagtaatgaacccatatatagaagctgaaagtataaaatacttggaataaaatgtcagtctttcattggaattatttgcaacctgggcaaatttttcttaagataccaagaacgtgtaccataaagaaaaatggttaattagatttcatcaaaattaaaagtgtttgctgttcaagattcagctactaaaaaggcaaggggaatgtgttgtctgtgccagagtgccagaatgtccataatacacaggcagcccataattcagacagcagctctgtctaagagaggttagaacagaccatttaaaaaagacaagtcatttgataaataaatggaaagatatttggtatcattaatatcattagttagtggaatccatatcaaaacaaaattgtgtctgatatgtgttctatattattcagggggaaagtcctgttatcttaagtagttgctcatctattgtaaaagtcgttggcaactacttagctgtggatggttgttaactttttatctgcccctccaccatctgtttcttaatgatctttgtgagtcagcatacaaaatagtgtgcaaatgtgagagattgtgcttatgaggtcagatttctcagctttgtaatacatgtaatgaagcagattctgaagatgggcactcataatttgcatttccataggaattctatgtgattgggttcaagtggaccacagttttttctttttctttttttttttttttaatactgtgtctaggtagcaccttccccactccctgttctcacccccactcccctacccctacccccaccctgctgtaatctcagcattcaggaggctcaggtatgaaggaagaatagagatctggggctagcctgactacagaatgagaccctgttacaaagccttccccatactgagtcagagtaccttttgtttagttagtagttgattctaagcagacatctgtagaattcctaacaacccctcaggaccaagaaagtcctgtagatttcatttggaagtcacctgcttaattttaacccaactggtaaccaaaccgtagagctcatttctccaggatttcattgttttctagctgcagatcagaaaagtctgcgtttctgtctctccagatctggagggcggtatgttcctgtgtacaagagagaaagacagagagggagagaaggaaacacagacagagatacagggagtttgtctgtctggatgtttatgtgcacatgtgtacatgtgaaggccagagacagccacagatgttgtgtctcaggcatcacccaccttttctcttcgaggcaggatcacccactgccctgtagttagccagttagtctaggctgatggaccagcaagccccctgccatctgtctgttctctgtctacctagtattggtatcactagtgtgctccaccatgctggtctctactcatgtgggtcctggagttcagactgaagtctttgtgcttgtaaggcaagcattttactaagatagctccctagtcctgcaaataatttttcataaaaatttagaagacaattgtattgataattcagagcaaataattgctgaagaaagtgaaaaagctatgacaacatcccagattggcttgcatttgtaattgacaaagggatataaaccatttttcatattgtctatcccttcaatttattttttatcatttctaaacatttgcactctgttagtagagtattattgagtagtgtcttgtcatagacaaataaacaccgtagaattgttttatcagttgcagatatgtgacagctgtgttactatatttttagttttttaaaacaaggcaatatttgtgcctgtttgtgccaacccacttgaatttttcccttggccgtggctctgctgttgtcgtgaaaacacacatctgtgaaagactcatcgtccactccactcctcctttctcaccgtgactgttctcacagtcccagtaaccgtggctggctgctgctcctgccgagtttacaggaggcttgagcacagggcactaaaacctcctcctaaggaggtgccaggaaaggaagggagagtgtcccttgcagatgatttgtctacagtgattgtccagggtttgggcagcacatatggagacaattggaaaactgaagacaaggccctgcagcgggaccagaacttggcaagaaggtcttttatataagcagcctcccaggtttcctgctactgcttacttagctccatctagatatgatactgaatttaaatggtccaaatgatgctcttcaacaactttcatgcagcccttctccttttagtctactattcacaggttgttaaagtctgtcagtcatccttggttctttctctcctagtcccgagtcagtgtgactgtcgtgcaagtcccaggcttaggaagcagccactgtcccttcctctgcttgggctgctgtagcaacgccctgcttcccgcctgagtttctgttcttcacactgcagcccacaagtgccccggtacacaacactgaatcctgtgacttctttgttaaagcactgctgtagtatgtaactctcctcattgttgtcacagagtcctttacaagaaacaacttaaggtatacagttgaggggacatagtcctgtcatggcagaactaagaggcagctggcattgcatcatcaaacagcacagagtgaaaggaagccaggccaggttacaaaaccacaaggtccagctccagtggcccagttcctccagcacgctcggcttcctgaaagttccacaacagtgccactagctggggaccaagtgttgagacacatgagcctgtagggaacacgctggagagggtgtttcttacatttggaataatagccacactcctcacttgaccttgccctttcctctcctttcactcagagctttgccactcacattcccctgtctacccttgatctccaccaccctagctttggggtgccctcctcactctctggttaacctactgtgctggatttgtgtgctgtcacatttgtgtcaaatgcatgggcattgttcttttcagtcatgcctaccacttcaaaagtattcatgtgcaaatttcaaggcatattcttggttctgtgagaggaagaactatatcatgatctcctctgtccctctaacactgagcatagatgtgtgtgtgtgactagtgactcaccattgtgtcaggcattaccttttcctttccttaacttggtatggttttagactagcttaagtttgatgcttaaaacttaagctagtctaagtgggctggggagtcagttaagagcacttgtaaaggagctgggttcagttgttgccacccatacggaggctcatcacctccttgggcaccaggcacacatgttgtgcacagacacacaggaaggcaaaacagtcatacacacaaaataataaatctaaaaaaaccaaacaggtttgccaaacatgtcttattttaaagtagccaagaatgctgacactctgtcatggctaaggacagccgccgcagctgtcttacaaagaactgtgcctctcctcctagtgtctgtagttttgtcttagcacagtatgatcttgagatatgctgttctttctttcctgtttttgtcatctgtgttcagcatgcatatgtagaaagagggatgctccaatagcccagaagaaggatgctccagatcggccaagctcagaacactgtggagctgattgctttcagctcagtggcccagtcagtttttagtgtatttcctggatctattgaatgaaattacatcgtttgaaaacttgagttcttatgaattgtgcacgtgatgagaatacagtcgttttagattatgtcctatttcttcaaacaaaaatatcagaattcattttgaaagttactttagtggctgactgcatttcttacttcatggtatctaaacataagactttagatatgtaagcaccacctgctcccaaaagatccttgataatcttaccttacatgttgggtcaggatatctgaggcttgccatgccaaatcctattttgttaacaagttctagtagcaagtcaagtagacatggtacttgaacacttagaatagaacattagtgtaatgaagtccaattgtttgaaagttccaggcccagattccttatgactgggtctttgccactcagctggaatgtggttgtaattcttcttgtatcaactttgtgtaattgtattaacaatttatcatattgtgtcaaaaaaatctaagaaaaacatgttaaactatattgttaccagtgatatcaatcaagtaaatattattagtctattgagaaagttctgctttacatacctttctgtaaaaaaaaaaaattattttttttcttttctttcctccttgtttgtttgtttttcctcgttttgttttatttgagataggattttactccgtaacggaggctggatttaaagtcataagcctcctacctctctatcccaagtgctgacattgtaggttcttagagttataggtgtcactacattagcttatttactaaaattcactcactttcttctaacttaatgaagagcactaggttctgtaatgtgtgtgtgtgtttgtgtatgcaggttgctcttgtttcttgagaggccagaggacaaccttagctgttgttcccaggtactatccatcttgttttaagacagtctctgtcattggtcggaaagttaccaaagagtctggaccaagctacctagagaaccttaaggacctgccggccgtgctgctggccttgctgcctctaagcttgcaaccatactcagaggattttggtttttggtttttggtttttggttttgttttgttttcttttgttttgttttgttttgttttcgagacagggtttctctgtgtagccctggctgccctggaactcactttgtagaccaggctggcctcaaactcataaatctgcctgcctctgcctctgcctcccaagtgctgggattaaaggcgtgcaccaccacgaccggcttgggttttgtttttaacgtggtttttacattcagctgctatcctcacactttacccactgagctgtcactttgtcccagattcctgttctcttaaaatgctttcttgtgacagaagtcaagcatccaaccatgatttacagaattaaagagctgcttttcacactttttctttttctttccagcatttctctgtaccggggtaattgcaggcccatacgattcgaaccgcccatgctggatttccatgagcagtaagtaacttggagctataggacagttttacgtggatttctcctgccctttgctgtattagctgtgtgagaaagctacaaaccttaacaaagcaaatgatgttgaagcctttgaaactagaatctgctaagaatctgacataacataaacttcgaaagtctgaacattgcccacacgctacaccctggttcagaggatcccacccagcgtgagaagtggtcttcacctggaagcctcatctgattagcactttgtctctggcatttaaagtcaccttattgataatttgcatgatataatgctcttaaagtgcatgtgtcagcatgtcaccagtaatatggtcactgacctcgtgaaaggtcacagctaatgccacagatatatctgagccagtcgccttctgcttagggactctggattcacatatctcagggactcaaggaaagacaagtgtttgccctgttgggctcagttgcagtgggtgatgggggcatcttgtatcgtcacctggtatagaagaattttcaaaggctcaagagcaagctgtaaattagtgtctgtaccaggagagcatgtggcctagggtctggttctgtgcatgtgtgcatttgttagtgtgcttttctcaggtgtgggtggactgcaagtttatcttgatttctcagcagtaagttaagcagttgtctatactataagcctgttctaaatggaggttagatgttatacatattcttgtgggtttaattattcttctgcccctgggaatataggcccgtccttccttgcctcctttcctccctccctccttcctgtactactacagtaagtttctaagcaaaaggccaaagtttctgttttcaattttgagactgataggtaaataggtagtagatattagactcctatgctttgctgggtcaaagtttctagctgtcttacagggccatgtcctctgccagagaatcactgtgttctaccttcttagacgttttattttagttatcaatgttttaggtctcttctggctaagcaaacaaagattagagtgttggtttgtcaccggcagcgtttactcagctgcttttgctatgacacacacagcaaggtcaagtgtctttttcatagtttcagatacagaaatcgaatgtatcatttgttttttctgaagtgtggctgggtagtttgcctgagagtcaaaagacacttggtagcctgtctgtgtctgatgatggtcttcttgcagaggtgctgagttgaggggcttaggcatgcagagaaaagtgtgtgcacttgagaatcagccactgtataagtaaaattgacctctgtgctatttagttttaaagaccataacgttcagatagggaataaatgttatattgttctgagacaggtttaagtactgttaggacggtaaacctcaggaggaggtaggctctcccagaggtagttaaggctcagggtacctacctctcccacacaatacctgcagcagtgttagaatgtgtcaggaaggccaacaccttgattatgaaccccacctcccacccccctagccttgcagaactaaaaggaagtaagtttatttctatgtatacatacataagtataatacacacacacacacacacacacacacatttaaatctctgtgtgcacatctgtgtgtgcctatgccataggcccatgcagacacaaagagaacatcggatcccctggagctggagttagaactgactgtgagccacccagtgttggttcaggatactgaactcaggtcctttggaaagaggaaatgctcttaatcactcacctatctctccagcccatgttcacacccagggccttgtgttaccactgcatagtgtgtgtgtgtgtgtgtgtgtgtgtgtgtgtgtgtgtgtgtgtgtgtacatctcacaggcccagaacttctgtttatggattatgcagtctgttacagcagcacaaaatgcactaagacagatgcagtgataagatgcaataacagagttcttaattaacagagttcttaattcagttacagaatatatcacaatcttcttttaaatgaaaaatatttagtgaaaaggggcatgtatttggtgtttatcaatatagttaatttttttttaaataaaggcttttctttctctagtaaaattacctctgagtgtgttcttacgctaatttgttgagctccatgccgcactgcaactttagatagtgtcagtgctgttctcaggtgtggactgcacagcaccaaagctgtagtcaccatcagagactgctcttgaaactcactttcaaaagtctcatctaacatctagttgtgttttctccattggtgtttgtgtgtgtgtgtgtgtgtgtgtgtgtgtgtgtgtgtgtgtgtgtgtatgttcatatgtgtagctagagatggatgtcagatgcctgtgcttggtgtcttcctccattacttctagacaggaggaattccacagactggctagccatcaggctcctgggatctgtctgtctcctgggatcacagaggtgtgccatcacacctggccttttacataggtaccgagatcctcatgccttctccccagcctttggtttctttattgaggggatttgtaaatttcatttcaaggtttaaacaaaaaaaccttcagttatagaaaaataccggaactgaaactaaaagttcatgtcctaattacttgtttctcaagtctgagtattgtcctacctccaaaatagtagaaattgggatgaagttaagcaaggttctgaaaaggatgattttagtgtgtttgggagatgttagcttctttgctttctgaatcatgtatttctttaggaaagaatggcccctcttgctttcttcccctaaaacacacagttgcacaggagagtattcaggaggctgaagcaggatcaaaaagttgaagactaaactgaggcctgtcacaaaagccagagtagtgaggcatgttctgcatgctgtgacactttatagatagatgcctcctccagagttcgtctgttcatccctcagagcttgaaaaggttgctaatcactgttataaaactggagttctgtttattgtgttgagtggtatatagtcaccgtaataaatttataaacaaaatacttgtgaggacaagaacgagaagaactgccacagtctgaccacgtagaacctctacatttgaactgtcgtctcttatggcctcctttgcatttaatgttattgagtcacaaaagcacaaccatgttttataaacatactaccttttgacttgcttttcaacttaatatattgtgaactttttctgtttttatgtggtattagcatcaagttatatggatatatttgttgaattcatttgctaattttatttgtttgcatattttgttttcgatcagtgctgaacctggtgtgttacatacaattcgacttccctcaagagagtttcaattaaaggacataaagaatattaaagttaacctttaatatcctttatagctagagaagaatttgatgccatgaactagaggcaactggtgtgacagtaaagtcatcattgactggaaaggaagcagataggcgttcttactgaggctggcccaggtcatagagaagccaaaaactcgtgggctaagagaagcttcagcttcctgaatgtaggtgggaggacagatgagcttcagcagggcacaaacaaggcaggtaacacagtgaggagaactattggaagcacaggaaaggggctaatcctgagggtagagacctgggctccgggctccaaagacagaggagcaacacaaaggagccagtgtgctctgtgtctggtgtttgcaccctccagctctctacagagaacctcctcttggagcttgcgatggtgtgggaaagtggaggctctgcaaagcaagtagggcacaagggagagcagagcatcaggagtaggatgctgccaggctgcccagcccattacccaccaggtgagtggacagcaagaagacaccacaaaggatcccactagaaccacaatgtgctggctctctctatgctcagaggttttggcactggaacagtgagaaagacaagactagtggatttaatccactgagtgtatatcatcttattacattttcttaaattgcctaacacattgcttttccattattcaaaacacctagtctaagaacattaaatggagtgtgttttatttcataaagatgaaactggggttacagaaggtaggttttttttgtgggccagtggggaaacatgcatagtggagttcatttaaaaatcagaacttgctgggaatcttaaacatgtgtgcctatatgtttttagctgtttgtttgggcatatgagaggtttggcttatggtgtaggaactggttaggcacatactgaggaagatttcgaatagctggaactgtgaggcacgtggaacatctttttcaggcagtcggcagggggtcctgagctagagagtgcaattgaaagtccagttggcttgagagctccctttgatggaagtcagctgataggggatttaattacacctgcagaatcactcccagaaacacctacatttcaatagcttgggaaggtatgtttgctacagaatagctgctggctctcttcctatcttcaatccgcaggagagactttcagaagtgtctgtactcttaagctctcatgaatgagaaatgcactaaaaaggaatcctgaggactgtaacttagaccagcctgagtgttagtatccagccactgtagggatatagacatcaaaattcctaactttagtgctcttgtctcaaaaaaggatgctcttttgcttaaaatactttgtttggcagtgtagagccaggttctcaggagacaaaagtagcttcatgacaagaaagagttatgttttcacgatagaaagttattcctaaatgaacaaaaccatccaggatctaaaaatggaactagaaacaacaaagaaaccacaaagggagacaaccctggagttagaaaacctaggaaagagatcaggagtcatggatgcaagcatcaccaacagaatacaagagatagaagagagaatctcaggtgtggaagataccatagaaaacattgacacaacagtgaaagaaaatgcaaaaagcaaaaagttcctaatacaaaacatccaggaaatccaggacacaatgagaagaccacacctaaggataataggtatagacgagagtgaagattcccaattttccaacttcaagggccagtaaatatcttcaacaaaattatagaggaaaacttccctaacctaaagaaagagatgctcatgaacatacaggaaacctacagaactccaaatagactggaccagaaaagaaattcctccagtcacagaataatcaagacaccaactgcactaaacaaagaaagaattttaaaagcagtaagggaaaaaggccaagtaacatataaggcagacctatcagaattacaccagacttctcaccagagactatgaaagctggaagatcctgggcagatgtcatacagaccctaagagaacacaaatgtcagcccaggctactatacccagcaaaactctcaaacaccatagacggagaaaacaagatattctatgaaaaaaacaaattacacaatatctttccacaaatccagccctaataatagatggagaacaccaacacaaggagtgaaactacaccctagaagaagcaagaaagtaatctttcaacaaacccacacaaacataattccacctctaacaagaaaattaataggaagtaacgaccacttttctgtaatattgcttaatatgaaaattaatattacaaacatatcctaattgattgaaattcaaaaatatgagtgattaaaaatttgttggctgtcatgcattggtctttctaacttgataactggaaaaatccaatattgcacaatccatatacactttctgcttgtttgtacatgacagtgtcttgctgtgtaccacataatggtcttgaagtcacgctctcctgtctcagcctctctattagtagaattgtttatttgatgtttttacaatatactgtggttttcagaacagcttatatatttcaaaattatttatacagccaaaagaagtgtagacaattaatttgggtggtggcttgtaagagaacagcaaaaagtgagactgaaggctttgcttgatatttataattactgtatcaattttgaagaagaggactttataaattactcttattctgagatgaatgcttttcaaaatcatcacagccaatgaaccagaatcttaccctcacctgaagtctgtgccaccctccaagcagagccattgttcattgaaacagttgatgaatgacttcatggatagaccatctcaatacacacaccatttcttaaatgaatgtaacctgttccctgcaagctgtgaaggacaacagtcactcaagtcaaatagcttcgaccatagcaggaaatctgtatccaaaaatcatacctacaattcattccttggcgcagcagaactgtcaactcttagcttagctacaatggaggtagaatcctttcgtgatgtgagggacattgaagtacattgtaataaaatgaactccaatgtctaaaaattgttctcatttttgttttgtaccacattaagagccaagattttaagctctactaaaaacaaacaaaaaaaaggccttatcattttatgttcatttaataacatgtccatcatttttaagattggtataaaatatattgtgttgaatatgattaaaaagataaagagagaaaagaaaaaaatatatttttattatatattttaataaaaagattattaaaataaaagagagaggaaaaagttattcctaagtggcttcaggaagtagacagttactatacttgttcatgtcctctttgagttagggtttttcctccactcatagaaacatagacattgttagttaatcagaatttttcccgcattgatctattttctttctgcctccaaacactcctgcatttcttaagtgggtactaagtaggaagcatgaggtcagagcaccactgtagaagagctgctgtaggctacctgcctgttgcctgaggacacctgcctacctctagcaaccccgcccatgtttgtttgtttttgttaataagtgttaagctttcttttcagttgttcaacctgtgggcaaagtgagcatgtccctggcacaggagcaaattctgtttaagttggatataacatttccattctcatttagggtcagtttacagagagatatgacccagactagctaggggtatgaggacacatgtaagggaattctggaggaggattttttccctctatgctgctcagtgtatagaagtcccctcttccaggctaagtatgggattggtgacacagtgttgtggcagccatcctgttacttgccagcgagcagtacttggcaggatagaggcagcatgttgtgtctcccagcaggaaaatgcaagggcgtgttccctgggcagcaggctgccatgctgagctcacaaaccccggtgggtgactgcactggctggggccttagttaggacaccagttttgtgtccttggtactttgtggagcacatggtccccttcctctgccccttcttttgtctgcaggtagccttgtgagcacacatctacatattcgtcctatctgaagcctgctggggcacctttccctgatctttcatagctctggcacaagcctgtgattcccagtctatggccccattcctcgccactgaggcatctgagtacttcctgtcccttggagcactcatgtctcttctgtcagtcaggagaaaggttttatcaagtttatgtactctctcctacattcttcattgctctgctacctcctcttggctcaggcccgtgttagttgaaaactaagactgtctctacatgtatggcatttactgacttatcatccatgctgtcaacaaattataatgttaaaatttgatcatgaggccagggagatggctcagtgggtaaaagcatatactgccatgcctgatacctaagttcaatttctgctatccacatggtgggaggagagaactgactcccaaagttgtcctctgatctctaccctcatacttacagacagcatgccctcctgtacgtacacacacatacacacacacacacacacacacacaaaggggagtaataaataaaatttttataaacttgatcacattattatcttcccataaaaagtcctttaatggttcctgttgtcttatgataaatgcgaatagtcttcatttcttattccacatatatagaaaactacagactgtttcctgaagtcagtgtgatctttctaactctgggcatgttctacatactttgaaaataatctccctcttttgtttctgagagagagagagagaataaatatgagaatgaatacatgggcacatgagtgcagtgcccgtggaatttagagacaagatctgtggaactggagttgcaggcacttgtgaaccatctggcatggttgctagaaaccaaactctagtcctctggaagcagtaaatgagccattgagccatctctccaggcacactaaagcagtgtttcttacacatagaaagaaaacaaattatgatcgtacattgaacaggggtagcagctatctatttttttaatgcgtgtatttgtgtgtgtgtgtgtgtgtgtgtgtgtgtgtgtgtgtgtgtatgtttaggcaggtcaaagaacaacttgtggggatttgattctttccttccaccatgtaagtttaaagagttctcccaccctatatttcttaaacaaaggattctgtcactgaacctgaagcacatccattcagctagacggttggccagataacctcaggaccctttatgtttctacctccttaactgtatatgcccaggttttatgtagatgttggggttcacgttcaggtcctcattcttaaacagcagatgccagccatcttcccaggtccttgtagttttataagccgtctgaaagcaacaggcactatgattcagtcatatttttagttatcatttccatatatttagagaataagaaaattggcagttagtgtagatggcctatagtacttctgcttcaatcagtgttgtaattgtttgattgtaaatgagagaacactgactgaaactccttaaggcaaaaaaataagactgattcagccaccataacagacaggtaggcccacattacctaaggctgccaggactcctgtgtcctcaccttgctcactctcagtaccaatgctatttccctacagccctgctgactgtttccactctaccttctgtagccttctttctctctaatctaaaacatcttagcagagagcaatggtcaccccaggtggattcattgtccaattcctgaagcagctgtgttaagaagacgtatatatcagtggatgtaatgctattcctagtttgtcagagtttcatcaagagagaaatcatagccgggcatggtggcgcacgcctttaatcccggcactcaggaggcagaggcaggtgaatttctgagttccaggccagtctgatctacaaagtgagttccaggacagtcagggctatacagagaaaccctgtcttggaaaagagagagagagagagagagagagagagagagagagagaaatatatcatacagtgggcagcggatcctattgaagaccatcttagtcccttggcttctcatatgcctgatgaccagtcagtagaggtcagccctgtgctcaaaacaaccttcacagcttgccatgcacaggtagacatggccttcccactgtttccatggtatcttcccagctacacagaagtgggatggatcaccacctaaaactgagtttaaatatccagactgatgctgccacacacagacataccccagagggtatacattgtccatcatataggtagttgatccatttaggatggggttcctatcctgacttcctttgataatgtggaagcataagctgaataaactccttcctccccaagttgcttttatggtgtttcatcacagcaatagaaacctaaactaagatatgtactcctaagtaacatagcctccctttttctttattttgggtgtttttaaattgactttctggaattggatttgaagctggaactttgcaaacattcagcttactctccaccttggaccagcctggaatcccttaaatgtgcttagaacatttccattctattcccagctgtcctctaatgactggctggccagggctgtgcctgcctctgctcccagagttatagagaggctgggcctgcatagccaaagcccagaatgggatccagggccagagtacaatgtctagtgacttcatatgacctcgcatcactgtaaagcttaaaaaggaaatgtcattctggccagcacaagttacaacatctgtctacactaacacaacacaatgaagttctctgagaaaccacagcaggccttcagcaaggctgagagcgcaaacaaaggaaaccagctcagcttttactgggttcccagtgaggctggtagaggcagaagtggtggcagcagtttggaatcttggttgtcatagccacgaggaagcagagggcctttctgtcccctgctcagatgtactgggaagggaatgttgtgggatggagtgtcagcatggcttgagaatgctagcagtgtgggctgtcctgaggcacaccttgctgctctctaggaaacctggtactgactgtcctcacctctgtggtcacctctattaataatgggctaacactcatttcagagcacagatgtaaaattagcattctgaagaaatgggctgttttttaaaaaagacttttgtgtgtgtctttgcctgtatatatatttataccacatgtatgactggtacttgaagaagtcagaagaaggcattggatccccggagccacagccaattatgagctactatgaacccaagtcccctgcaaaagcaacaagtattcttaaccaggccccccaaataggtttttcttggctttctttttaaattaactttgtctttaatgtttaatttctacttcaccctctctccctggtatcttcccagctacacagaggtgggatggatcaccctgcccagtttccaaatgacactctgccatgatttgggtactcacaacctccctttcttccctctcccaaattatttatgccagtgtccctaagtgttttctgtttccatagcaacatctttctctcaggcatttattgcaagcagtaaacgatgtttggggtaaaaactggttcactgcattctttggttcatataattattaggtgcagaaaaattggcttcagatcttcagtttaaaatcagtgcatgaaagctttttcaccctaattgctttctggttccaagaaaatcaaggaggcttcctttttctaagagttgtttggttgccttgtagcttcccacttctaattcttacttccatgcatagttttatagcatgtgtttgtgagaactgtaggatgttgtggtgatggagttttacaaagtgctggtgttgatttggcccggcttcctgcctgaggctgcacagcagaatgctgtatttcattcagcaggtttgtctaggggcatttgggaaactatgcctgcagctgtttcctgcggttgcaggaaacagtgatagaggaagtttaatcccacaggattgcagcttactttcccagctactcccggtcctaaggtttcctcccagttctttggaaccttccactcctgtagaatctggacagtgtgatccttcagcacagagagcaaagatgtccgactgctctggctgtgttcatctataaatacctcccactgttgtctctgactcctctgtttggagcagccaataatggaaacaaacaggactagcactggcaagggactggatatttgtttatttttaaattcaacttgtctagccaggcagatcacacatgctgcttgtggtagtcagaactgtaagatgattgggagaatttcaggtttctaatacacacacacacacacacacacacacacacacatatatatatacacacatacctctttacaaccaagcattaatccaggatgtgactgtaaccaaggctctatctaaatcctatggtctttaaaatggagagctatctgtgtggcccagacctagtcccaaagccttcaaaggctgactttagaatgaggagcaaaagtgttggacatttgcagtaggagaggaacttgattttggaagtagaggagctgcatggaatcatgcaaacaaagtaaatgcatttagctctgcacgagaacccaacatgctcagcatttgcagaaaccttgtggaactttcttagaaactcgtgcagtaatgagtggaggttgcctttaactactgagcttgtggtagtaacacagcctagagcatgagaggtgatgcagagagctttgcactgagagagtagagggtaggctggacaaggaaggctcttcctacaaacggaagcctctcgccatcttctctatcctcatcactccaaattcccataacccttctctcagcaaggccttatctcttctactcggcatggcccagaacatttcctccttgatgcctcaagacaaataagccaacctcccatcgctggccactcccatggacgtccatacttgtctgcttgagccctgttgtgtagcaggccatccacagccctgtttgaaggagactttaaagtacctgtctatcttcaccctgtctttctcttagatgagattgcttgtattaaagttagacaccaacaaaagcatggggagctgacaaaagccacttagcctgcagtccttctgaactgtccagggacaaaggtgtttttaagagaaagtacatattgtgctatgtatctttcaagatacaaggaatgtgtttatttctctttactgttctacttacaaagccgaggaaataagcagaaaatctaaatagagtaaaaaatcaaaacccaagaatttgagtacatgtatgagaagccaagcaaaatgagtcagtccaacaaagtcaggctgtggcacagagggcagaaggcaggtccttacatgctctgcttgctgcattgccctcattccaaatcaaacacacacgacacaacaggcatccttctgaatataggctcagaagtaccccacaatgtgccgacagacagacctcatctgtatgtaagggaatcatacactgtgagcaagtagtagtattctaggacaatgaaggggatacataagatcatacatagatgtagtaaagatgcacagtgtgcttccatagcaagcattctgaacaaaccaagaacagaaaggaatgttccaacctaatgaagatgatctgtgaaaccccaaggttgatgtcatgctgagagggaaactgtccctgcatcaggagcagctgggagtcttgtcagctctcttcagcatctcattcttctgatttggcaataaggtaggggaaaaaaatcagttggcacccagatggacaaagaagcaagcatctctacttgcaaatgttccccattccatggactagatactgactctaaatataatattttaaattaaggctactagaagtagtaagttgaatgcaagaccaacatacaaaaataaaccatggttttgttcagtggcagcaaataatctttttaaaaagagagaaacagtctcagccaggtggtgacatacacctgtcacccagcactggcgtaggggagcatgagctcagaggcggtctggactaaataaagaccctgcgtcaaagctgggatggggtggggagaaagagtagcatcaaagagaacaaaaattcttaaatattaatttttgatagaagcactaaggcataccaaaaaaaaaaaaaccctaaaaattgtgaccaagagaaatgaaataaccaagtaaataggaaaagaaatctcacagctcttagtgtgttagatggcaggaattaagatagcagattgaatacattcttcatcagaatttcacctgtctctctgtgtagaaattgataaccttaaaattcacagccatataaaggaccccaaacagtctgatccaaaacacccttaaattaacgttgaaggaagcacactttccaatatcaaaaactttatagaaaattttttaaaattctgtttactttatgggctcacatatgtggatgtcaggggacaacttaagggtcttggttcccccattctaccatgtgggtcctgagggctgagcttagcttgtcaggcttggcccccactaccttcatgtgctgagccattttggtagaaagctctccattttcaaaggctttctacaaagcagtggtggttcagacatatccctaaggacagacacatagataaatgcaaaagaactcagattgtagaaagagattcattgacagttgattgtcacagtgatgccaagaccgtttaataggggaagaatattcttagtagtacatggtgctggggccacttgctatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacattttgtatgtgtccattgttatttttaaaatgtagaaatccagatgcacaattaacaggaggcaaaatttataccttgggttacgtaaatttttttttttaagtttatgctgtaattgataaccatcaagtaaagaacatgacccacacactgagaaaatattggcaaagcatgtttcaagggagctatatggctgactgtggccaaacatacaagtacaatgttagtgaaaggaaagtccgatgctctgaagaactggaagggagttgccgttgtcagcacactgagcaagctgcccctttcatgtgtttatagggccgctgtacagtaagaacaggtcaggccccgcccagggttagcgtaggatgatcctaaggtggaaagcccagctctgcacacccagcttctggctgacccaccttgtctgcaccctgagacagtgcttaggtcaaactgcagttgggcaggattgccctcctagaccatagcgtacagacccagctctctggaagacctgagaggagagttggaaaccataacctttctacacttgtaaggagttgctctctgcgcttgagtccagacagccttcccatccgcagtctggttttcaggccaggctgtcctttgcccccctggtccctcactctctcctgtctgcccgttcaggcagcctctcttccctcagttcgctaaagagttctcagttgagtttattcctttgtttgtttttcagtgttccttagaattgattttttatttcatacatgagtaccgtattcagactgtttccactcttctctccttcccaactcttgttcctccttcagttctctagttcataacatcctattgattatataaatacatatatgtatagatcacacgcatgtacaaatacagcctgcagagttgacttagttctgctcatgtatatgtggttaggactgcccatttgggattgggagtgtttcagagggtccacccatggagaaacccgattctgtctcttgggacccattaaccctttgattgctgttactcttctgggggtgggctttccccattgatgtaggcatggaaattgataatggtgtagtcgttatgctggttttgtttaggcaatcatgctgttgagatttcatctgtgtcatacacatctagaagacaatataccacagcaggtgtcccagacctctgattcataacgacctttccacccctgttctgcgatagtctctgagccaccattgtaggggttgtgttgtccagatgtgtctgttagagttgggcacccagtggtcagttgttcaccgcagtttgacccattgtggatttacctctctttagcttttaaattttaacattgttttggaggcattagttgggaggagcaagtctggcctgtgtcctaatataagttacgatccttaaaggaatttaaagcccctaattcattttcttaaactggtgaaaattatcaaattattctttggtttataaatttcccaaataataaattagtcagacgactgaactgaagaaaaggtaggaataaaattgtacgatgtccacttgacacaactagaaagcacagctcgggctgtgctcacctgcttaagctcagcttcatgtacagacactgaatctgaattgtaaaacaaggcttcgggaagtgcgccctggggaaagcgccttgtagaagaaagttggatccgaattagaaaatgagttagggctccaggacagggacggcacattgtctgcaaaggagctagggtcgttcacagtctgaaggttccatttgaatggaagtctgcatggtgaaatctcactagttgaaaatcatcagattctgcagggcactgtaatactgaaagagggagaggaaacaagccagcaagcatgtgcacatgtgctctcacccatgcctccggctgcactgagtgatgcatgctgtgacggcctttgactttgaagtgctgataatcttgacaggacataggaccaacatgcctatgagaacatctgccctgaagaaagatgtgtacaatgccgaagaagccaggaggatacacagtgacatgagctgcagaaggacccatccgccacatactaagactgcttttaagggacaccaaggggtcattccgtggacctgtgagcccttgaggatgtattccatagtgttcccttgaaaggaggcaattcgtagattccggtgcagagagcagctgtggacaagttaatgaagctttcttaagtttctgtgccctctattagtcgagaataacagaagtccccaacttgcaagatttctttatacaaccatgccgctaagtttgtctgtgcttgtagaatttgaggagagaggcagtgtggtattaatgaggaaagatgaacctaccctcccaggctggctccaggttagagagatcagccagctgagacttacttgccctgaagtcgcatgggatcgacaagcagatacttgtcgaggggctacgtatgtttcactgttttatggtatttgcatatgaatttgcttaataatctatatgtttgacttttaaataattactgattatcctaaaagctagaagtgtctttgaattatttctgacagtttcctttttatttttgcaggccagttggaatgccaaaaatggaaaaagtctacttacataaccctagttctgaagaaacgattactttagtatcaatatctgctaccacatcacatttccatgcatcgttttttcaaaatagggtaagcttgtctactaaaaattacttttgtttgaaattgaagttctacatttttattaataactttattttgctatgattaaaatctgcttctagtgttttcatacttagatgccagtttgtcccatttcataagaattataatatctattcttaaatgcacagtgtcccttcaagtaatagtaactgtgccaggattcctaagcgttctgaaatccagcctgtgcaaagctgagggctgtgtggccggtgggggctggagaggttgctgttcttgttttgttttttccaagacaggatttctctgtgtagccctggctgtcctgtaattctttctgtagatcaggctggccttgacctcagagaaccgcccctccccccacccttgtgctgggattgaaggtggaagccaccatccctcttcttagctacaggggccagggccttagcagtgagtgaggctgctatggctgggcactgagtgagtgaagttggatggcttcagctagtgctcgctcggggacacggttcattagttcagcgagttgtctgctcagcatatcgtaaagtggcccttcctgtctgaggctctgagaggacgtgcacctccagacctattgagtcttcggtggattgcattgtcattggttgcagaacaaaaggccctgccttggtgaccaggctctcactcagcttgaggcacccgcgggctcctctgtctctttatgctggcggcaatgtcctctgcccttcttgtgtcttttccctctcccgctgctgtatctgcccaagctgacctgagcgacaccagcaaagtcctttttacaaccacaggtgtcttcatacctgtggtcacagtcacggttgggttctaggtactacaagtgtcctccaaattttgactgatgatgtcagttgttggatgtgaagttggtattcagggaagagcctttctgatcaaaaccacaaaagatgggactgaagtatattttttaattaggagatacattaagttttaatatgtaggcttccaaaataacgaacaggaactatgaggagaaagagtaaatgaatgggttctgattgcatcttcacagggttttttctgactgttgaagggctgtgactaagaaaatgagcagcatcttttctaacatgtaaactactggtgtacgccatattacttgttcaggatcctacatttcttctttctgaaatcctgtatcattgtatgccattgtcagcagcttctaggggtaaaatggctatggctaaggggtttttttatccctctctttggaaatattttctaaataaagggtttgaaagttaacattgcttttggtaattaaagcttaatttctttgtgctactcatggaaaatatccctattcttaaagtatttcttaaatttcccttgagctattgttgttgttgtttttttaacctaaaagatcttttcaccatttttattaatatgtcaatggtctttttttttttttaaagatttatttatttattatatgtaagtacactgtagctgtcttcagacactccagaagagggtgtcagatcttgttacagatggttgtgagccaccatgtggttgctgggatttgaacttcagacctttggaagagcagtcgggtgctcttacccactgagccatctcaccagcccgtcaatggtcttaaataacaaaattctaatactgagggagactcaagtatataaaggaggagtaggtctcagaagagtcagggtcagaggtcagcatccatgagtctgcttagtgatttgcctcatacgtggccatcacaagtggtacacacattataaaccaccaccaaccacccctgtgtgtgtctgtgtctctaaacaaccataagctttcaggcactggtagtgtgcaagtgtactaggttagaaggcaaagacaaatgggaaaagcccagaagtagtgtttgattgtgctacagttacagttgtgctagagttagtaatgccttgattcactctgccagttctgagatgctttgttctgggggttgaagctccccctgttcctctccacatcgtgagcaggagttgcagctgtggctggatgagggaagtggggtgggctgcagaagtgctgggggtccctgtaagcaacgccagcttccctgacctggtagccatactgtgggaggtagaagtctgtgtgcagttctgagttttcaaaacaagtcagaagtatgaatttctatgtatctctcagctttcctacattgggaacgagttgaatttagagacagggtagagtgcccatcgtaatcagctcttcactgccagcttgacacctctgaattagactccgcccagagagagacgtgtctcctgatgacctttatgtgaagaacagatccctggacattcttaaaaaatacattgtgtgtgctgtcagccagttctaggaagtggagctgagtgagctccatgaccgtcccagtgcctgtggacacgtcaggtcagctttgagacagttaagatggtggccatagttggggctggcctttcttcttccctgtgcatccatctttccttctcaaagactgtggggaggggtgagccgttgaggggaaatgagccgtgtctctcatgcccaggagagcacagccttcctatatatcccctctgacttaactccctccacaccctcagattccccggcacttcttatttctttgggaaaaaggatattacaactcatgatggtttttattatctaataccatgtctatattaaccaaccagtagaaaaatagagaaaagaccaagctctatatagctacatttcagttacatttcagtctatagataaaatttaaaatttttaagctgcttactttcttatgctttaaaataatcttgtgggttgaaggctcttgtgaacattggtgattatttttaattagatgtagaagcctaaacattgtttatgccattctaggttaaactctgctatccacgcaggttgtcagaaatcggggcacatatgctatagccctagtgtggggtattagacagataaagataaacctgtgttgtgtctgctgctacagaatactctacatcgtgtgctcctgtgtaagaaaagcagatcttagcagagagatcttttcatgccattgtatgaaaagctggggcttctctggggtttggtatgttagcaagagccggggtaagttgtctgcagctgcatggcgatggcctggagagggcaggactagaggagcctagagagcaccgaccttctcacacactgctgccatatctgctgtcacagcttacagcatggagcacataaagactttaaaccagctttgccatctatatagaagtaacaagtgtgttaatttaataaatattgccaggatttatcactgaacaagaggtctctgcttatgatactcacccctagtgggggttggtgacttcagcagacaaaataaagatacttaatgagaccaattagacagttgatctatgaaaaagaaaagcagctgggtagggggatagtgctggggtgagtcgggtttaaatagcaggcagggtttaacctgagactccagaaaggcagtcctgaagcagcagatctggcagaggctgtgctgggaaagatacccaggagtagtggggtctccggttgtgagggccactgcttgttacaaaaaggtcttggctttggttctttctgaaagagaaaggcatccgaagagttttcgcagaagaatggaatgttaaattttattttcagacagttactgttgatcaaaaaatagaagataagggagaaatcagatgtaggactgctctggttgtctgctgtataagtgagctttgttaaattttccaggctatgagtgaatcttttcatttcttctgatattaaatgtataggcattgggttgtatataataccttttttttttgataggatcattttcttataatagttttatacatatataattagactattcacatttgagcaaaaatgtggtatgtttctctgagtctgagtttcttcatttcctggggtgctttccagtcacacccattttcctgtaaatccattttcctttacggctgaacaaggcatcatcgtgtatgctcttcactttgttgtccaggcccatgtggtgggcaggcaggccgctccatacctggcctgttgtgaagagcacaacagtaagcatggctgtgctagcttctcagggtgctgactgagaccccttaggtacatacccggcagtgctacaactggatcatgtgttagtttagtctgatttccatagtagctgttaccaatttcatccctacagtgtatatgtcttcatctcttctccatccgacctcacctgtgtttcttgttgttttcctgataacaactgttgtgactcagtgagatgtgatctcacaacagttgtatttgtagtttcctgatggctacaggtattgagcacacctctgactgactttctttctttctttctttctttctttctttctttctttctttctttctttctttctttctttctttctttctttctagaacagactccagttcattaaccatttattggttgggtgatttgtccttttgggtttgtttgtatgcttagagtactttatagatctaggtattaattctctgttagacatttagactgaccaaggtttccacccattctgtaggacatgccttcactctttcattgatttttcattttatacagtcacttggcaattcttggacttactgtgtgtgctgttggcgccttttacaaaatctttgtccctgtgtcttgaagtgttgggcgagtctttattagtgcttcagtagtgttgcttgttacaaacctgaattgtttatatcctcttgatacatgttagtatcatacacagctaggaatgtatgtttcttcagttttcatgataaaggtttcaaagtattccccaatggttctctgcgtttcatcagaatctgttgtaatatcccccctttcatctctcatttgttaatttagattttgtctctcttttgattagattggatggggcttatcaatcttgttacttttcaggaagagccagctcttggctgactgtggttctgttagtctctgcctcattatttctgccctggtgtcccacctttcttgccttccactgccaatgcccttgctttgttcgtctttctctaagactttgaggtacagcattcatttgtttgagagctttgcttgtttttaaaagattaatttatttgtatattttgtgtgtgaatgtttccattcatgtatatctacaccacgtgcatgcctggtgtccatacagacaggagaggacgtctctgggactgaccagagctgccgagagacaggtgagagccgtcatgtgggtgctggagatgcggcctgctcctctgcaaggcagcaaatgcttttctctgctggagccacagcccagcctcctccccatttctttattaatttatgtccttagagttttaatctttccccttaaaactgcagtgactgtatcccaaaggttatggtgagttataattacactttgctttcatttgattctaagaaatttccaggtataatccctccccagaatgacttcagtgacctactggtcatttaagagaatttctccatgtcgtgtccaagcatttgtacagttctatggtttccctagtggctggtgtctgcttttattccactgtctcctgaaatataagacattattttgaagccagtgcagtgcgatctcctggacccacatgatgggagagaagatccagccctcagtgtcctctgagttccacatgtgccatggtgtgcacatgccacatactaatgtacatacacaaatacatttaaaggtttgtttgtttggttggttggttggttttggttttttgagatggggtttctctgtgtagccctggctatcctggaactcactttgtagactaggctggcctcgaactcagaaatccacctgcctctgcctcccaagtgctgggattaaaggcgtgcgccaccatgcccggcacatttaaagtttttaaagaaattattttgattattttctgtatcacttgctttgaaacttaacctgtcttggggaaagttccataggctgttgagaagaatgtgtatttctattctactaggtataatattctatgtgttaagtccatttgggctattatgtaatataactccaggtttcttgttggttcttgtttgaatgtcctgtctaaaaatggggacagagccgggcagtggtggcatacgcctttaatcccagcacttgggaggcagaggcagggggatttctgtgttcaaggacagccaaggctacacagagaaaccctgtctcaaaaacccaaacaacagtaaggaacaacaaaaaaggggagtgggggtggggggacagagtaatgctaaagagatgatactgggtaagagcacttgctgcatttcccaagaacctggggtcagttcccagtggcatgtcaactcagagctatctgtaactccagtcccaaaggcagactaacgccctcttctgggctctgtggacactgcatacaggttagtgcacagacatacatgcaggcaaaacacctattcacatcaaataaatacataagtaagaaaatgggatttgaaggttacccactctttgtgtcaggatctgactaacctttgtgcccactagtgtttgttttatgaaaccaggagcaccaaaatggggtacattattacttaaaattgttgtatcttgatgaattatatcttttatttggaactctatcacatatcaaaataactacatcagcttctgtttgggtgataaatttactttttgagtgtcttccagttaggtatgtatatttcttagagacaacatatagtcagtttttttttttccaactcagcccatctgagtccttttattgacacattgaagccattaacatttaaggttgctattgggagctatcatggggattgttgtgtggttttgtttcctgctagtattgagagttttctgagtgacaggctagctatggcagagttcttccttgatcgcccctatcatccgttcccctcatggagtttatgctctttagactacagtgtgttagactttcttccctttctgtacagagcgttctttctgaagcactcctgtgctgatggctcgtttgtgcttgtctcgaaatgtcctgatttctccagagcttttaaaagagctgtgctgaacatgatcatcttggttggcagctgagtgctttacaggttgaagtgtctggcccaggcttttctcagcacagagtcgctgaagccagagccagagcttgctctggtgagtctcactttgtaaacgtgtgggcttctcccttcggcgcattctgtatctttgctctgaattcctgacatcctgacttggtgctgcttctctgctgtgtacacctagatctttaagtctcttgcattcggtggttcagttctttctctagatttaggaagattttttaaccataattctattaagtaggttctctctgccttaagctttatctctagttctttacctcaaggattcttaggtcctgtctcttaatcaaatgtgggaggtcctggtccctgccattgagtttgcctgttcctttagggatgcttgaccttgtgtcccaccgctgacatcttccttctgcttgggcaagtctttcagagacacttggcactctgctttttatttgagtcgttgagcttttcttttctagtgactctgttttgttttgagtctcagtttttttgctgatgttcacctctcattgctggttttctcttctttgttgctgttttccctctcagtccaggattggtctccttacctcattcatctgtgtggttgcccttcttgggggttttgcttttatgatatctatccatcagctgttttagctacttcggtttctgactctgactgttaaggaattgtaattgcaggagaggccttgtctctctacctttccacgttgcagtttgtgcatgtttgtttcgctgtcttcctgacttatttggttatcattttagtgtgcagcttgcccctaagagctcaatttcctttccccttagaaaggaaaaagccagagctatagcttatagctgtaacatcgaatcatgcaggacaaagaaagagacagaaaataaagtaaatgccacctgcataccactgtttaataaaacttgacaaagctaatggagagttggctttgaagttaaaaattattttgagtggggctagatagacagctcagtggtttagagtgcttgttgctcttgcagaggacctaggttctgttcccagcacccacatggccgctcacaaccacctgcagcttcacttccaaaggctctggcaccatcttctgacctcatcaggcaccggacagacatgcaggcaaaacactcacacacaaaaataagtcttactttttaaaattacttagggttaggatgaaaataacaaatggatggggtaaaagaagaagcagggaagggagaactagaagcaaagttaggaaacaaagagagaaagaagagaagcatgttatgaagaagatgagaaaagagcaagaagttagactaaataaaggaaacaatggtctgccgatgaagacccaagttcaagtccccagcacccaactaaaagctggacacatagtgtagtctaactctagcactcctacagggacatggggacaggcatagaagagtccctgcaagctcctaggccagccagcctgctgtatgcattgggaaatcagcagagaccccgacttaaggtgcctgtgtgttatcctgacatccatacacaccatgggacacatactagatgtttacacacacaagtgcatatatgagcacacacttcagaaccaagcacatttacacacacacaagtgcataaatgtgcacacacatcataaccaagcctagataaatataaggagaataacaaacattaaaatgtaaaagctttttaaagaatgaattaagtcgaaaatacagatgactgaaaacccaacaaaccagagcaagcacagaaaagagaaagaaaaatataaacaaaattagctaaaggtaggaaggggaacaaaaacgaaagcctaaaagctatttatagatgagagaaaatactcctaatggtatagaaaaggaaagtggatagccagtagggcactgctaattcgtcagagtgcttttcctctgggtctttgaaacctggaagtggcaggtatgtgcaggtcagttgaacttgaggactcgtgtcttctcctgtgtcttacgctggtccttagcctgtattgctcaagtgtccactgtctccagggctgtctcagtctagtaccttctcttctttgcatcccaggggccttggcttttcagtctcccattctcctgcgccccgcccccacaccgggttcttactgaaatggtctctgggatggagggtgggggaagggtgtctcctgagtgcagagacagtagggaaagcagtggcagtactttgttctcacctcattcattgccctgctggaggagcacagctgggaatgttggggagtgtcctggagctcagagttcttggactctatagcgtcaggtggctctagaggtctgtccacccacacttgtttgtctccagaggctggtgagctcccctcttccctgccctcagaagttgcctcttcagatagctgctaggcacaggagaacttgggactgcagacccattctcttagaaaaggcactgtgtcagggagacccatcaataatagatctgagccttgtgaaagctgtggccttgttctgtgggtaggactggctacccaccaaggctccttgtttacctttcagatgagacttctgcccccctcccccataggacagctacggcttggttaactatggttgcatctcttccctggcaactcttgagtttctctgcattttgagctgtcttgtcctctccatctgtatttataacacaaacccaactttgccagatccacctcacctccctacccatctaacttggcttgtttgtttgttcagtttgttttctaactcttcaaatccaggttatattgcccaactaatcttaggagtgaggagttccttaaagagtggttgacctgccaggggtcacactggtaaagaaaactgactcttcctttcccagtggctataaatctcgaagagcttctgagctcagaatcgggatttgtgctcatctcctcttccagtccgctcctttctcctctgttctccctctcctcaactctcatctccagtttgtctgcctcaggcttcataggtgctgcgtttgctgttaaaatcactgagttcatatttgtaactgccctagggtatccagaaaactggtctccttgaagttatctatccctgctatctcttaaagtctttccctcccctctttgctgaagatccatgagcctcgggatttggatgacccctttaggactgagtgttaactgtctgcaggttgaccaggttagggtctctttgttaattgatgtctactgcagggagtcactttgaggaggggtgagagatgcactggcctgttagcgtgataatgagtcatcgaaacttaatgtcagtgctgggtccacttagcagaatagtagtaggtgctcaccaaagctatccagttacaggttgtcggccctattagcagtgctaggtatgggttccatctcatagagcagaccttagattcaagcataaagtagttggataatcccataatgcatgcccctggtataccagtgagcaagcatatcttgtcaaatctgtcattatcgtagttcacagggttcacagctggatgacattaatggttacttttcttctctggtagcatccatagtaccttccaacattgtgaaagctagccagtagggagacagctttcaggggagtaccagctagatgtttccttgatccatgactcaagaatggagtgcccttagcaataggacagtagaaggctaaccaagagcattggtaatggcttgtaatatttggaggcttctggagcactgtagaccaataactcaaaaagagggaacctattcctggtactaggatttttattcactatcatgtgtatctgcttagggtgccgttcccccattataaggtaaccccattcatactctatatgtatatgtgtatgtattttaagaagtttctgtggcagcaggtttccacgtggcctttcaaaaggcttttagtgttagatgtacctccctgttgtgtgccttctaacctgccctcctactcccactctgtttacctttttctgttccattacaccccccacggttccccctgatgtgtcctagccctctcctgtgaaaaatcctctctttcctggggtcctttactggttttctaacctctgttggtatggaatactcttcctttttgatatttctccttcaccgggctacacagaggcagatactatctgaccctctttatcagaggaactctatattccttgagtcctcccatacatagtgtatggatgcacggtgcatagtatagaacatgtataaagctatgcatgctttagctccgtgtgccttctctccacatgttctatagagttgtccatcagctctgtagatctgaagcaccagctttcattgtatttattttgctggttgttttctgctttctagttcatcaaattttacctgactttattctttttacttacgttggatttcattcactctttttttagcttctcaaagcagaaatataaattgttggtttaaggcctgtatgttcaaagtatgtaatgttataaatttttcttctaactattgctttaactactccctgtatgttttaatatgttgtattttcagttcaaatcaattccgactatttatgttaccatgagatgacttaaatggccagtgggttatttagaatttgtgttctgggaagtttatcagacttcagttcattcttaaattcaggatcaggtgtttataattcagggggagctgtgctccacttgatgccacacccacctctaacaactgtggatgagttctctgtgtgccctgggatgatagccctgttgtcttcccgttctctgctgtggttgccagcgtttacatgtcatctctatttggacctgttcaccatccatacaatttgtgtgatggatttaagaaaagttaggatttcccccgtcccccacccccaccccccagttttgttgctgataatgcaggaagaatgttctttctagctttcttcagccagagtctcagtgccatatgctttgagctatagtttgggtagcattttagagttctcacaatagaagcagaatgaaagagattggtagctttacacattaaatgtccttaaggctgtattgcaggcaaagccttaatcttgaatgtcatagaatatcctccattactttgttgtaataaagtttccttttaccaattacaatgacattctcagtctgcaggaaataataggagtgacttccttttttcctaatttaagtagctgggacatttcatatttcatatggacaaatggcagaggtcagaggattgaggcccaggctttctgttttagtacaacactgcatctatatagaaagcttaggctcagccccgggcctgtttgtctggtcttggagctaacagtgtataattaggtcctttattccagtctagtgacttttgaatgaccagagtccaagggagctatctgagcagagctttaggctagtaaaggacaaagataggtaatgaagacatcttttattattttccattgtacaacagtgtggctaacttgaaggttagatgtttaaaaggaaacagctggtttatagaaatgattctaagatgtgtttgttttgtagaactctagctgtctgttagccagtatgctctgactgttttgtgataatttaattttcttacttttctttttcagaaaattcttccaggaggaaacacatcatttgatgtagtttttcttgcaagagtagtaggaaatgtagaaaatactttatttattaacacatctaaccatggggtgttcacttaccaggtaagaccagaacttacgcttccttttcagtacagtcataaccagcaaacctgataacctttaggagctgcggtgtgaactccagggggaaatgggaaatacaggacattaggtttagggcacttacacttcctggatctcaggggtttgcatttcatctattgcttttgtttgtttgtttgtttgtttgtttgtagtaccaggaaatgcactgaggccctcgcatattctagatgtacactctaccactcctggctaccttgtccactcagtgactagactaatgtagaatgaagggcttggctctcccaggcactaacacaggcggtcatagtctatagtatctgacggttactgtcaggttgttaagatgagcttcaatgactgctgtactctagtgtactctgtcctttcccacagctggtgctcctccaagtctttgtcctaaatacacctcatctgtctgctactcttggccctgcccctgctctttctcagatgtcacctctgctacctctcactgttccccaactccttctccttctgtgacttactttataatcacagcacattttataagagtctctgcctttaccacatctgcccagtactagagtaagtgccatgggctcattatttactgtgttcactacggtgcctgtgctgtgcctggcatagcatagacaataatatttgtcatttgaatagttgcctttcccttttggtcagcctaagtgaaatgttccatgggggttaacctgagcctgggctccatagctgagcattgtctgggtcatggctctatcccttactagtgggatagggaaatttcagctccctgtgtgcatctctatgtgtagtccatggtctactgaagggctgtgctaaaagtcatccagaactcattctggatgcatgtacacaggaaagcagatctacgcatgccacttcaaggggtggttagcattgctcgcatcaaaattagactgactgttctccagagataagagagctgtaactatgaaaatgctagtttacaacgcaactaaagcttttttcccccctttgaaacaggtatttggtgttggggttccaaatccgtatcgattaaggccatttcttggggccagagtccccgtaaacagcagcttttcacccataataaacatacacaatcctcacagtgagcctttacaggtgagtttctgtccttttccagagggtaagtttaatcttcattttggtgggaattagtgcctagcaagaaatctcaagtctgtcacagttgccaagactatgttagaaaaagtcctagggttttctaggtgggctcaagagatgtggggcagtccacactgtttgcgtgttacccattttcctcagtctttgttgtgacctagttatcttcactttgaattaatttctctactcctttcccagttattccttgtttgtttgctaaaggtggggcatcatgcaggcctggcacttgctggacagacgtgctgctgctcagctgtgcccagctgtgccaaatggcaggtcacagtactcagtgagatagagctctagccagcctgcagagcgtggccttcagcatacacagaggagagcaagcaagcagaaaaccttttctgcttatcttggagtttagatgtcctactgctttgttctctcttactccttcctgggagactttatgataaaacaagtatcacagttcccctacttactactactttgccccaaatttactaaagttaaatcaatgtatctattctttgttagcactaaagttctctgctattaaagtttcccaccatcttgcccactctcttccttaatgtttacctaaaagaaaagaaggcaggtgtccataacaagtgtcctcagtcagtacctactgcagcttcatgtcacccaacactagacatcaccagtatgttagtgtaagaaactgtgatgtgagaccaggcaagttggcacacacttctaatctcagtacttggattgttgagtccagacaacctgtagcaaggccatgttgcagatgaataaaacaaagcaaagcaaccataaagagagaaaagaaatgaattattaatagaacctggtgaatctcaaggtaattacattgaaagaaaaaaacaaaacaagccagatatagtacatactatttactctgtgtgtagaaaactctagaagaggggctgggaaggtggctctgtagataagaatgcttgtttttccaacatgaggtcctgagttctaatccccagcacccactgaaagactttggcatggtagaatttacctgtaatcccagcactggggacataaggtcaagccgattctgacagctcactaagcagccaaatctgaaagagcagcaagctcccagctcagtgagaaactatctcacagcaatatggcaacacaggaaaatgcccagagtcaaaggaatatgcactgcctgagaagagggggggcggagagaattttggagcactggctatatttaatatctacattgcagggatggcttcatgcctgtatacaaaggtcagcaattcccgggttatacttgaatacttgtcatttattgtacaccagagatattaatttaaaaaaacattgtaggcacaagcttcaaaaccaaatatctttgtatttctgttttaactgaaacatagttaagtgcacatatttatggaccactctgacatttcagtacatgtctacaggagaaaatgagttctgggcagttggcttacccatcacttcctattcctgtgtattaaaaacactcgacatcttctgtgatctttgaaatggccactaactgttgtcaactgtagttcccttcatcccatagaccgtgagactttgctccagtccagccttgcagagttgttgcacattagccactctctctctccagccctcctgtagagaccttttttggtatgtgtgctattgggttcaaacccagagctttgcacatgctaggcatatacactctcaactcagaaaccaagtgctttgatctttattagaattgtacatgtatctcagagtgtttaatcttctcatggcactgttattggatccaccactagatctagctatatgtaaaattgatatgtacgtatacattttttggttttgtttttctgaaatagcctcatgtagcctaagatggccacagactgtgcagcgcagatggccttgaattcaagattgcctcagcctcccaagggctgagaagacaggcatgtggcactgcaaaagccttaaacttatatttctaaaacttcatcatttacatgtatctttatttttatttatttattttttaaaaaaggtgttctgttgcttcctaaaacctagtttctgaaactacactgcttccaggtttactttcagagttaacttgagtcagttgcttctgcagatgagccatgggagctagtgcctgccctagtgtatctgcttctacacctgcccaacaagaagtgagagtgctgtgtactttctttgtcacaggtcgtagagatgtactcgagtggaggtgaccttcacctagagctcccaacaggtcagcaaggaggcaccaggaagctgtgggtaagtggaagcagagcttgctcgtgtgtgctcctgtgaagtccagcattttcttcttcttttaaatggttcacagaagagttattcctgccattcattacatacattatgacaaggttctgggactctgtggcaagagggcatcaaatcaacatgaggatcttttgatatacaacatgaagaatagattatgaacataattaaaacaatataaacatgaaatagtttacagaatacaaagaaacagattagttgcaggtgtatggtaatgattcaacataaagggaaaattgatctaacttccttttcagattcctttcagtatgtaagaaagatggcatttttacttaaaagctaatcttgctcatctatttattgtttgaaataagacactttcagaaaatgtgcccaaaattttgtttaaagaaaatacacattaaaaacgattttaggctgtgaggcaggagaaacgactagagagatggctcagtatttaggagcaatggctctctagctggaattcagttctcagcacccacgtggtgcctctcaaccatccttaactctacttccaaggaatccagtgccctattctggcctcatagacacccggcaagcatatgagatgcacaggcatgcaagcagacaaaacgctgtacacataaaataaaagtaaataaatctttttaaaaatcaacctaaaaacatacacacacacaaagtatgactctctatcatatgatcctaacactaaacattttgaaatggcttgctaaccataagtacttaaacttggtagtgtattagaacatccttagattcaacagggcttacaatagaaggagaaagggtgtattgtatgattgattttaaaagaaataaaactcattctgtataccattgctaaaagaatcctttgagaatcttttcatctagtatttattttcaaaagtggaactagaaatatgtagcctagaagtctagaaatctgctcttccagagggcccaaggtcagttctcagcacccacatgaggtcccgggatctgatacctctgacgtcagtgtgtatgtgcacttctgtgcacacacccagacatgctcatatacacagtgaggcactgagaggcgcagatcccttcagagcatggattccaggctccataactcctgctgggctctacagaagtccctttacaccccatgcttcctgttagctgcatttctatcagagcactgcaggagacggttacacaatcactttacatccggtgctcaatgttacatacatttatagacattcacgacaggagacgctcctatccaacttggaaactttcatacaagtacaacttttttgctcaattttctatttcacaagctattgccctactgtgtatttacaactgggggctgtgaaatttatgtctttggtcaaacttccctatcataggttgttttctcttccttatgaaactgataggcagtgcctagaaagtgtctaagtgaatcgacttggaaatagctgagagctataatgaacctggcagaaagctcctaatccctaagcgactgcagaataataaccagtaatgaatgagtcctccggagaggccgccacctgcatccacatcctagcagtcggggagggtgtgggtttacttcaccgggaatttggtctgagacactgggcagttttagcagaggtttactgagcaaaggcagattggagagggctgtcccacagtggatgtagcaacctaatcaagttgtgggttttaagcacatcttgtgactatttatcttatgactattttgatttagcgtatttgtgagataaagtgatcatttcccctcccagatcatagcacattaagattagattttcctgccccataggtaattcttctcatgatgctttagaaaggccctgaaagggggtggaggccaaatacagtaaaaatggctttctaacagaagcaggatctttgaggatgcagaccttcactagtgtgtgggaaagcgccctgcaccttaattttttttatgtagtgagaacattatcttcagccacaagggagtttaaccactaacagtctgtggaaccatcaggagatgcagcagctccaaggcacagctgcaacccctgtggttatcccataaccgctgctcaggtcctacagttgatgtgtaggttttatcatgagagccagggcttcccaagaggttgctggctatgtagacaggaccagagctttggctgtctgtaggcatcctggtgcccagctccaccattcctgtctgtcttctgcctgatgccaccctacccacttcactgtacatcagagagtcccagggactgagaccacttcctagagttggaaaacaatctgggttttccccagaaggcttccacttgcctgttttctatctactttgagacgacagagttatctagtagagtgtgtgtgtgggtgtttgcatttagaagtctgaaagtttatgggggggggggtgcgcgcacgcatgcaaaaacatttacttgaatgcactacgaaaagtgttaggttttaaatgagagaaataagagtccaaagccaacctggctatcatctggagaacactatgcacttctggaaaatcctgccctctgatagggacatttctattggataatttcaggactaaatacacaactgacatgttactaaaacaaaacaaccaactgattttctagaccagttaggcttttaagaggttttttgcagcttatggttgttttcagaccgttggcttgatttacttgtcttgacacagcatccatcacccattctaaaaaagctcatttgtttttgtgttgaaacgttctctgagcttagaggttttatgtgctgcagtcatcaaagcatatgtttaattggtgatgtactattttttttcttgataggtgtataaaatagcagtgcaccttcactctgtgtcatctaattgaataaacaaggtatttgtacagcattgcaggcacttgctacattatagtctgtttactcacaggaaatccctccttatgaaaccaagggagtgatgagagccagcttttcctccagagaagcagacaatcacacagccttcatccggataaagacgaatgcatcagacagcaccgagttcatcattctcccggttgaggttgaagttacaacaggtcagtgagagctgactgagtgcaggtttgttcagcacgccctgccctggctgagagagtgatcattgtgcactgttcttttctcccagctcctggaatctattcctcaactgaaatgttagattttggaacacttagaacacaaggtaaagtagcaaaagcctttctgggtctgacttagttacttttttgttgctgtgaagagacaccatggccaaggcaacttataaaagaaagcatttaatttgggggcagggggagttgcttagaattctaacggttaatccatgaccatcgtcatgggagcatggcagcaggcagacaggcatggtgcttgaggagtagccaggagcacacgtgttacctgctagttggaggccaggagagcccaccctgacaacatggccacacctcctaatccttcagaatagctctacctctggggacattcaaatgtctgagcctgtgggggccattctcattcagaccagcatgagccgtaaagtaatccacttgggattcagttctgatggctctgcttgtaattcaacttgaaagccatttctcagtgggtcctgtgatttttgtagaaagtgttttttcgaaacctcctccccggtgagaaaatagggtgaggtaacttgaatcttcaggtagaaaacggagtcagaaaatagtttctttttttaaaagatttattattataaataagtatgtatttgagtacactgtagctgtcttcagatgcgccagaagagggcatcagatctcattatgggtggttgtgagccaccatgtggttgctgggatttgaactcaggacctttggaagagcagtcagtgctcttacccattgagccatctcatcagcccccagaaaatagtttcttaatctagttcctcacacattcaatgtaataaatatttttatttatcttagtgatcaaagaaagaattctaattttaaaattataaacaaccaagctaagatgatgatgatgatgattaaggaaaaagtacaaaatttgagattgattttgtaatttgtaattaagacttacttgtccaggattaaaggccatatttttgaaatttaatttgcttttactatactaattttgcattgtatttgatgaggtaaagattctaatttgctgtgaagcacaccttttaaagaaacacttcttttcttccatttcaacagatctaccaaaggttttaaatcttcatttactaaattcaggaacaaaggatgtaccaataacagtaagtttttgagtgtcggcgcacacacacacacacacacatactcacactgtgtgtgcatacacgtgcacatgcgtttgtgtgatttaacagcagggttaagtccttgctctgtattgtggtgacctgtagactcttggttgtatgtaggatatgagaatcctggtcttcattcatctactcgttcatttaataactgtcagcatcagctgtgcactagactgcatcctgaaggtggagctgtggctcagactgcccaagtcccccttaccgttgagctcactttgaacccagacttctttgggtccatctaagtgtggtaaggaaaggatcagccgacttacacattgtagacaaacgctgtgcctactttggcacaagcgtaaaagatgagagagaccagccagtgctgtcatggtgctcagtcggggaggtcacatgggcgtagatctctctcttacattcactgaaaactgagttttctgagaaccaagctttgctttgtcgtgctttctgtttatttcagcatttctttcacatagtataacaagattagagcctggtgtgtctttagagaagtcattttcctccagttaggctgtgctgaatgttaatgtgtattttattcatttctcttccaagatctattctctctttaaacactgtggtccttcccagtgtgtgatagcaattcagggagctccagatgtgatcccctgaccatgcacagaaggcccacattcaggccctcctgtctgtcatgtaactgagaaaacagccttcctgatatcatgacacccatgtgcctcagatatcttcaaagggaggcttgcatgagcttccatggtagttgatgagtgggagccatttgtatcagcttgacatttgctctagtgaatgtatacacaaaatatccagttgctatgtactagccggtttcccctcgcttgttggcatgctctgactgctcaatatgtcttggaatcttttttttaaaaaaagacaaaaaaccaaggtctcagacgtggctctgaactcacagagatctacctcagcttcctaggtactgggattataggcatgcacaccacacctgacataattactgagtgctagtttgacctgaatatcatgagaaaagactaaacatgtattaagaatagatgcaagcatcagatcccattacagatgttttgatcctccaggtggttgctgggaattgaactcagaacctctggaagatcatcagtcagtgctcttaaccactgagccatctctccagccctgctttcccatttcttaagtcatctttgaattagcagtagttagtaactagtactaaagtggctagtataaataagttcattacaaggcaatgattttgaataattttttcatcttaagttacctgaatgaactttaagtattttattgtgattttttgtttgttatttatttatttgttatttccttagacaaatgagttttacctgatgattcaggtttatttttaagagtgcacagttcagactccttgtgtaaagtggctcaccaactttacatttgttcactattagtgcagtatgttttgcagtgataactctgaatgtaaattctctctctcatttggcaatgcttaaagtattgcatttgaagtgaaagaatcattttttttcaacatgtattttaagatcttcctgcttataacaactgtatctcagcaaaaaaacatgacttgttctttctggtacggttttgcaaggctgctaccacagagagcatgctacggtgtggcccctcaggaaccgctgcagcaagggagcatgtctggacatggccgtgcttccattgttgctgtctcacaaggtagacagtgaaggaaagccctctgaggcctcagctcacaaggccagctctctagctccgcagacagatcataccctagagaaattctcacaggtggggaagtgagcctgagtgtggccacgagcagctggggctccagctgcactcctgctgcctgcctgcctgccacgtgtgctccgtggcttcccttgctcgggtggtaaaatcgtgcaataaaagcaaaagaaacttccttccatttgcagcttagctcacagttctagctgttctttgtttactctcaaaatgcttacatatgcttgaggggatggagaggtctgtgttttagacggttgctactaacagtaagcttattgataagtaaggaattgctgtgagcagatcttctggttcccagcccagtcttcagcgcacagtgaagcagatgagaagctcatgctgggagagcagaggtgcaaggattccagcagtgcttctgcgggagggagggagcagtccttagggtgccccagcctgtgaggtcttgctagcccccagggctaatggcagtgcgtgggagagtgagctgccctggcaggccctggagttactctaatcttcttaagtccctgccatagcaagcaccaggctgcaggccagtgtcctttttcatattcttctcacttctgttgtggcttcaagggactcacatttgatgctcagactgggaagagttctcctttataaggatcagcctcgactggggaggaatctagtgccctgccggccgtgaagcaggcatgagcttcacaggtggaggattgtcctggggggagggggggggataagtgggctttgatgtcaagttcacacagccccaatgatttgatacttagaattaaggttactgtgcaatttgtataccaggatgtcagacaagtggccctgtaccgagtcaggagcctggcttcagtcctctcggtacccgactgttgaaacattgcgttatactctgaggctttctttcttttttttttttttagatttgcttatttatttatttatttatttatttatttatttatttatttattatatgtaagtaccctgtagctgtcctcagacactccagaagagggagtcagatctcgttatggatggttgtgagccaccatgtggttgctgggatttgaactcctgaccttcggaagaacagtcgggtgctcttacccactgagccatctcaccagcccgaggctctctttattagaacagtgcggatagaattgatatctttgaattctttcagttaaaatgatttgtatcattgaggataatttaaaaaaataaaccttataaagtgttcaatttaaatatatactaaaaatacaccatttagtggggtgtttgtttatttgtttgtttgtcttaactttaagtttgtgtagatagacctgatttcctaagttgtaagcatccgagcctcacttccaagttcagtgcctctgtagtgagcctcagtccctagtgctcactagagtgcagccttaccctttgacagtggaccgtgcttaccctgccaagccggggagaaacactgcagaggccacatggggtcacagtgccctgaggtgtgctcactcttcctactaggacacagtttcagggcacctttgtgtgtggctttcttcaagatggatgagtcttgagatatcttcttgtcctcttatcttagaaagtaggctttcatgtagagaaggagacctttaggtttcccatgtgtgagttcgtcctgaggtgtcatacttagtcatctcatactttgccatcactgcatttcatacagtgttcttgtgaaagtcgggctttgctcttgtcttatttcacttacagctactagtattacgccttacgtttgtgtatgcttttctttctacctaaactactagactaaaataacaggtttgttttcttcgcagagtgttcgaccaacaccacaaaatgacgctatcacggtacattttaaaccagttacgttaaaagcttctgaaagtaaatataccaaggttgccagcattagttttgatggtaaatattcatttttttctcctagagtggttattattttgacaaactagaaagctcctatgttgatgagttaatatagaaatccagactattttaatactactgcctcaattgattttcccctatgaagattcatcattaacttactttattaattcataatataactccacaaacctaaaacagtatgtacaatcaggaaacctaagcagatgtgttagggtcggaagtttctgtagtgtgggataactagtcacagcagtcgacatttaccttagttatgaagtcattgggtgttttaattaactgatactatatttaacttccagaagcacattttggttcacaggcaaaaatattatttttaacatttttctgtgttgactttttaagcaaagcagacagtcctgtctaagctaaaataagagcctttatgtattgtcaaattagctactatttcagacaagtgatagatatcatttgatgtgttatttcatatctagaaccacgcctccctggtcatacccagtctcacctgaaacattagctcagacgtcagcatgtttacagtctgtcttcattccatttttcacttgttttaagagaaatttattgaatttattactgcaaattttaaattatgacataacagctgctcaactagatatacaattaaataagaactgaaactcggaagagcatgtcttttctgtggtcttgataccccggacatgcccatttcatccaatacacctgtcttatcggagcatggagtgagcgataaagctgagcctggtgctccaacacccacatctgcccagagtccccagctcacaccccggctcatcagatgagggagtcggtgagggtggcagcagccaaccaagcgcagcagtgtgggagagagtctgcatggtcctcacatgctcactgtactgagggttaaggagcctgccgtcctaagtgacaccagcgcctcaaacgagcctgtttgcctcgctacaggaaagataacctgctttttatataaaatgtgagcgcggtttgcaagtgtgctgttggccagtgtaaaagctttcctttttcagaaacaaaactttcagtttgcataaagtcacacagacttacgagcagtaaaaagtaagaagctgcctacatggctcagggttcaggcctcgctgctgcaagcctgacagcatatgttctgtccctgaaaacgcacatggaggaaagaggatagtcctgaaaattgtcaatgtgtgtgccacatgacacctcacccgcactcactcacacacacacacacataaggaaatgtaatttttttacatttcaaaaataccctcacacacacacataaatagatgatttttttttaatgcttccttgcagcttcgagagcaaaaaagccatctcaattttctgggaaaataactgttaaagcaaaggaaaagagttattctaaactcgaaatcccctaccaagcagaagttctagatgggtaagttttgtcttaaaagaagctttgtaactttttgtttgtaattttttgctgattgataaaagttcacctaacctgatgggttattgtgaaaaggataaccacaactataaaggaaaattttctgtgtcctgtttatttctgactttctaaggtggcaaaagaaaatggaatattatggtttgtgttagatttaataatttataagtcaatttgtgctttttaactacttaaatcttttgaacctttttcactgtgccattctgtttgaggtatgtcagcctgttcctcggtgacttgaggcagtcttctgtcctttcctaaactagcagtgtgccgacacacagcctgtagatgcccactgtggccatgcatgcattcatgcttgcagtgacctcagcagcgttagccttcctgcactctccatgctgtccatggaatttcagcttgcagcagggaaccgtccgctgtttcatttcagtatttcatgagcaaaatgttaagtcacatggtgaatgaagttataaaaattaaccactaaatgcctatagttgtaattccatggtgtggcttaatgctaaatgtataccaagcaagttgggcacatggaagtaaagaggattcatcctgctttgttttcttcccgtagttatttggggtttgatcacgccgccacgctgtttcacatccaggacagtcctgctgacccagtggagaggccgatctacctgacgaacactttcagttttgcgatcctcattcatgatgtgctgttaccagaagaagccagaataatgtttcaggtgcgttgagcccgcttgcttggcatctgctgctctagcatccaggtgagagtaaccctgctcttctgcttcatccccaggtgcacaacttcagccagccggttctcattcttcctaatgagtcgggatacatttttaccctgttttttatgccatccacctcatccatgcacatagacaacaacattttacttgttaccaatgcttctaagtttcatttacctgtgcgggtatacacaggctttttagatgtaagtatgtcgtcaaggtcctacctctgtgcttttggatattgtcaggcaattgggaggattccttcctagttagtgctttcaggatacagaaatacacacacacacatactcacatacactcacacactcacacacaaaggactcctaggatccccagagaactccaaaactaagggttgctattcttcagtgtccagtgggaagtgatcttggaatctactatagatgcccaaatctgtgattatcgcaggccaggcccttatggagaatgctgtagtattcgtaggcaaacagtgacatccgtgaatgtggaatctacagatggggaagactgactgcccatactggtcttgttctaatttagaaattagaatagatagtggtaaatggaacacaggttaatatataacacagcactgcagttaaactattactttcaccttttgccttaaggaaaggactctatagcttttctttggcatagtaactccctgcattcactgcccttgctccttgggacatttataaagcatgataagggttgattgaacacaagcactgtgttgctaccacagtttccctttgagacctacaggattgatgagtgggtcgcatgtacaggattggattcacaggctgaaggactaattcacactgggacagctcaggctttgctgactgctcagtgaagcaaaccactgaaaacttaggagttacttttggaatttttcacttgagtccccccctcccatatgatatatttatgatatatttagctcctttaattccagtcacttcccggagctttttctacattattttctcttgctttacttttacattgtaagacagagaatctagaacaaagataaatggagaacaaatgggacagggagactattaggaaacacagtggtgaccttgattggataaagttggagaacaccaggcaaagcaaagaaccagagaagaagaaggctggatggtaaagatgcacacttgggcaatgcagtagacacaacacaaggaaggtgcagaggtcttcatggcacagaaaacaaaccagagggaaaattgcagacaagctttggtgaatgtggccaatgaaaggcattggggaagagaaagatgggacatctttcatcagctaggtgtgcccagctctagagctcagtccaggcaaggggctaattattatttgtaatctgtgagtactgagaacacagacttctgcctgattgtcagagctccctagcctttcctagaacttcagggaagtagctgctaggaaatggcctctccatccctgactcctgattgtccttgtccgaagttctcagcatatcatgtagttgtaaatatagacataagatgtagaaaccttagtgtctcctagtggacactttattcagtaacattgttaaacatgtgatctggtgtctaatacagtccttttctatctctctagtactttgtattgccccccaaaatagaagaacgcttcatagattttggagtactgagtgctacagaagcaagtagtattttatttgcaattataaacagcaatccaattgaggtaaagacattgtttttattctcagttacactgaagatttcatgtttgtgctgcaagatcactttttgttttctctttgaagctggcaataaaaagttggcatatcataggagatggcttatcaatagaacttgtagctacagagagaggcaacagaagcacggtgattgcaagccttccagaactggagcggtcctctttgcccgaccagtccccggtgagtgggcctcttactgcttcaagttagaatgggtgtttccggcccaagtgaaagagcagggctatgtgccccactcggcaagtactgtgacctgtttcccggtggccatgagcgctagacactgcgggggccttgtggagcccgtctaccacagtgaagcaggcacagagtagatgatgagggcacagaagaattggaaggatctgtaccacactgtcatgaaaggagagtgtctgcagtaaggttctgtgcatcagctgtgcagatgctgtcacacaaagtccacacatgggtctgtgtgggcatagctcaccaccagagtgctcccccttcagtaagacccttgaacctgcacagctactaaatgatgccatttttactgcttcaggtaacattagcttcaggacactttgcagtgttcagagtcaaacttactgccaagaagctagaaggggtccatgatggggccatacagatcacaactgactacgaggtaagctgaccagcggggttcgtgctgaccagcggggttttctcaaacttattaatggctgtgcacattgatcgggcatgtcagtttctgtagaagcagagaactacatttatttacagtgtacccctcttgtgcctttaatacagacctttcagagccatttcagaacactagtgcttgtacctcccagggctctgctgaacctcctcagacctcctaacttaaccacagtgacaggaaagtgcccttagcacactgagggtcacactgttaaaaacctgtctacagatcaccacagagcaggtctggactggacttcctgagctgcaggtctgactctgcactcgtgttttgcagtcctctgtgtagtgtgtatattatattcactaagatcctgattgcatgtatttctggcagatctgatctttttcctattttatacttttgattttttggataaaggttctggaactcactgtataataaaccagccttgaactagcaggcctcctacttgagcttcccaagtgctagcattacaggtggaaggttgcttgcctgtctcagacctaaatacttttaatttaacacttacagatctttgggcggttgagtacttctaaattcaacaagttgctatctttgtcctcctgagtggtttcagcatacacaaatccagtggcaaaataaacagaactggctattcaaataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttctctgtgtagccatgcatggctatcctggaacttactctatagaccaggctgtctcaaactcagaaatctgcctgcctctgcctcctgagtgctaagattaaaggcgtgtgtcaccactgcctggcttgaatcttttttaatttcaagcttttctaatttgataccttctagaaaaacgaaactgttacttggtaagaaggaacactgatgaagacttcagtctgtggggctggagagtcggctcagcagttataggagttaggcttttgcagagaggatagtggagttggcagcacccgcatggcagcttcttgctgtctgttcccagttcctaactctggccgctgcacttgccagacatgcacacagtgcactttacatgtgtacagccaaaacattcatacacatagttaaaacaagcaaaccttttcagaagaatctaatttgtgtgctgttttgtcagagtcttcaatgagttacttggtgtgtttttactgtgaattattattttgcaagacaaggacgtatgaggctctgtcctctggccttgatcatccacatgctgacagtacaggcatgtaccccatgccagctgatagcctacatttttttttaaagatttatttatttattatatgtaagtacactgcagctgtcttcagacactccagaagagggcatcagatcttgttacagatggttgtgagccaccatgtggttgctgggatttgaactctggaccttcggaagagcagtcgggtgctcttacccactgagccatctcaccagcccgatagcctacatttttaaagagatttaattttctcttggatggcaaaaattactgttgtatttctaaggaaaacattttcttttaaagaatgtgtttcggccttccttggttagattttagaattcatttattttggggcagccttgccttggtgttagcagactttacattacaaacaaagtgaccctctaaagccccctctgtgccttcctgggtacttagtatgtcaacacaagttaaattcccattagtttataacagtacttctgtaacatgcacgatggcaccagtgaaaaagctggcctgtgatctcaggtcttcagatttgctggttctcatttgaatgagggcatggattttcgtgtcaattataattttaaaaggtcaattgatgaaaattctgaatttgtgttttcttctttcaggggaaaatagttcatcagagcttaaatattatgaattccttctcacagaaggtgaagatacagcaaataaggtctttgtcagaagacgtacgattctactacaaacgattacggggtaatagggaagacttggagccagggaagaagtctaaggtttgttagaaatgagaatttccagctgtcatcactctgtggctggtcatctgtctgttctcggcactcatgttcgtcctgtgttcctttacagattgcaaacatttattttgaccctgggctgcagtgtggggatcactgctatatcggcttgcctttcctatccaaatgtaagtcttccatcccgccttcctttactctcctgcctcggtaccgtaggactcactggaaggggtactggcagtggcttaggctgagtgcatgctgacttgtgcttcctcttttagctgaacccaaagtacagcctggggtggccatgcaggaggacttgtgggatgccgactgggacgcacatcagagcttgttcaaggcttggatggggataaaggaaaacgcaggacataggtatgagcttctgcttcattcaggagttttagagggtagcccacggggcagctctgctgttgtgtcacattgtcattgttagcatgtgtcgctaagaaatgcacgcactcctgtgtcctcttttctccagtgcatgagatctgtccttaaaaatcagaggaactatttgaaatcgtccttgtttatagtgactgccatgtccaccttagacacagagttatgcatgagaagaaagatttgtctgtcactggcctctccaaaaggcaacttaggcttaatcccaacaggagaccaaatttatttgttccttatgaaaaatgctacttcctttttcttcaagtgctggtcttttgctggggaaacagggccctgcagtggcctccccactgcatctttggcaggtcgaaataggcttctggaaacccagtgctgtacctggactcaaacactgaaatgtggtgttggtatcacagtagcctggccctttcacgcacagtagaaaagaacttttccagaaacaggaatactgatgagtaataagtacttttctcacttggctgacgtgatatgtattggtcagagttaaagtattctcctataaggacagtatgaagttttaaagctttggttagcacacagagcatgggtgttgctggcaccgtcgtgtacacatgcgtactctttgttcttacagttcctctgtctccttgctgctccctttcttccttagaggaatcccctgattttgctctcatgatgtattttccattacctcctcttggccttccttgagacctctcctggttccctcttcactcttggctgttttagatagtgcagtgataaatactgctttttgcaaatgtctctacagtatgttgacttaacaaccttagggaacgtcccctggttagtagagatataatagttctactgttaattttcaaggacctccatactgatttccataatggctggacaagttggcgttcccatctgcaacaagtagagcttcactccacccacccatcttcactaacgcttgttgggggtcagttggttagtcaggggtgtgcgtgtgcatgtgcatttcaataatagtcacccctctgaatctcaaagcagttctaatttgcatcccttgatggctaaggatgttgaagacttcttcaaatgtgtctggacattggtatttcttcccttgagaactgtctgtccagttcagctcataagtccatctgtctactaggtggctcagtccattaactgttgagaatgagggtttctatattgtaaaaattttccttatagtaaagaaaagaaagttttctcattaaaaatggtttccctgagcacacaaagacttgtaatgacctcgagaagagctcagtgatcacagctctcttcttctgtctccagagtggagcttgtaaagtgtaggcagtcccctagtgctgatgagtagctcattagtgctgcctgctgctgcagccagggagcctcctcaccaccagtgtcttccgacatgctcctcaccaaggccctgggttcccgtctgcagtctgccccccccccccatctggttgacaataagcataacactctcctcgtgcatgcacttgggttaccttgtttgtacgcatgtgcttgtcagtaccccagaatcataattcagtagcactgggtttgagtgtacttcactggttagtcccagacacttggcatttccaaatacgttccaggtcctggactgctgactcttgagcactcattagtaagtatgtgtttatatgaggtcctgagggtgactgtgactgaatgcagtctatactctccgtttatttcctcttgaactgacatcttcatcatgtgaagatgtcaccttggttttatatcagagggaaactgtgtatgtcaagccaacacctcttgtccatggtactactgggaatacccaagtgtcctgctggggtgtccacatggaagccatggaaaagtctttaaaacccaagtgttcagccttcattattgaattaatacctttaatacctttgaggactaggctgttgatgtagttcagtggtagggagcttgcctagcacacaggcatttgcttcaatcctcagtactaccaagaaaaacgtttttgaagatgtgcgtgcatcttttactgatgctactagaactaaagcttgtcatcctttacatatgctggacagagctatagcacagatgactttaatgttgacagctctctgtgcaaaatagagacacatgatatgtcattgagagcttaataaagctgcatgcccagtcataaggatgacagcatctctgtcaacttctctaagactcaaggaacatcaacagaaacgtgtagagaacattcaagccaggggaaatcgtgagctacttgtggatgtgacataactcatgtttgaagtaaatacagatcttcagaaaaatatcgtatcaaaagtcagtgccgagctctcctggccgtctgtccttagctcgccccggctcctgaagttcccactcactaacacaaactgttcttcggtaagtgttcaaatggcctaaacagtcagcaatgggccacgcgtggttagagagccgacgctgtaattcctctgtagggatctccactaatgcatctgggctttgctttaaggaagaagagattagcttagaaaaccctgcagacgtccctgtctacgtccagttcatcccactggctttgtattccaacccctccgtctttgcagataagttagtctcaaggtaagcactccttagctggtcaaagggtaaacgcagagtctggctttatggctgaagttgccagcagtttcctgggagtgggttggtattgaattgaacatgaagaaaagctttcaacaggtgtaaatggggcgctcacatttaacagatttgtaaagggacaacagacaaaataattccactaattcctttttaaaagtgaacaaggtattaattataagttagcctttagtattaatatggtataatgctactggtcccaagacctgacaaaagataaatttgcaaataaaacctcaagtttggctatcctccatagttcctagttgtgatgtttatgaagataaacgtgttttttattttaggtttaacttgagtaaggtggccaagctagatttgagaacacttgaattccaagtctacaggaacagcgtaagtacaacaatcatttactctgctaggaccagggccaatgggaaggacacctgcgggctgcccttagcctggctgaaggcagctattgcagtccaggaattgacttagaggcagaggagagcaggaagagtcagggctgcagatacacagggtatgttagacggttcctctttgtgggtattaaccttagagtcagcagtcagcccacgatagctcagcataatgccacccagaaagtctgaggctgtacatgaaatatgctaatgcaacattttatttttaagcgttaaaagattcagctgagctgggcgtggtggcacacgcctttaatcccagcacttgggaggcagaggcagaggcaggtggatttctgagttcgaggccagcctggtttacaaagtgagttccaggacagccagggctacacagagaaaccctgtctcgaaaaaccaaccaccccccctccaaaaaaaagatgcttcctgataaaattgtaaaacctgtgaatgtgagaccaatacctggcacagctctgtgtgtgtgtttatctcgatagataatgttgactttaaagtgtataataagttgatttgttctgggggtgaaagtggcctctattattcaggtaagtgtctgctagccactcatattgtatcaggccttgatgtggagggtgcatgtcagctaggaaggtttcacaggggccaaagccctgcaggctgcctggggtcttgtgcttcattgcctttctgccttattcagatgagagtgtttgtccttcctgtttggaccacatagtgctatgtaggaagtctccccagcctcgtccagccagctgctttgtagttcttcatc

SEQ ID NO: 296 - DNA, 1651 bp, Mus musculus
atgaccctcgtggtggccgcggcgcgggccgagaaggaagcattcattcagtcggagagcataatagaagtcctgcgctttgacgacggagggctactacagactgagacaacacttggcctcggttcatatcaacagaaaagcatttctctgtaccggggtaattgcaggcccatacgattcgaaccgcccatgctggatttccatgagcagccagttggaatgccaaaaatggaaaaagtctacttacataaccctagttctgaagaaacgattactttagtatcaatatctgctaccacatcacatttccatgcatcgttttttcaaaataggaaaattcttccaggaggaaacacatcatttgatgtagtttttcttgcaagagtagtaggaaatgtagaaaatactttatttattaacacatctaaccatggggtgttcacttaccaggtatttggtgttggggttccaaatccgtatcgattaaggccatttcttggggccagagtccccgtaaacagcagcttttcacccataataaacatacacaatcctcacagtgagcctttacaggtcgtagagatgtactcgagtggaggtgaccttcacctagagctcccaacaggtcagcaaggaggcaccaggaagctgtgggaaatccctccttatgaaaccaagggagtgatgagagccagcttttcctccagagaagcagacaatcacacagccttcatccggataaagacgaatgcatcagacagcaccgagttcatcattctcccggttgaggttgaagttacaacagctcctggaatctattcctcaactgaaatgttagattttggaacacttagaacacaagcttcgagagcaaaaaagccatctcaattttctgggaaaataactgttaaagcaaaggaaaagagttattctaaactcgaaatcccctaccaagcagaagttctagatggttatttggggtttgatcacgccgccacgctgtttcacatccaggacagtcctgctgacccagtggagaggccgatctacctgacgaacactttcagttttgcgatcctcattcatgatgtgctgttaccagaagaagccagaataatgtttcaggtgcacaacttcagccagccggttctcattcttcctaatgagtcgggatacatttttaccctgttttttatgccatccacctcatccatgcacatagacaacaacattttacttgttaccaatgcttctaagtttcatttacctgtgcgggtatacacaggctttttagattactttgtattgccccccaaaatagaagaacgcttcatagattttggagtactgagtgctacagaagcaagtagtattttatttgcaattataaacagcaatccaattgagctggcaataaaaagttggcatatcataggagatggcttatcaatagaacttgtagctacagagagaggcaacagaagcacggtgattgcaagccttccagaactggagcggtcctctttgcccgaccagtccccggtaacattagcttcaggacactttgcagtgttcagagtcaaacttactgccaagaagctagaaggggtccatgatggggccatacagatcacaactgactacgagg

SEQ ID NO: 297 - protein, 551 aa, Mus musculus
  VARIANT (1)...(551): Xaa = Any Amino Acid
MTLVVAAARAEKEAFIQSESIIEVLRFDDGGLLQTETTLGLGSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQASRAKKPSQFSGKITVKAKEKSYSKLEIPYQAEVLDGYLGFDHAATLFHIQDSPADPVERPIYLTNTFSFAILIHDVLLPEEARIMFQVHNFSQPVLILPNESGYIFTLFFMPSTSSMHIDNNILLVTNASKFHLPVRVYTGFLDYFVLPPKIEERFIDFGVLSATEASSILFAIINSNPIELAIKSWHIIGDGLSIELVATERGNRSTVIASLPELERSSLPDQSPVTLASGHFAVFRVKLTAKKLEGVHDGAIQITTDYEX

SEQ ID NO: 298 - DNA, 260027 bp, Homo sapiens
  misc_feature (1)...(260027): n = A,T,C or G
cagcaacgggctaagatccttgctagccatctctagtggagcttcatctagatctgaagtagctgtaggcctatcattgcttcttttgtctttttgaactttttattatggaaagttccaagcgtacctaaagtagagggactagacagactaacataatgaacttccacgcgttgattacccagcttcaataatcaccaactcatggctgatcctctttcttctatagccccgcccactgtccccacccaccctgcagattatttagaaataaatatcattatatcatttgattcatacttcagtatatatttctgaaagataaaacgaatttaaaaaatctttaaaaacctctacaaaatccaaaatagccattattacgtctaagatgattaataaattctcatcagaagtatagtagaggctgtgctttgtggctcacgcctgtattcccagcactttgggagactgagacaggagaatcacttgaggtcaggagtttgagacccatctgggcaagaaagcgagacgcacccctcccaatacccctacgacccatcccccacccaacacacaaatttagctgggcttggtggtgcatgtctgtagtcccagctactcaagatgcggaagtggaaggattgcttgagtccaggagctcaaggctacagtgaaccaagatcatgccactgcactccagcctgagtgacagagcaagactctacgaaaggaaggaaggaaaggaaggaaaggaagggagggaaggaagggaaggaaggaaaggaagggagggaaggaaggaagaaaggaaggaaggaaggggaggtaggaaggaaaaaaggaagggagaggaggaggaggagggagggagggaaaggagggaggaaggaaagatcacagggagggaggaaggaaggaaggaaggaaaaaaatcagtattcaaatattccctgttactgcttttcttaatacatagactaaaaattaaaatttcaatttccccaactgcttttaaaaacattcatatttcactggtgactacaacaaaaatgtataaagccaacaaacaaaaatgtataaatgacaaaaaattaaatctgctctttagaacttgataattcatgagaaaatgaaaatagtttccatcatcctttctcaggctgctgttttttatttgtctaagaagaaaagaaaatatgtcaaagcctatggtagtcactagggctgttcactgatgggcccacttatttatctccagccaatgggaggattgaacttccctggtaccttgaagtttgtgtggtcatatgacttgttctggccaatgagtgtgagtggaagtgatgaaacgtcagttcttaccagaaaatttaaatcgacattaggagaccctccataaccctcttttctttctgctacaagtgacccaaattactccactagccaggatcctggatcaacatgttgtgggagagaaaaaaacaaattgctgttttaagctattgagatttgggggttctttatcatcacagcataacttggcctaccctgacttatagaaagtggctaggcttaagcttgtgatttcagggaagttcaagctaaggctaataaccttttaatgtcagtcctcttgaggaatcatttcattcacctcttatgatattactatattgatccatgctatcattttactagaggagtagaattttaattctgtagtcttcgacattattatgagattaaaacaataattataagagtggcctgccatataaaacaccaaagatatatacaactttaattaaatggacccgaagacgaaacaaaagacgagaccctggcctggaagtcatgtctctgccctgccatggtcttggataggtttcttcatttctgggcctcagttttcttttttataataatgattattattataacagtgacattgttgaatatctgccatttgctaggtaattccatggtactttagtttattcaattcttacaactaatcttcagtagttatttttacccttttttaaaaacgtgaaactgtggaaactgaagtttagacaggctgagtaatttgtcaaaccatagctggaagtggaggagatacttccaaagccagactcaaataaatatttaagatccatttcttgttctaaaatcctatggctattttggtgtaagatgattcacaagaagcaaaattacattgtcaaaatgaaaatcatatttactccaccaaaaagagcagttctcttactggcaatcatattttccagtgtgatagaacacatattttatggagatcaaagactctgctattaatatttccttgcctgcataaactatgaaagggcttcgaagcatcaaacttttatgacagtgcatggtaaccattgttaatgtattgtattattgaaaattgcaaagagagtagattttcagtgttctcaccacaaataagaatgtattagaggtaatgcatatgttaattagctcaatttagccattccacaacatatacatatttcaaaacatcatgtatacaataaatatatacaattattgtttgttaatttaaaaaattagttttaaaaactttaggactgaatacagatgctcaccgtaatgtagactaaaggtgaaacaaaattattccccttgagattttgcacagactatttctttgctaacatttttaagaataattcaaacacttgttaattcatggtcataaagacttctgaccagccatggtgtgtggttttaaaatatcagatttattttatttatttgtttgttttatttttatttttttgagatggagttttgctcttgtcacccaggctggagtgcagtggcacaatctcagctcactgcaacctttgtctcctgggttcaagcgattctcctgcctcagcctctcaagtagctgggattacaggcatgcaccaccacgcccggctaattttgtaatttttttttagtagagacgagatttcactatgttggtcaggctggtcttgaactcctgacctcaggtgatccacccgcctcggcctcccaaagtgttgggattataggcgtgagccactgcacccagcctatcagatttaaaatactaaatttaacttgttaaagtaccagaaattaaagtaataacatttaaaggaagtagaatttaccttctggaaaacactgcacaggtacgtgtgtgcgctagctgtgatgcctgccctcagaccaccctgcagaggccatgcaaaatggccaattctcgattcttcatttagggaactcacaccagacttggcagagagaattgtgtctctcctaccttatatttgtctctgcaattgtcattattttactgttttaattttttcattgtttctggtatttatctgcatcttgaatatgttgatctttgcctttacttactattgctgggaattttacagttacaagcaattaaataatagggagagggagaaacacaaacatccctcaatacattgttcaatggcctttttttcccctgaatggctttccatggctgttagtttccaccaagcaatgcaatattaagtacagttgaatgacgggtgaggcaggcttctttaataatggtgtttaggaacattcagaaactcagggcagcctaaaaatcaactttaaagtactcatcagtactagagaggacaatggtaaggggaggtggaaggaacaagaaaaatactagggtattatttccctccttttaattgaaagactaccaaaccacatgacatttttcaaaagtcacaagattaataattaaatgttgcaggagagaaaaaatcagagtggcgctggagcctattgtggaggagttgaaagggcaggccaagattttgattcatgttaaacttggctgtttgtcccaaaaaacatttctaaagaatgccagaaaaataaatataagcttataaactgtgtcagtcagcttggaaggaaaatattgaacaaacccatcattaattctcacatctaaatccagtatgtttattagtaaaggtatgtatgtgttgtggtagtggtcattgatgagatcttagttcatgtagatttagaaattgcaaaggaatctagttttcctgaggaatatatgaataaggatcttcaaatatgggatccacactgatacagagctcggcccacatgctcagaagctactaccctcatcctgctgcatgaacttgactgaggtctatttgccctaccctaggttaccataatttactactaagttgaacagacttaaaccttaggcttcgtgagctgactttttttaagaataacacccagggaaacctcccaaggaataagggacacaggagacaaaataagcaggttactcttcatcctgaataagacagacaagatgccatattccttcttactcgcttgactgctgtgggcttcagactagatgaaagagacagagaactgaaaataaagaaaaatcagttaaagaacttgaaaaggctgggtaaataaagaaatgagtagaacccagagttgccttcatttaatactcctcctctttcctcctttgattcatttcttcctattctaccatattttgtatatgtctcttatttaccagatttgaagctccctggaggagaaggactatgtcttcgtgatctttatcttttagttctgttcattcatccattcatctatccattcatgtaataagtgttattgagtgcccaatatgtgccaatattgtagaagctcggaattcatcagtgagcaaaacgaatggggggaaagattggtaataacaatacatttaatgagtaagtaaagtatatagtattatagaaagtgataagtgttatggggggaaaatgagtgcaaggtaaggaggattgggtcttgagggtaggtgtaataagctgcagtattaacagtggtgatcagggtatgcttcgccaagaaaatcataactgagccaagactgagaggaagtatgacagtgagcccagcagagaaccagggagaagggggtggggagaaagcacttcaggtggagggctagaggatagaccctggagtagaagcattcctgatatgttccaggaacaaaatggtggtcatttcagctgaaacagaccgagcctggaggaatccaggaggaatggaaagaccggggcaagccagatcaaggaagcttttaccctgagatgggtattcaaatattccctgttattgctttttttaatatacagtctctaaaaattaaaatttcactttccccaactgcttttaaaaacattaagcaggccactgcaggatgtgaacattgagagacgtgacatgtcttatgttttaaatggatcatgctggctgtcaggttgacaatagactataaaagtacaaatttatgtcaaaatataaagcaaagcccaacaaaactcaaaaaaaaaaaaaatcaaagatgagtttatatactgccaggggtggatgtaaacacaccagtgaaaaagttcactgagtaactcatgaattaggaaaagtcagggttttttaagtgtgagaaagagagaagggagtttggaggttatgcggattaagggctggaaagtagtgctctggataggttggaatagtgttgataaaacatgtccctttgttaactggtcagaaaggagtctttggttaggtctaacaagggtctggtatggggtcactcaaagttcacagtccttgatctgcttcagttggttagaaccagttgtggtagagcatagcattccgttttgatatctactatgcaagtgttgtaagtggaaaattttcttttacaggtggaaacagggaaacctgttaggaagctcttgcagaaatccaggcagcggatgacagggctcataccagagtggagtagtgcaggtggtgagaagcagttagatttgggtacatgtggagagagtaaagaatgactcccaggtttttggcctgtgcaactggatggttggagttgccctggagataggaaaggctgtgggtgaagcatgtttgcatgggaagatgtggagttcatgtgagtttaagacacctcattatacacctgagtgggaacagcaatagagacagcgaggtctggctggtgacatgaagtggggacctgaaagtgtatagatggtgttgaacggcaggataccaggtgcattcacctatgcagcaaaggagatagaaccctggaaagcccaacagtttactccctcctagttccagttttaattcatagaaggcattcttgcacacctccttaagtattttgtggaatgaagtggaggtatcaatggatcaaggatcttcgtgcctaatgtggtgttttgaaaagagtgagtgctcactaatagctacttttgacagtctcctatgtcccagacactagtctatatgcttcacaaacctatatgcttaatctccccaaatttatatcataatccccatttttacagattaggaatctgaggccagaaaagtcatttgctcagcatcatatagctagtaaaggcagggatgggatttaagttcaaatttgtctgagtctcttataattctgccttgaatggtaaattactaacctgcatagagagcaaaatgaacagaaagtgaggagtcccaacagcttgtagctcctggcatatatcactgtgcaacagtcttcaatcttgagcctgtatcagaatcacttggatgccttgtttaaacagattgttggacctcaacccagaattcctgattccacaggtctgggatttggcctgctaatttgcacttctaacaggttcccaggtgttgctgctacagctggtctggggatgacaccttgagaaccactggtttagcgagttttccctgactctgccagctaatacctccacctgccaaatggccaggtctctccaatttccaaaagggaaaaagagaaaagttcacaactaatcagaactatttgagagtccttagtgtgatggttccttcaattttaactcctggttctctcctgagacacatgagggttggggagtgggggtagaggatcatagggtgatggtggctccacgccaggttctctctaacacacagtttaccatgctgtctagcaaaacgtctttcactgttagactctcagtggcctcattgtcctttcctgggaggaaagttccatcatcacccctcctgctcctagtgtccctcaggcacaggggagggttcaggtatggtgggccttaaaagcctacccaactattgggagggctcctttaagaacaagaatacaggcttataaatacacaattaggttcagggacttggaaggaacttgtgcaagagagggggccctgcggcttaagcttcattagctgcatgggaaatcgaactctgatcaaacatgtctgtatacgtctaaagatccaattacagacaggtgcaagttatttcccatggagctgctgagcctcaggctaaccaggggatgtggctgattgctgtgtaagagaacctcagcacttcatggttggaaaggcttgtttgtcctgaatctggccatgggggaagggctgctgacttgcagagctagcacgttggaggctaagcaaaagcgctcagttacatatccttgggtttgatctcttccgtgagtcaaaagccttccagaaatctcttgcctcagacattttaaacgccaacttaagagataattattcctatttcattacatcaaaataaaatttgactactcaattttaaggctaatattcaaaaaagtaaaattgcttatgattaattttttgagacggagttttgctcttgtcgagggtatagtgcagtggcgctatcttggctcactgcaacctccacctgccgggttcaagcgtttttcctgcctccggagtagctgggattacaggcatgcactaccacgcccggctaatttttatattttttagtagagacgggttttcaccatgttggccaggctggtctcgaactcctgacctcaggtgatccgcccaccttggcctaccaaagtgctgggattacaggcgtgagccactgcgccctgccctaaaattgctttttaaaatcattaggctaaggtcatatttaaatatatattaatttatgaataaatttaagtgcttgcttgacacaggggactacttcatagagtagattctggagttccttttgtctttctgaaaccttattttcctatctagcttgttctgagacgtactgtgggcagacttggccttacacatatatcgactcactcaacaaatacagctaaggaaagtaaaatgtctctgggctacaagctgggaggaagttactaagatgagtaaagaaggaccccctccaagagcttaaattaagtcttggagacaacagccatgcgcaccaagaagctcaacctaagatgaaaagggcatctaagaggcgcgagatggctcgtgaaggtaacagacgtcttaagaatttttccgggcccagcacagtggctcacgcctgtgatcccagcactctggaaggccgaggaaggcggactgcttgagcccaggagttcgagacctgctcggccaacatagtgagacagcgtttcttaaaagaaaaagaaaaattggcgtggcgtggtggcgggtgcctgtagtcccagaccgcaccactgcactccagcctgggcggcagaaccagaccctgtctcaaaaataaataaataattaaaaaataaagaaaagaaaaaaaagaattcttcctcgagagaggaagccggctactggatattctaaagagcagtctgtttgcccctgccttctccatccagagtcaccgacgctttctgcacacgaggtgttccgcgccaatgtgggcacaagccaaggcaagaggactccatcaagctcctcctgggtaccatgatttggaagacccaaggatgagttcagcgggccaccatcctcaaggaagcaccatcaagaactgagtcaggcccggggtattctcgacgtcaaagcggtcgagaggtgggggtgccaccaggaagagtcactggaacggaccttccgcgctcgtctcgcggtctgtatgcgcactcacacccctggaaggctctaccactgtaggacagagcacggaggattgcccaggcgccggagaagaggttagcgccccgcaactccgcccctgccccgcccacgcaacgcggcggctgcgcggcgaggccgccccgtctccacgtgattgccgacaccgcctccgcgaagcagaagccgccatcataagtcctggcagctggacctgggcctgcctccctccttctcctgcgccaggtagcggtaacgggctggggttgttctgtcctggttctgtctggccgtgaagccgcaggcctccgagagcgggacgaggaggtggggcccagggggctccggggcggacagactgaccgccggacagcccaggtgtcggcacagcgtgggcggtgcccagagccgcgccccgcccctcgcaggccagcgctcagggctcgcgggccgtgcccgtttccagtatggccgcccgccgcgcctgacccgcggcctctccgctccgactgcttgtaggcgatgcccaggcaaagaccgtgactgacactctcgctcacacgcacgcacggacccaggcccacgctcggagatcgagccccgggctcgcaaccgttgtcgctcccggcgccgcggccagagcccggaccacggcttccgcgccgccgccgcctcgccgagaagggccgcgccggacctcgagcgcggcggcccccggccggcagggatggggaagcgggcgggaggaggagcaaccggagccaccaccgccgccgtctccacgtccgccggggccgggctggaacctgcggccgcccgtagcgggggcccgcggagcgcggccgccggcctcctaggagcgctgcacctggtgatgaccctcgtagtggctgcggcgcgggccgagaaggaaggtgggtgtcccccggcggcgtccctgcggcggggctgtcaccccgctctcgcggaggccgggagggctgggccgggaggaagggccgcggccggggctccggcgcaaagttgggcggtcgggtaccgtcccgagccgggacctcgcggcgcccgccgcacggagtggccttcgctctccgtgattccttcccgtgccttcccccgtctcctgtcactgccatttcaaaacttcctgacttctcgtacgttcttgccacttggcccgctaggtaggaggggcatattttttggctttattgcggcgaataggtacattttaggacacttctgttttcttggttgcggttggttgcatgcagacagagcttactttaaaatgtggtaaaaatagcgagacacagcttaaaaaatttcactttgaatttgttcagacatttcttcgaggggaaatcttggtcctgtagcttcctcctttagtgtctctgcgttattgataactttattattagacctaaatacaattccatttaactctttagtaagctgttgaaagcctgtttacatttcttattttaaaatacgtgattcggtgcctttatctttgatgtgaaagcctttaaaaataaacgtgaagttgccagcttgcaagcatttatctataatttacagttaagggctggcccctattttaaaaatctcattagtattgtactgctgcaaaacgggtacttggacagggtcaaaaattattttgtaatcttgaagaccaaatcagtgtaatttcatctacactacctctttttgagccaagggacatgtgaatggtcacagagccttcatgaagaattgactaagtgaatagtttaaaaaaaaaacaaaccacgcaaaacttgttagtttagcattgcacatgaaactgcctgtacaagaaaacaatttcttgccacggtaattttagagttaacattctactttatgactaaagtcacttgctttttattgttgctgaaggtaaaagcaaatacaaaccaaattagtattaaagtgcaaatgtgcttcagtatactgtttcttttatttttgtccacattacattcccttatctaactctctaagcaaccttagtctgagttaacattggtggaaattattcaaagaattgtcgtctatagaaaggattaattgatggaagcaaaattatttccagaataaaatattgccgctttaggactagtcggtcctggggttgtcataatacatcattggccacagatctgcagttagttgagtgttctttcttatgtgtgatcgtggcacctagcattttggcctgtagtgggtgttcagtgaacccaaaatagtgcagtaatttaatggacattttttgggtgggacttcaagtagaccttggtgggtattgtgtccttgtttttctgttcctttgcttaccttgcacagtgccagacacactggcgcttagcctttgagtgaatgactgtcttcatgcgcccttagcacagggaattgaaataatggttgaatctagtaaagcattaagtttgtattttccttctactgctgctgatttttccaacagccattttatatgctaataaaaactttactctgggtaaagttaagtaaacaaaccttttgtttgagaactgtcagcctaaaatatatttgctaatttctcatttgcatagtttatacatgttagtgcacctctctaatacccataaatgtgtgtaaggattggatgaggagaatacttgccagggtgttaagtatgtattaaaggggtggttgaatcagccagtggcctgggtgaatcagatatcctttgtggcccatgcttttctgtatgaacaatttgtgtgtgcggttatccaagatattaatggagatgatgctgatatagaacataggcctctacccatcataaacagatctggttctaatcaaatattctgtgaaggtatctccagaaatggcttctcctttaaaactgatcatattccagtattgtttctgagtaagtaggggaaaagcaatttattttcttacgtgattgtgacactgtgagtctggcatctgatgaggcacaaatacagtatttgtcctaaaaggtactgttgagtttttcagcaagtttgggcagatttctgaagatggctgagttcagtttgatcattcacacccggaggaattttgtgtctattgaagtagcataaactagtttaaaatttcaaagttaagatttacctgcagttttaatgatgattctgcaggtattttgtatgtttgtatttcttttccttcattactgtataatttcactgcaaaatctttaaaagacaataaaactcattgtctcctgaagaaaagctgcagaaataaattacctaatgtagtttttcatgtttggacttgatgttgattttcttgagtcagaagcatggaccattccttgtcttaacatcctatatgacttaactgagctatgggagtgtgctatcactagtccagaggaaaggtacctttgagatggttttggctgtgatgtaaagtttgtaaggactttgaaagagtttccagagatagaagttgttataatcactacaaataactagttctagattggtggcaagattttgtcttgaggctaacatctagatactgagaatagcaaaaatgtgtgtgagttgtgaaaatatatttttaaaatatatagtgaaaatacatgtgtatgtgtatatattaaatgtatacttttagtagtcttttgaattataaagcagcccattatgactggcaaataagaccttttttaaaaaagcattatatatcatgtaatataatttcattgtgaagtgggtttttggaaggcatttattataaatgagaagctatagtttatgtatctagtaaatataaattcgaataagttttcaagaatgtttcaatctatgacaatttaaatttcattgtcacatgttttattaattggcaattaaatggcagggtaacgtttgacagcctttattaggactttaaaaattttttgccagtgtactatagtttcatgcacaaatttttgttttaagctgtatttgtgacataggtgcaaaacacagtacaaaagtatttacaaagcatatgagaaaagtgcataggactaaagaccacaagaaaacagataagaatctaatagttttctaagggtagccaaattgactaggagtgttatttactttttcttaaccaaactatttttaacctacttattactcgataatgttaaaatgtttttgaaagtgattttcttaagagtgagatgtgttaaccctttgtatggggtagagtgggtaccttttaatttagggccttgtaaatagaatgttatttaataagtgcttcactaatgaacgtttgtagcctgcttttactaaaggctgttgcctgatggagcattggagttttgtagttggaaaaagtgtgtccttttttcctcttgctaatgaccattttcctcctccttctaattcttacagtggaccctcatagacatctgccaacaagattgctttgggagtagatgtaaactcatctaattgttactatccagagtagcaataagccaaattactcttggaggaaaataaaatctttgctaggtgcttgatattttaggtgttctctctcttgcctatatgtgactcaagcgctctgattggccttgccagaccaagaggcccttttcctacagctgaattttcccctacggtctcttgtaagcagcatctggcattgtttcggtgactctgtacttctcggttctggttgtgccctagctgacagttgctgctctccaattgcctgttggttgtcttcctccctgtgtgtgtctagctgctggtgcacactgcatgtgtccagggcagaattatcttgcgccacctccagttttcagttttttattaatgctatgattattctgcctgccccactggattcagttttgacccttcaccaagtggcatcagtgcctgttacatcctcttttgatcactctcccactgccttcaccatggggcactgcagcagcctctctcctaccgcctttcgccatttctgttcagtcctgcatgctccctctgaatttgtggtctttgttaatcattcatcattcattttgacacctaattgtgtactgccttgttagctacttaaatgatttcaggggtgtcattcttcacctaggctggaatttctgtagggcagaacctttgtcaacatctgtagtacataaatagcaggcattcagttttgattgaaagtttgcctaaactttcattgtaatataatttcattgtgaagtgggtttttggaaggcatttaatttattataaatgagaagctatagtttatgtatctagtaaatataaattcgaataaattttcaagagtgtttcaacctatgacaatttaaatttcatagtcacatgttctatcaattggcaattaaatggcagagtaacgtttgacagcctttattaggacttttaaaattttttgccagtgtactatagtttcatgcacaaatttttgttttaagctgtatttgtgacgtaggtgcaaaacacagtacaaaactatttacaaagcatatgaaaaaagtgcataggactttttatacctgagaacctgagagtcagaagtacaggtaaaattcagttctggtgcagatgtcatgaggaagtctgctatagtaggacattgagtaacaccagttttttcttccccacatgttgcttttccttgtaactaaaaggagttgtatacacttatctaaaccatcacttttataactttttgattttaagattttcagattctcataaaaccctaatctagagatcatgaaactgaggcttagagaggttaagtaatatacccagcgtgatagggctggtaaatagtggagccaggattccgccctaagacatctgtcccttgagccaaactatgtaaccccaaatgagcacttcaggaattagattttgttatattgtaccaactgcaaaaagaacagacttgacagttcatgcaaaacccatgtattagtattcaagtaaaatgtactttttttttttttcaatcagccgcaagctttcatatcactttctgttgacttgttaacagtttaagtaatcacaggccattctggatcatgaaggttcttaaaaggaaaccagtgagtggataatacagggaaatgaatatttggtattcgaagctactgtctctttgttcttgatgacttagatacctggttgtattgctaaggttaagcaatattgccttctgtagatactgcttagctccagattggtgtgatgagttagtctagacttgtggaatattctcagaagctggccctggactaacaggagctggagataatgcaagggctggtagtggcatttgcctcggcaggcagaaatctctcgcagacttccattagaggtccaagggctccagaagaagttcaaaggtgctttgttcttattagggcattttggaattaggtggtcattagttctcatctgtagttccaaatctgttttgttgttgttgttttttaattcccatgtgattacttttaaaaccacagatggagggtttctagaaagcctttgccatttgcctgattgattttgttgcatacaactctgccgttttagggcagaggtttgatgtttaagaggatcttttagatggtcagtcatgatagagtatgaaacctacgtttttatttattttcatttatttattttctagaaacttggtgaaaaaaacacataacaaaatacttaaccatttttatatgtacagttcagtggtgttaagtgtattcacgttgttgtgtagcagatcttcagaacttcttcacgtaaagctggaagtctatacccattaaacaacttcctatttctctccctacccttaatccccacccccaggctcctggtaaccaccattctactttctgtgtttatgaatttgactactttagatacttcatataagtagaataatgcaggatttgtgacctgcttattttacttagcataatatctgtaaggttaatccatgttgtaggatgtgacagttccttccttttttttttttttgttttgttttttgaaatgatgttttgagaatttatttacaaccattgaacacggatgattttgtaaaactgacaattacaggctccttaaactcacaacatacatatatttcaatatttaaatagcctgttttcttcaaaagtaattttctgctttttcataaaaatataaaaaagacaacatttatagttccttcctttttaaggttgaattatattccattgtatggatataccacattttgtttatccattcatccatccgtggacactaggcttgctcctacctcttggctcttgtgactaatgctgtgaagttgagtatgcaaatatctcttcaagaccctggtttcaactattttgcatatctacccagaagagagatttctggatcatgtgatagttctatatttaattccttaagcaaccaccacatttccatagtggttgcataatctcagaatcccgtgaataatgcacaaggattccaatttctccatgcccttgccaacagttgtttttgttttgttttgttttgatagtggtgtgaggtgctatctcattgtggtattgatttgcatttttctaatgattaatgatattgagcgtcttttcatatccttcttgggcatttgtatatctcctttggagaaatgtctattcacgtcctttgcccacgttatattcaggttttgttgttgttgttgagttataggagttccttatatattctggatattaccccttatcagatgatttgcaactatgttctcccatttggcaggttgccttttcactctgttgatcatattctttgaacaaaagtttttgtttgatatagttacttttgcttttggtgtcatatccaagatatcattgccaaatccaatgtcatgaactttttccctatgctttctcctaggcattttatagttttgggtcttatgtttcggtctttaacccattttgagttaacttttatttatggtgtaagataaagggtataactctattcttttgcatgtggatatccagtttctccagttccatttgttgaagaggctgtcctttcttcactgagtagtctttgtgtccttgtatgaaaattaattggctatatatgcaagggtttatttctggacactttattctgtttaactgctctgtgtgtctgtctttatgccagtaccagactattttgaatactatagctttgtaatatgttttgaaataaggaaatgtgagacctctaactgtcttcttccttttcaagattattttggctatttggggtcccttgagattctgtatgaattttaggatgcacttttctacttgccttgggattttgggattttgatagtgattgtgttgaacctatagatcacattgggtagtattgatatcttaacagtattttaacccataaacttgggatgtctttccatttatttgtgtctaattttttcagcagtgttttgtagttttcagtgtacaaatctttcacttccttggttaggtttattcctaagtattttattctttttgatgtcattgtaaataaaacatgcatttttgaactaatgattttaatcagtgtatcattaatagttgtaaatacatagtttttagtaaacactccatatttgaaacaagaaaaaatgctgcgtacttaaggtatttcgttaattacctgcctataaaatgaaagacatttaagccctcgttagttctaacagtttgtgacttttttttgtttttgtttttttgtttttttgagacagagactcactctgttgccaggctggagtacagtggtgcgatctcagcttactgcagcctctgtctcccgggttcaagcgattctcctgcctcagcctcctgagtagctgggactacaggtgtgtgccaccacgctcagctaatttttgtatttttagtagatgaggtttcacggccaggatggtctcgatctcttgacctcatgatccacctgacttggcctcccaaagtgctgggattacaggcatgagccactgtgcctggccaatttgtgactattttttaaatcagttataatgattgcaaagtgatatggcagtttggttcttgaaagctgattttttctgtatagttctagtattacatttggatcaaaggatgtgctagttaaaaactgtcttggcagtgaagtttgagaaatagcatagccaactttatggattcaggttaattagtggtttgtattcatggtatggcaagggccctacatggattttctttttagagcatgattaaactgggagcagaagattttctaggcaattattcatggtacaaaggtgctctgtgaaacctaactgtatttataaagatctttgagatagtttatgtttgtcattccaaaagttattaggtagagcagtgtacaagagagggtagtgtgctttcaaacctttgggcgaaattggaccacctttagaaatgcttctatggattggtgacatgggctcatctgaagtattgcttcttgattagcaaatgggaaatgaagtagtggtcagcactaccaagaggtaatgtctctttcagaatgggtgcagcagtggttatgtttcagatataggggagttcttaggtatttaggggtccacctcattattctgggtggcttctgttgagttatggctgggcatgaaaataggttactgagaattgttttgaagagagatgtaggaaggaaaaaacaggcaaggaattaggtccagttttattggaatcctagaaattcttgtttaaattgattgtaagaataaaacagattataaaatgcagattaataaatggtgaaaaactgtaaccagtcaagaactaacatgagtcatccatgttttggtctctgttccttcctcatctctcttccctctcctcactcttttcctgcccctattccccatttaaaaaaatagatactgccaatagttttcttcaaaggcaatcaattcacatctcaaccatactgtatgcatgtgcttacttccccacactggctgttactcttttcttaccagtctaccaataaagttgtcacgttgttttaatttattttaaaacaattactactaagactgaatacttttatacatttgcgaccatttgtatttgtgtttgatcagtcttttgtcagttttcccattgatgtttgaatttttctttttgacttagtcttttgactttaaggatttaatatttttctgagtttctatttgcatttgaattttttattttctattatttttatacctgtcaggcaactctcttttttttttttaaatggtttctgcctttctgataccttaacacccctaaagattatatattcaccaatattttatgtccgtgcttccatctttaaatgcaaatctctatttcttcagtccgttggcatcaggtagagaatctgtttgtcctcaaatcattagtcagttgccttaacaccacttattgaattatatacagtatttcctttcattcaaattctgttatgtactgggatctatttcttgattttttttttcccagggtatttttttttctcatgtatatgtctatgcatttgtacatttctgttttaactttattttaggtaatatagcttatttatacatttcattagctggcttggcaggtcatcccctctccctaaatgattattcttcaaaaagcagtttcttatctatcttgtttttattccctatgaatcctcaaatcattttgtaaagaaaatttaaagttgctatttgctttttggttacaattacattaaaacgttagataaatttggaatttgacatctttatagggttttccattttgtttgtctttctcctaagtctgtgtgtgtgtgtatatatatatatatgtattaagtaaaactgtatgaaattataatttttgtcagtccaacataattaacaacttattcaatctaatattaatatgtatgtttttatgcattattgctttggctagagcttcagaacattgttaaataagagtgatgaaaaagcaggcatccttatgtttttctgtttttttaagagaaaaataccttaagtgtttcattgtgtagtatgattggggtagttggttgaagttagatgttcttaataataggaaatttcttatatttttaaagagttttagttttaagagttattagggacagctactacattttatcccatggagttattttatgacctttttaccttaagctgtaggagcagtcctcttagctgcactgaactctcttggtgaatttatacccatgtctgttttccctctagtaaactcgtccagggatacccattggacttgggctgcctgcagctgccaggctatactcacacacttccacatttgctccatttagttaatgtgcatatttttatattgtggttttgtttttaactaaaactctttttaaaaagctattatatcgatatgatccctcatgagtattgatgtatcaatatatagtaattattatagtaatatatcattatatataatatatattaataatccctcatgaatagattaatgccctccccagggggatggggaactaagttctcacatttaatttccaagagagttcacctgagacctggtattaaaatgagcctgtcaccaccccccttgccgccatgtgatctgcacactcctttgccttctaggagtggaagcagcctgaggccctcagcagaagcagatgttggtaccacacttcctgtacagcctgcagaaccatgagtcaagtaaacctcttttctttataaattacccagcctccagtactcctttaaagcaactcaaatggactgagacatcagtttgctgtcaattaatttgatatttaaaaaaaaaataccaagaaaacttcttatggaattaggaaagttgctgttaaattttctatgaaaaaatgaaaatgtagaaatactgggaaaattctggaaaagttatgaggaatgactagcacaagcagttattaaaacttgctcttaaactattatgtaattggtataattagaataagtactggtatataaatagacaaattaatggaatagaatagaaattctagtaatagacctaagtatatatggtttatgttaacctacttttcttctgggagtctggaactttggtatgtgttaggcagaggggtaccgtgtggctagccccaagtaaaaaccttgggactctgtgttagtttcctattgtgcctgtagctaattatcacaagttgagtgggttaaaacacaagtctattctcttatcattccaaagggcagaagtctaaagtcagggtgtgtggctgactgccacagttatggtttgagacaatcattacagcagttaactcctgttattgcttgagactgtcattactgcagttactactggagaccatcattacaagactgaacgaagggacgaacatagaaatgaaaaaagacaaaagaaactgttttaaggaaaggcaacatggggagaagaggagagctccctgcttctagtgatcaaaggcagcccccttgagcttctacagtcctttcgtatttattgggtaaagagcaaggaggaggaggtaaccattggtcagctgcttaattgatcacaggttcatgttgttactgacaggcttcagttatgcctaatcatgagaaacatttgtgcagcctccatctcctttttgtttttaaattaattgagcaagacaattgcagattatgcagcccttagtggcgcctagacaggaacttgaagggactatcagggacaaaaagggacctgaagagaactgaagagacccgaagagacctgaaaaactagttcaggccatgatgggaagagggggtcggacatgtctcattataccctcctccctttggaattcaggcaccacttgtagctgactgtcactgctactacttgagactgtcactacagcagtttctactgttactgtctgagaccgtcattatgagactgaacgaaggcacaaacgtagaaatgataacaaaaaacaaaagtaatttttaaggaaaggctagcatggggaagaagaagagagaagaaaagaatgaaagggctccctgcttctagtgagcaaaggcaacccctgagcttctacagcccttttgtatttattgggtaacaagagcatggaggaggaggtaacgattggttggctgcttaattgatcacaggttcatattattactaacaggcttcagttgtacctaattacaagaaacatttgtgtggcctccaacaagggtgttggggctgtgctctttctgtaggcttcaggggagaatctttttctgtcttttttagcttctagaggcttcctgaattccttggttcatggcctctgacatcacccttttcctaatccaaacatcttgcatatcacattctgttcctctgagtgtgattattaatatatttggcccatctgactaatctgggataatctccccatctcaaaatccttaatttaatcacatctacaaaattccttttgccatgtaaggtaacattcacagcttcctgggattaggacatggacattttggggagtcattattcagcctaccacagacattgagtttctaatgagctttcttgatagatgtgacaccaaaagcacaaacaacaaaaggggagaaaatagataaagtagacatcaaaatttgaaagttttgtgctttaaaaagccctataaagaaagcagaaaacccacagaatggaagaaaaattttcgcaaatcatgtatctgataaagggatatgtatctagaatgtataaagaactcataacctcagttacaacagacagtgcaattaaaaaatgggcaggggatctgaataggcatttctcctaataaagatatataataaacgtatgaaaagatgctctacatcattagctatcagagaaatacaaatgaaaaccaaaatgagattccatttcacacccaccaatatggctacgatcaaacagatggataataaatgttggcaagggtgcggagacattggaatgtcttgttgctttatgggtaacataagatggtgcagctgctttggaaaacagtttggtaggtcctgaaaatacggagttactgtatgacccacagttatgctccttagtatatactccaaagaaacgaaaacacaaaaacttgcacataaaaacttgtgcaggaacattcatagcagcattatttatagtagccaaaaagtggaaacaactgaaatgtttgaagaatagatcaaatggaatattattcagccatagaaatgagtgaagtattattatgaatgcttgttacaacacaggtgaaccttgaaaacattgtgataagtgaacaaagccactcacaaaagaccatataagaccatagaagccatttatatgaaatgtccagaataggcaaatccacagagacaaaatagataacatggttgtctagaactatggagagcagtgtagggagtgactgatgatgggtacaagggtttttctttgggatggtggttgaacaactctgaatacactgaaaactatgcattatatacttaaaatgggagctgttattaaacaagttttattaaaaattgataggcttttcatctaagggggaaaaaacctaaatgagataccatttctcacttatttgggtggcaaagttctaaaagcttcacaacactttcgatgagactgcaggaaagcacgtgttctcacaccttgttagttggaatgcaaaaaagatacaaccttaatggaaagaagtttggcacagtgtctaacaaaattacatatatgttacggttttcacctagcaatctcatttttaggaattggctgttttaacaatacaaatacatatatataaggttattcatagcatgatgatttgtgaatgaaaactattggaaatgacctaaatgcccctatatagttgaataaattgttacatccacataatggatcattatgcaccttaaaaaagaatgaggaaaacctctagaatatgctttttagtgatttccaaagtatattgataaatgaaagcagcaaggttataaagagtgtatgtgtgtggatagctaccttaacagatttttaaacttttttttttttttttttttttttttttttttttttttggggggggagttttgggagtttcaccacatgtttaaatttgaataacccctcccatagtcaggatacaaaacatttttattaccctccaaaacctgggctttctccatataggccacttttgacttttgtaaaccactgatctgttatgggcaactgaaattttctttttttgaaaatggcatataaatgaaattagggggtataattggaaattgttgggtttaaaaactggtttattttactcagcacaaaacacttgaaattcttccaacttgggggtctggatagttagcctttaatggggagtagtattcggtgggttgaatatcccaggatttattggtccatcnnnnnnnnnnnnnnnnnnnntatgccccttaaaaaaaaatgagggaaacccctaaaatatgctttttagtgatttccaaagttttttgataaattaaagcagcaaggttataaaaagggtatgtgtgtggataactcccttaacaaatttttaaaccttttttttttttttttttttttttttttttttttttctggtgtgtagttctgtgagtttcagcacatgtatagatttgaataaccactaccatagtcaggatacagaacattttcattaccctccaaaacctgtgctatctccatatagtccacttctgactcttgtcaaccactgatctgttatgtgtcactgtaattttctctttttgagaatgtcatataaatgaaattagtgtgtataatttgagattgtatggttttaagactggtttattttactcagcacaagacacttgagattcttccaacttgtgtgtcttgatagttagtctctaatgttgagtagtattctgttgtatgaatataccatgatttatttgttcatctgttgaaattttgggttgtttgcagtttggggctgttataaataaagccgctttgaacattcatgtgtaagtctttgtatgcacatgtattttattttctctcaggtaagtacatatgagtggaatgtctggatcctatggtagctgtatgtttaagaaactgctaacctgttttccaaagcggctgtaccattttatattcccataagaagtgtatgagagttccatttcctccatatgcttgccagtgcttggtatggtcagtcctttaattttagccatcttaacaggtgtgtagtggtacaggcatttctcattttattgcactttgcctccttcacagccaatatgctgtttacaaatggaaggtttgtggcaatcctgcctgacacaaatctattagcaccatttttccaatagcatatgctcacttctatttttatgtcacattttggtaagtctcacaatatttcaggctttttcagtattaaatctgtaatggtaatctgcaatcagtgatctttgatgtgattgtgtaattgttttgggatgcccacaaaccacacccatatgacactgcaggcttaactgataaatgcctgtgttctgactgctccaactggctgttcccccacttctcgcccctcctcaggctgtcgttttctctgagacaacaatattgaaattaggacaattagtagtactaaatagcatctaagtgttcaagtgaaaggaagagtcacacctctcccttataaatcaaaagctagatatgattaagcttagcgaggagagcatgtcaaagctgagataggccaaaagctaggcctctcgtaccaaacagccaagttgtgaatgcaaaggagaagttctttaaggaagttaaaagtgctactctggtgaacaaatgaatgataagaaagcaaaacagccttattgctgataggagtaagctttagtgttcaggatagaagatcagaccagccacaagcattctattaggtcagagtttaatccagagcaaggcccctctcttctcttcagttctatgaagactgagagaggggaagaagctgcagaagaacagttggcagccaggagaggttggttcatgaggcttaaggaaagaagacagtttcatcacataaagtgcaaggtgaagtggttaagtgccgatgtacaagttgcagcaagttttccagaagatctggctaagatcattgataaacgtggccacgctaaacaacagattttccatgtagatgaaacagccttcttttggaagatgccatcttggtctctcatagctagagaggagaagtcagtgcctagcgtcaaagcttcgaaggacaggctgactctcttgttaggaactaatgaagctggtaactttaagttgaagccaatgctcatctgtcatgctgaaaaaattctagggaccttaagaattatgctaaatctactctgcctgtgctttataactggaacaagaaagcctgaatgacagcacatctgtttataatgtggtttactgaatattttaagcccactgttgagacctactgctcggaaaaaatattactttccaaatattactgcttgttaaaaaggcaactggtcacccaggagcactgatggagatgtacaaggagctgcatgttgttttcgtgcctgctaacacagcatccattctgcagccaaggatcaagaagtaatttcaagtttcatgtcttattttaaaaatacattttttaaggctatagctgccacagagactgagtcctcagttggatctgggcaaagtccattgaaaacctcctggaaaggatttgccattctagatgccattaagaatatttgtgattcataggaggaggtcagaatatcaacaagagtttggaagaagttgcttccaaccttcatggatgactttgaggagttcaagatgtcagtagaggaagtgactgcagatacagtggaaatagcaagagaactaggattagaagtgaagcttgggctgggtatggtagccctttcagaggcctaggcgggaggaatatggagcccaggagttcaaggacctcctgagcactgtggcaaaaccctgtctctacaaaaactacaaaaattagctaggtgtggtggctctcacctgttgtcccagctactcaggaggctgtggtgggaggattgttagagcccaggaagtcaaggctgcagtaagcactccagcctgggcaacagagtggctggcatcctgaagatgtaactgaattgctgcagtgttacgataaaacttgaacaaatgaagagttgcttcttatagatgaagtgatttcttgagatgaaatctgctcctggtgaagatgctgtgaacattgttgaaatggcagcaaaggattcagggtattatcaacttagtcgataaagtagtagcagggttagagaagattgactccagttttgaaataagttcttctgtgggtaaaatgctgtcaaacagcattgcatgctacagagaaatctttcatgaaatggcagcaaacttcattgctgttttttattattattatttattattatttttttccccaagaccgagtcttgctctgtcacccaggctggagtgcagtggcgcagtctcggctcactgcaacctccacctcccgggttcaagcagttcttctgccatgacctcccgagtagctgggattgcaggcgccccccaccacacctggctaatttttgtatttttaatagagacgggggtttcactatgttggccaggttggtctcgaactcctgacctcatgatccgcctgcctctgcctcccaaagtgctgggattataggcatgagccaccacgcctggcccattgctgtttcaagaaattgccacagccaccccacccttcagcaaccattatcctgatcctgatcaaccttgaggcaagactctccactagccaaaagattatgacttgctgaaggttcagataattgttaggattttttagcaataaagtatttttaagttaagatatatactttcttagatacaatgctattgcgctcttaatagattacaatacagtgtaaatgtagcttttataagcactgggaaatcaagaaaacttacctgacttgctttattgtgtgatataggttttattgtggtggtctggaaccaaacctggcaatatctctgaggcattcctgcatttcattgtaattttaattgtatttctctggtgaataatgatgttgagcatcttttcatgtgcttatttgccatccatatatctcatttggtaaagtgtcttttcacatcttttgcccatgttttattaggctattttcttatttttgagatttgagagttctttatatgttctgggtaccagtattctggagatacatatttacaaggattccttccaagtctgaggtttgtgtttttattctcataacagtcttttgaagagcagaagtttttaattgattgaatcaactttaccaatttgctcttttatagatcatgtttttggtatcgtatctaagaaatctctgcctaatgcaaggtcacaaagattttctcctgtattcttttctggaagttttatagtggtaggtctttcatttagatctgtgattgattttgagttcattttacatatgatatgagttttgtacccaagttcttttttttttttttttttgcatataaataaccagttcttctagtgtctattaaaaagtcaattaaaaagactactacccttttcccactgtattgtgcttgtacttgttgaaaagcaattgcatgtacatgtgtgagtttatttctggttgtctgtctctcttttgttctgttaatctatttttctgccttgatgccagtaccacactgtcttgactgcagctgtattatagttaccgaaacagtgtcagttcaccaactttgttctgtttcagagttttgcctattcaagatccttcacatttcattatgaattttagaatcagcttatcaatttgtacaacagagccttcttgggtattgattgggactgtgttgaatctatagatgaatttgtggggggaactgacttcttaacagtatttagttttctgacacatgaacagggatattttcaccatttatttaggtctttaatgtagttttcagtataaaatttttaaagtatcttttgtcatatttatctctaagtatttcatatttttgatactagtttattaataaatgatatttttttaaaatctcaatttctggttcattgctagtatatagaagtaaattttatgttgatcttgtattctgtaatcttgctaaactgacttaatagttctaatagcttttctgtagattgcattggactttttacgtagatgatcatgtctgcaaatacgtttttttccagtctggataccttctgttttgcttacctgattgtactgcttatgacctccagtgcaatgttgaatagaagtagtaaaagtggacatctctgtcttgttcataatcttaggggggaagcattcagtcttccaccattaagtatgctgttagccataggtttttcatagatgccctttcccaggttgaggaggttcttttatgtcttgtttgaagagagtttttaacaggaatggatatttatcaaatgccttgtctgtatcatggatttttttggttaacatgatgaatgactaaccttgcatttttttcttggtcatgataggtattatgcaatttattttaaagttttgtttgtttgtttgtttgctaagacttagaatttttgtatctttggtcattaggaatattggtctttttttttttttttcttgtaataccttccctttcagtattagagtaatgctggtctcataaaatcagttgagatgtgtttttcctttttaattttttggaagaatctgtataaaactggtgttatttcttccataaatatgtggtaagaattaccattgaagccatctaggcttggagtttactttatggggatttttttaaccacaatttcaatttttaagaagcagggctcttcaggttatctatttcttcctgagtgaactttggtaattaatatctttcaaagaatttgttcatttcatctaagttgtcaaattaattggcaaagttgttcataatgttcccttactatcttttgaatatttgtagcaactgtaatgatgacacttctcttattcctgaaacttataatttgtgttttctgtcgtttttttcttgatcagactggctacaagtttattaattttaatctcacaaaaagcatcttttggctttattattctctgtatatgtttgtatttgtctcactttttctgtttcattgactttttcacttgaattttatttctcttttttttttctttgcttacttagagtgtaatttttcctttattttctagtttcttaaggtggatactgaggtttttgatttgaggtctttgggtatttatcaaagatctttttgttattgatacataatttaattccattctggccagagaccatacttggtatgacattagttcttttgagacttgttttgtgactttgaatataggctatcttggtgaatgtgtgcatttgagaagaatatgtcttctgctgttgttggagtactctgtcaatgtcagtcaggttggttgtagtgctgttcaagttcaccattttcttgctgattttttgcctgctttattcatcaattattgagaaacacatatctgtattccacctggtatcatttccttctgcctgaaggatttttttgtagtgtggatctgctagtaatgaattctttcaggttttatatctctgaaaatgtcttcattttgcctttgttctcagatacttttatttgctatagaattacaggtcgacatgtttttttttttctttttcttttagtctttaaagagatactgtcttcccacttgcattgttttccagaagaaatttgatgtcatccttatctttgttcctctgtatataacatgtctttttttttctcttgatacttttaagattttttttgtaaatctggtttgaaataatttgattatctcttggtgtagtttttttcatgtttgttgagctcagggtttgttgagcttcttggatctctggatttatagttttcattaagtttgggacatttttgcttactatttctttaaacatttttcctgtcctcctcctcctcctcctcctcccaaccccattttgaggattccagttctgcaggcattagacagcttgaagttgatcccacagcacattgcactgtttaggttttttagatcttttcctgcgtgttccattttggatgggtctactgctatgccttcaagttccctaattttttcttttgcatgtctaatccacccttaatcccatccatcacatttttttcatctcacaaattgtggtttcatctctggaagtataatttgtctttgtatcttccatctctctacttaactttttgaacatatggaacacatttataatacctgttttattgtcttgtctgctaacttctgtgccagttctaggttggtttcaatggattattctcgtattgggtcatgtttttctgtctcttgtgtgtgcctgataatctttgattggatgccagatattgcaaattttacgttgttgggtgctgctatttttgtattcccataaatattcttgagctttgttttaagatgcagttaagttacttgacagtttgatattctgggatgtcttgcttttaagatgtgttaagtgggtctggaacattgttcagttttggactgattattccccacagctgaggtaaggccctcctgagcactctgtccagtatgtcatgagttctggatttttttccagttggtataaataggtactgtttctgaccctgtttgaatggtgggcattgttcctctaatccttttggatggttccttccccagcgttggggagttacctcacacaaatgcactgatcagtacttcaccgaggactcaatggggaccctctgtagttctccagggttctctatgcagctcactccattttggtattcttttctatgaactctaattgccttggtttcctcggactctcagctttgtctcatcaatttggaaaatccaccaagctctaccactgtttcccctccctgcactgtggcctagtaactcccttgaggcagtaagctgggccaatcatagggcttaccttgtttgtttcccatgtccttcgttgactgatgtttagggtctgaaaatgatcatttaattaatgcagttcgtgtgagtttctggttgcttcaggatgggagggtacatcatgcccagaagtagaagttcatatgtctgcatcagttattattctacagtgtaactggcattgttattttcagatgttattcctaaacctcttggtacagaaaatttttggtaattaatgtgagatagtatggtgtattagtttccctttgctgttactgtaacaaataaccacaaatttagtggcttaaaaacaacacaactttattattttatggttctggagatcagaagtccgtatgtagtgagtctcacaggctaaaatcaagatgtttgtaggcacctactctatacccacaaaattaaaaaagattttttttaatatgtgtttgtaggactgtatttctttctgaaggccctaggggagaatttgttggcttgagttttccagcttctagaggccacctacattccttggcttgtagccccttcccctgccttcaaagccagcagcattgggccgagtcctccttatgtgccttctctctgggtcaccctcttctgcctccctcttccacttttaaggacattgggcccacctaggtaacccagaataacctccctattttaacatcagctgattagagccttaattgcatctgggagcttaattcccctttgccatgtgatttggcatattcacaagatcccgaggttaggatgtgggcgtcttggagtgggctgatgactattattttgcccaccacagattgatggtttttagaatggtctctgcctaagactgcctgcctgcctgcctgcctgcccgcctgcctgcccgccttccctccctcccgcccgccttccctccctcccctccctccctccctcccctttctttcctttctttcctttttcttttctttcttttttaacaggggatctcattctgtcacccaggtgggagtagtgcagtttctggggggtcttgcttttaagatgtgttaggtgggcctggaacattgttcagttttggactgattattccccacagctgaggtaaggccctcctgagcagtctctctggtatgtcatgagttctggatttttccagttggcagaaataggcactgtttctgaccttgtgtttctgtttctgaaatggcagatctcggctcactgcagccttcacctcccaggttcaagggattctcctgcctcagcctcccgagtagctgggattacaggcatgtggcaccactcccggctaatttttgtagttttagtagagatggggtttcaccatgttggccatgctggtctcaaactcctgacctcaagtgatccacccagcttggcctctcaaagtgctgggattataggtgtgagccactgtgcccgctcctttcttttgatgacagtgaagaattgtctatataggattttattttattttgcttatttttttaagacagggtcttgctctgtcacccaggctggaatgtagtggtgtgatggcagctcactgcagcctcgacctctggggctcaagcaatcctcctgcctcagccccctgagtagctgggactataggcatgcaccaccatgcccagctaattaggattttctttttaacctacacacagtaagacattattagaaacaatgagactacaaacctatactttaaaaatgtgttggttatatatagcctgtctgtcatacatagcatttagaagtagcttattttaatttcaggtatgattcagaaaactttatggattatttcacaaagttttgatttgagaatttctcagcccattgcatttggcaacgtatagaaactttcaagcttgggaaattgattgatagccacaaatgtaattttagatcagtatcaactatcttatatttcagtattttttttcttttaaaattgaagaatggtatattttccccccttcctccacttatcacagctaatgccttatgttctttgttgcttttgtcacgtggaacacctccttgtgtgctattttcctgtcaggacttcagtgtgtcatcccccacattgtcagcaatttcagtgatctctgaaaaagcccaggattttctccctgacctttacccagtgccctttgtaaagggttatgtatacctgatttgatggaataatttatgtatagcagctctgagctgaagttagcacttttgcttccataactgtcttcatattgtatttgactcccatcttcttcatatgtttaaataattattgatagaattctaaagtagtagtttatttaagccagaagttaatgtgcaaggtgaataataattttaatcattctttatactccccccaccataggctacattaaaaacaaacccggcttttatttgtccaagaatggttgagtgtcagtaggtcagtagagccagttccagagcacatagtcaagccagcaggtatttgtaataccttctcttctgctgcgttctgcttgcttctacttgcacactcctgggtaaaagtgaatgagatatgtccagcatggcagaccaccagaagttggccatagcactcagcactttgtccttgcttcaggaataggcccagatggttactcttctctggccacaatcctgggaccagaagcccagtcagcagagcacctgctcttccaccaggctggtttgtgcctggagtgagtggtgaatagatgaggtcaaggctttgcaaatggatggcttttcttcacgtattggtttatcatttacttgttgtgtgtgtccttgggcaaattatttgtggacctttctcaactgtacagtgggcataaacatgcttaatagagttgctaggcactttgccataggtcttgaaatgttagttttcagatatgtttgcagattaggcgtgctatcttttgtctcctctctctgtactgtttcttttggcctatgtctctatttacctcctcccgcaccttgcctccagtgaaagaaaccaggcatggagcatttgtctcttggatcagccttgatacccttatgctccctactgagcagttccttggggccaaggggagtctaaggccatccccaaaagaggtagccatttctttaaggtactgtgttttatttattcaaattttgcattccgtttcagtatccatgctggttccagtagaaaaacagattttcccaagtggatacaccttaagatgtgtctcatgctttgtacttagggctcacaatagcacgtttctggaaacatttctgtgtttcagcagtactataacagtcattcttcatcaacaaggagaatggaatggaatggaatgttgccagggtcttggttcacagaggtagactaactttgaccttcctgggaccctgaacaactccacatcagacagatcgttgtgaaaggcactgagtaacatttagataagtggatgattttgcattttttacagtaacatcagaaagtccagtgttgtatgaaacactgcttattaataaagtaagagcatgtggttagatatcagctacttgtaggagaatatgcgtggctttcagtttcatagttctattcctgcagatttttattgcatcaacttgttttatttgagcagtttgtgtacagtgatgtatggaataatcttcaccaaatagtgtgtagatatgtttttgactcatagcagaataagtactctaaggccttagaatagtagcctgggaagacaaatgttagcacagaaagatacatcattcttagatagccaagaagacctgcaggtgtcattaattagcatctgaaaaggaaatattttggaaaacataaataatacaggcagttaggtgtctgcagccagagagttagagaaggaaagaagtaacagactaatggaggggagttgtcagggaaggaggtgttggggcagaagggcccaaacatggggagcttggtggagggcctggaagaaactggtgattaaagcaacaattgtctgtctaagcacacacacccttaccctgcccctatcattaggcggctggccttatgatatgtactgtgtacagggtaacttctcttttgtacaattgaagataaaaggcttaatttatacatgtctagtggtcataatacatcaacaaattgctcttaaatgagttagtttgtcagctgaattaactaacataaatgttgtcatatccttttccttttttttttttttgaaacagagtctgtctctgtcacccatactcaagtgcagtgagtggcacaattatggctcactgcagcctcgatctcctaggctcatgtgatcctcccatcttagcctcccaagtagctaagactagaggtgcgcctccaggcccagctaattttttttttctttagtagagatgaggtttcactctgttgcccaggctggtctcgaactccagacctctaaccatcctcccactttggcctcccaaggtgctgggattacaggcaagaaccagtgcgcctgcccgatatccttattctgatgggaaggatgtgccttagcaaactggttcaaatgagaagttggggaaggagtataatcttctggataatgggagccaggaaacttgccaggtctcgtcttcactacgcacagatgagtgggagatgttgggagtcactcttgctttgtgcaggcttccctacaaacatgtcagcactgcttggcatacttcctgaaacttatgtttttgtctgaacattgcccctccaaagggagaactcattttccgagaccctactgcagggagataggagtgcccactgtgttgtctgaaatgtgtgtggtacacagcaagtgctcagtaagtctcaattcagttgaaagttgaattacacactgacaggcaggttcatgactattcccatgtttacgtccgaagttcatgttggtgtctcaaagtgttaacacttaaaatattaaaacaccacattgagatatacataatatataatatatatataataaaggaaacatagaccctctgcgcccttatctggtagtcactcctcggttcttatctggtcactaggctagacagaacaccagcaaattaattcgttaatttttattcagtaggtgccatgtcttaggctgggtgtagaaagataatgacacaattctggctttgcaagagctttcagtgtggtggagtgaacaggcctacagatggatgctgagttataagtggttgccaggataggtcgggtgctggggacaggacttagtgtactagggcattacttagaataagtaactcattttgaggtcttaggcagtaagacattatagccttgttatgtgtctgtgtctcagagttctgagatttttcttctgtgcctcccaccttaaaaaacctctccaaaaaaaaaaacaacctaaaaaaagtggcgtaagacatcccaacaggatgtgttacatgggaagacaacatggtatgataagaagagcatcgaggctctagtgcttactagctctgtgaccttgtacaagttacttatccctgagagtctgtttcctcttagactaagtgggaataaaagtattctgtggaatgttgaagaggttaaacttttggtttgaggatgcttaatctatttagcttcatcttctctccccccactatcaaccctcttgaaaaattttccattgcaccgttcgaattagttgagtatacagttttttattataagcagtttgttacttattaaatttcttatttccatgtgatctttatactcttttttttttctctttcctttctgacaatttgtctgtacccagggaatttaaataaataaacatttcattttgtagtcacatatgaataaatttacacactgtactgttttatgttacacttcctgttttctgtcagtgtgcatctttcatgcaaccagtatatttttcagtacactgctgggtccttggatatgtttatgagtaagatagtaattagcttccaagaatttttttgttagagacaggcataaacaattacagtgtaagattaaaggtacatattaatatgtgtgtgccacaggagagagctaggttgactgtatacacagacctgtgtatcagtcagcttatgaaattagagaggacagttctaatggggcattaggtctggatctgagtaactcccttttatggtgagtcaaaacaatactccataagttccatctgactcaccgcccccatctaagaagtgtgccgtttgtttgtttgtttgtttgtttgttttaggtggtgggcaggtgtggttgaattcacacctgtgaacacccctggaacaagtttggtcaaagcaagggcttgtcttcgtaagtgattagtcttgtcatcttatatgagggacctgcctggctacctttctcagtggtgtagagagtaaacagactgctgacttggaatatgggcttgactgtgaccttgagcaagttaactagtcctcatgtgtcagcttcctaatttgtttaatggggataataggaatacctgtcttctagggttggtgtgagtattgaatcatctgtagggcttggtatgtagtaagtgctggattagtgctagctcttgttgcatattcatgttatgtttgactctggactacttgtgtaatcccaggtgagccaacttgaagctattttcagttggaccagaccaactccttagtctgaaggtaatccatgtagtcagctcaacaaacatttattgagggccactgtgtcagacactggattggtcgttggaacctaagagatgaagaaggggtgattcctggcctcaagtagtttataccttttatttattgtgttctctttagtttctcaaaatacttttaagatcaagacattcaaagaattaagatttgaagagtggaagaaattttaaaaaattaggaaagggttcttttaaagtaatgtattaggtaatttagggagaaattgtcccttccagactctgttaaccacccggaaagattttgtctgagtcgaatgccagacaccttgctggtttaactactgctaagttatgttgcagtgagcagagaacagccgatttaccctgtgaggcttacatgttcagtgtatgcattgtcagctctagtaattattctaacatactagatattcatgatagaaatttgttttatgacaagggaaaaatatacccctgtcaaaatgatagcaaataaatttgataattttgcaatttaagtttttttttaaaaaattgcttttgttcaatttttttgtttctaggctttgcttactttctcttttactgaattatccttgcattactgttctttttctactcaaatttttagctctagcaggaaaagccaccctaggaaaattgactaatgccatctagttctacctttatgtgaatttcagggttacatttaaatcacttctccatgggcaggcaaaagaaaggtagaaaatagcttttgaagttagcctgtctaggagtaggtaattttacacaatctaaattcacaggagaatttcttcagatttttaggagcagtaattttcattacacattccctaatttcattaggaaatttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttttgtatttttagtagagacggggtttcaccgttttagccgggatggtctcgatctcctgacctcgtgatccgcccgcctcggcctcccaaagtgctgggattacaggcgtgagccaccgcgcccggccaggaaatttttaagtaatctgtgctgtttgtgagattagatgaattggtgcccagccatggggcttgtcacagccatccagattcatcattcctggtgtccacttggtgcttagcagcgtggcccttggtagtaagtggtagctattatgtgccaggtaatctatgcagtagtgcctgttttaaaaatgttggagaaaccagccccacaccacctggcgggtaccccgagtccagcggagacaaaggagttagaaagagacagaataagagtttaaaaggtgggtccaggggaccagagtgtcagaggcttgctcacagcccggaactctcagcctccacccaatttattggtttacaagctctttgttcttagggtagatgggaggggtacgaagcgatgaggaaaagaattaatcggtgaaggagaactcgtcagtcattcaataagatatatagcagtggcggtttctgtgaatttccccaagcaaaggcgtgtgtctaaacggcttaagatctttaacttaccgggactgaaatgggtgggagtgggtttcaagaggaaccaagatgtttgattatactccactgtttcaagggagtgttatttccccgagcaacctgtggcatgccgcggagctcttacgctcttggggcataaagacatgaaggcaataaggagacttttctcctcagaggccgcccatggctcccagtgggtgtctcacacaggggagaccaactcatctggcaccctagaaactctctttcccacaaaaaagaattgtatctatattttatagatgaagagactgaggttgtaaagaccaagagtcagtgttttcccaaagtttgctgataatagtgtgtattaatttactgcttggtaacttatttctgttttatagattagtatcttccttcccaggatttgttggaattaaataagaatagtgcatgcagattgcatagtacagtgtcaggatgtagaaagcatttaggagatatggttagacattttacttgggttatttctgtttcgatgtgtttttctgtctgggagtaaacaggtggtttaaggaaaaatcttgattgcagtagaattgacttagtcaaggacgtatatttcaaatgtgtgtttaacaagcttgatatgataaaaatagatccaattcttagttgcatgtgatttttgctttcctctgtaatatttatttgactgttttaaagaaattatggaaaacattgacttctttcccaactgtatttccctgcaatttgtttgcagtggaactgaatttactctaaagaggaggtatgtggcttgcatatcattttcagtaataggaagtgacatgagcaaaattgcaaggaaacagagattagagaccagccttgaataaatccagtataaaagtagaatgccttaacatttctcctaatttcctaaattgtattacagcagtatttttgaccttgtaggtggtggtctcctttattattattattttgtctggggacataggagatttcttgagaaagacctttaactgcagctgtatgtggtaataagtgtgtagggattgctgtcattctattagtagaacattcaggaatgtgaatgcttgatttgccagtttccttggaagtcggttggagtattagaatattactgtacactatacctgtgccacttttatgtaagcctgttagaactggattctggaaaacatttatatttgagaagttaacttattcttccaaatattaattcattctgtatctagatatttcagacttttagcaaaaatttaccactatgcatttgcatagaagaaaaacttttaaaaatatgtgatgtagtataaacatctgatttataagtgaagataaaattattctagcttatatataacaacaacaacaaagggaaattattctagcaatctcaaaaattcttattgtatttatttattttttgagatggagttttcactcttgtcacccaggctggaatgcagtggcgcgatctccgcttactgcaacctccgtctccctggttcaagcggttctcctgcctcagcctcctgagtagctgggattacaggtgcccaccactaagcacagctaatttttgtaattttagtagagacagggtttagccatgttggccaggctggtcacaaacttctgacctccagtgatctgctcacctcagcctcccaaaattctgggattacaggcatgagccaccatacctggcctgcaatctcaaaaattcttaaagctgactggttcctgagaccttaaggaaacaaaaaagctatcaaaaattagtaaagctccttttctcccacttttaacatacaagaaattaataaaagacagaaatgaggtgacatctatgtgccttcagggtattaagagcccagggtaataacctactttaaaacaatgctgtaaggttgaacatgactaaacttgtgccagctttctttttctttcctttatgttttaaccaactctattgaggtataatttgcatacagtaatattcactagtttgaagtgtgcattttgattagtttcataaacatacagttgtgaaaatggcaccatcttaatgtaggacatttccatcatctcagaaagttcccctgtgcctgttagcaatcagtgccttttcctcatcactggtctcaggcaacaactattgctctgctttttgtcactttctgtagctgctgcgtggtctagaattgtaaataaatggaatcatactacatgcagtcttttgttttgacttgtttcagtttgcataatgcttttgaaattcacgttacatttatcatgtttgtttctttttattgctaagtaaactacaatttagttttttacctgttaatagatttctgggttgtttcaagtttagggctattatgattaaagcttttatgaaggtttaagtaaaagtttttttgtggacaaatattttcatttctcgcaagtaatacctgggagtagattgatgagttgtatggtaagattatgtttaacttcagaagaaactgtcaaaccattaccagcaggatgtgagagttccagttgattttacagtatgtctttccccaacacttgatgttgtcagtcatttcagtgggtacttagtggtatttcattatagtttttttttgagacggagtctcactctgttgcccaggctggagtgcagtggcgctatctcagctcactgcaagctccacctcccgggttcacaccattctcctgcctcagcctcccaagtagctgggactacagacacccgccaccacgcccggctaatttttttgtatttttagtagagatggagtttcaccctgttggccaggatggtctcaatctcctgaccttgtgatccacctgcctcggcctcccaaagtgctgggattacaggcgtgagccactgcgccaggcagccttttcattttttaagcagcgttttttgagagtaaatattttaaattttaatgaagtacagtttttcaattttttcatttacaggtctgtgtatattctgtatcctgtaagaatttttgcctaccacaagatcacaaaaattttctcctgtgtgtttctctagaacattatagttttagctgtttatttaggtctgtaatccattctgagctaatttttatatatggtaggaggtgggagtcaatattcattatttgcgtattcaaataatgggaatatgtaaataatgcatattgcaatagggaatagaacacaaaagcatgctttttgttgttgttgacttttaaaatattgacctacaatttcccgtaagttcactttttaaagtgcatttgcatattcagctgttgcagcacaatttatgaaaagactttcattttcctccattgagttgctttggcacctttattgaaactcagttgaccatgtatttgcgtgtctgtttttcgattttcaattctgttctgttgatttacatatcattttgtcagttctgtattagcttggttactgcagtcttttagtaagtctttaaagggaggcagtatgaatactgcaactgctttggctgttttagttacttccatttccatgtaaatttcagacttgtcaatttcgaaaacaacaacaacctgagattttgattgagagcacattaactctaatcaaactggtgagaattgatataacaacatggagtttttaatcccaaacaagattcatctctttatttagatcttctttaatttctttaaacagtatttatctctcatgtttttggaggctgttgtatagggaattgtattttttccatatacaacaattgtatattgtatacaagtatacaaacaattggatatttgttctgtatacaaccgattgtattttttccaaatacaatgaaattatattttattttatttttcaattgttcagtgcttgtatatagaaatgtaattgatatttgttattaactttacgtgctataaccttacttgttctaatagcaccttttttttttttagatagtgtttacagcttcctttccttgttcccaattttggggggaaacattcagtctttgaccatcaagtatgatgtcagttgtaagtttttaataagtgttcataatcgctgaggaagttctttctattggcttactggtaattttcatcatgaattggtgaattttatcaaattctttttctctatattaagatggtgaagtaactagtttttctttttttagaatgttaatatggtaaaatacattactttttaaaaatgtaaaccatccttgcttttctggtattaactctgtttggatgttatatattactcatttttacatattgctggactcaatttggtaaaacacctttaagcattttttatgtctgcattaatgaagtctgttggttttagtttttgtatgctatttttatttctggtgttggattaatgctggtctcatcaaatgagttgggaaggatttttcttacaatgttgaatcatttttatagaattagtcttatttcttttaagccgtttcagcatcatttgttagaattaaccagtgaaaccatctaaggctcagacaggaaaactgcaaaatgatactggatcattttgtgtcgtaaagcaaacatgtgctccaggactaatggaaacaagttagaacaacacaaaaactggcttgaagggattctcattggccaaatttggaacattttgaacatcaaaaaaaaaagtaatcagttatattggaagaaaatatgagtccatagtgatacttaaacatgaagaaggtggatggaaataaaaatgacattaccaaagaatgccttctagtaaatgtacaaggaatgattgaattagaaagttaccgttttacaactgccactgtaatcattgactcaggcaggaattgtcaatggatgctaaaaattattggtaaagattattgggtatatgtgtactatctcaaaattctttttatgaattacttatctattacaaagggaaaaatacatctttgtgatgcaaagatctggtggatactacattaagcaagtgatccaatttaatatcaccagtagtgacaaattgaaatatcagtctcttgttagggttgcatgtcatttctatattattcttaccaaaaatatttgccctgaatctaatcatgaggaaacaataaagcaaatcaagattgtgggatattctgtaaaacactaagtcttgattctccaaaaattatgtcatgaaagacaaaaacttttgagggggactgttgtaatttaaaggagactaaagtgacaaccaaatataatgctgtaatgcatgatccttgattggatgctggactgaaaaaaaaggttataaaggacattttggggtggaaacttaaataccgactgtattttttaaatgttatatgtcagtattaaaatggttggctgtggtaataaaattgtgattatgtaggagaatgtctttgttcttaagggatctgtgctgaaagtatttactgggaagtgttgtggtgtctgtagcctgctttcaaatggtttgaccatatatagatacacacacacacacacacacgcagacatatatatatttttttctcatatatatgagagagagagaaagggagaatgtgctgaaacaaatctgataaatacagttgttttaactattctgtaggttaaccttttctacagtaaaaggtgcggcaagaaaatacttccctgtttgagagtcaggaccacagtggctcttccaggccttgaccatggggctgaagcagttggttcttcaaacctgtccagctcttccccacctccccagagacacagatgaccttgtatcttagctcattgaaacagaccctccagcgtcagctccttctatttctcccttcttgtaacctcagtttgtgtctccccccacgtttctttacttcagtcttcagatagagcttttcttctcctttctcttctcctgttttcttgactttccaaggcatctactttagagtctggcttctctctgccactcagaaacctgtctcaagacttaccagtggcttccagttggccaactctggtggcttattttcaagtctctgcccctctgtcctcttcttttctctgtgggatagtctttgacactgttgagccctttcttggcttccatgacacatgccctcttctgttcctcttgctcataaacctccactgtcagtgctccactgctgctggagggaggttctgcccgtaataagttgcagagctcagccctctaccatttcttccttgatttttgaaagctgagagcttcagtttcgtccctctgttggtgtccctttccccaagttcaagtactgttttggaactgcccgcttcagcatttttccttgcatagctcattgttaactcagatcccatttatctgaagttgaattaagcctttcctttcttcatatgccccttcaaatctggtcacttgccctaggcgtaacaggcatttaaatcaccagccttcaaagcttgtgggtatcataaaatgcagactcccaggctcagtctcagagaatgcgattcagtatgtctgaatgtaggcccagaatctaccttttgctgagtaccaaggcattttaatgcagtggtccaagaactccactttgagaacagctactttaatgattggtttcagggtttgttactgttctacttcaccatgggctttctctgtcttcaggaagctgcacctgttgggagattattctaagtattggaaggtcgttgagagacagcctgagcttgagctttgtagagatgcagacctgatctgtcctctcatctctgccacttgccagaagtttgaccttgggcaaattactggaaaatgggaaaaatagcacacaacttccagggtttggtgtggatggtggctcagcttctgcccccctctccagcctcttcttaattctcttcaatgctccccagatttcagacctatgaaatgacttatcttcttaaagaaccatgatttttcatacctcaaattcctttgcactgttgtgctttctggtaggaatgccctaccttaacctccgtgttcacctgactcttccttcagacgtaaccactccataaacccttgtggctgaatttggtggtttcagtgcacctggagcacccagtacttgatttattcgtctgtgtctcatctcagtgtatgagttccttgaggaggtccagccttagccgttagcactgtggttatgtgcagtagcttttagttaaaagttatctttttttttttggaataatcaaggcacctactatgacattagctaattgtatttcagaggcctagttttgaaactttcattatttgtcaacatacttggcagccatgccagcaggtataagctttcccgcatgttttcaaaacaggaaacttttgtcctttggaatagaagttctaacacttgagcacatttttttttttaaactaatgtcttgaagaggtaacttgtttctttttttaagtttaggtttgcctcatcccacaatgagatcatgaaataaccttgcctctccccatcctatgagttagctggtactttctgtttatagtcagtggtcagcaccaaaatagtatcccttgaatttcaaagcaagccaggacagactagaagtacattaaaatttgtgcctggttactagagggggaaaaataaaatatataatgttgtttcatatgtatgtagtcaaaagtaaaacatgtgactaaataaattttaaaaataataaactaaaattcatagtaatgctaaaatttagtttatgtaaatcattaagtaccaggcacaacaaaatttttgtttctttgctttttgtttttatgtaaacattattgtgcttagaagttgccaaatttggtgtctttcaatttttttccttttggaataaatgtgaacaaagtctcacatttattcaaacatttaacttcattttaaaaattattgctgtaggataacttttttttttttttttgagacggagtctcactctgtcgcccagcctggagtgcagtggcgcgatctcggcttactgcaacctccgcctcccgggttcaagctattctcctgcctctgcctcctgaatagctgggactacaggcacatgccaccacaccggctaatttttgtatttttagtacagatggggtttcaccatgttggccaggctggtctcaaactcctgacctcaggtgattgcctgcctcggcctcccaaactgctgggattacagccgtgagccaccgtgcccagccgctgttggataattttttaacttaaaatttatgtcagagatggagaataaactattaaagactaatagagaataaaatttttggaccatgtatttacaaaagtcatgtttagtagtaaaaaaaaaatctagtttacactacttaatgaaaaaagagaaatatttttaaatatatataacacattctcactttgacataaatttttctctttttaccccagttactactatgcccaagaaaattttccaaactttaagtcttttttttcttttaccactttggagtatgacctgttatttataaactttccttgaaaaaaaatcgaaattttaatttgtaccctgaaactttgatcaaagtaataggagatcaataccacatgagttaaagaatggagtaaaaatataattgttctctgtataatcaagaaattatctgatgggccattgtaactatttcacatttccatttagcaagttggttccgagatacaaaaatatttggcactttttggcttgtggatgtccagttgctctagcaccatttattgaaaattgaaaaaattcctccagtggattattttcatacttgtatcaaaatcaattgggcatatttgtgtggctctctttctgggtcatctgttctattccattagtctgtgcatgtcattttggcaatgtcacactctctcaggtactctattactagaataatactacccttactcttactctaccttaatattggggaaagtaatttctgtcactttttccttatttctcaagattgttttgactattttagggtgtgtacctttgcatgcaaattttagaataagctagtttgtgtgtatgaaatatgttgctgagatattgataggaattgcattaaacctgtatattaatttggggagaattgacatttttcctgtgttaagtactctattatatatgttcatttatttaggttttctttttttaatcagcatttaaaattttttagtatatagatcctgtacatagctttcactttccggagtgattgcaagtatttcactttccagagtgattgtaaatggtgttttgttttttattttttggtttccatatgttcattgttagtatatagtgtcttgtttttaactttttggtttccatatgttcattgttagtatatagaaatgttattgatttttgtgtgttaatcttatatcctgcttccttgctgaacttacttattctagaagttttagatgattttcacaggttcctttggattttccatgtaaacgatcgtatcatttgccaatacggacaattttattcttccttcctgatctgtatgcattttattttccttgccttattgcagtatcttagaatttctagtactgtgctgaaaaaaagttgtggatcaccttttcccagtcttaggggaaaaccattctttcaccattaaggtatagatttttgcagatgctctttgtcaagtaaaggaagttccagtttgttcctattttagtgagaatttgtatcatgatgagatgttggattttgtcaaatgattttttttgcatcaattgacatgatcatatgattttgttatttattagtatatttgattccattaattttttttcaaatgttgattcagtcttgcatatttcggataaattctgcttatggtgtgtagtcctttttctatattactagattcagtttgctggtatttgtttgagggtttttgcatctaacttaataaggaatagtggtctatagttttaaaaaaattttgcaatggttttgtctagctttgatgtcaagagtaatacactagcttcattagatgagttgggaaatgttctttgtttttttaaactagattatgtaaaattggccctaattctttttaaaatgtttggtaaaattttccagtaaagccattttggcctgggaatttcttttttggagatctttctcttttttagtttttttttttttttttttttttgagatggagtttcactcttgtctcccaggctgaagtgcaatgccgtgatctcagctgactgcaacctctgcctcccgggttcaagcaattctcctacctcagcctcctgagtagctggaactacaggcgcacgccaccacgcccagctaattttttgtatttttagtagagatgggttttcaccatgttggtaaggctggtctcgaactcctgacctcaggtgatccacccgccttggcctcccaaagtgctgggattacaggcgtgagccactgcgcccggctgagatctttctcttcacaaattcactgtctttaatggttatgggtatatgcaggccatttccttcatcttggttgagctttggtagtttgtggtttttgaggaattggtccgtattttcaaagttgtcaaatttatgagcataaagttattcattctatgcccttagtaatcttctaatggctatagtatgaagctatcccttgtttcattcctgatggttgtgctttgtgtcttcacctttttgtcagtcttgctagagccttttcagttttgattatttttcagagaaccagtatttgatttcattgatttttgttgttgttattttcctgttttcaatttcattggtttctgctcttgtttttataattttcattctacttgctttgaatttattttgctctactttttctagtttcttaaagtaggggacagagattattaatgtgagaccatttcctcttttctaatataagcgtcactgtgacataagtgtttcggtcagaactgttttttgatattttgcgtttttatttttatttacgtatatgtattttttgctgttctattgctttttggccaatgatttgtttagacatgtggtatacagaagtgtttgaagatttttgtgttatgtttctgttactgatttctagtctgattacattgtgattggaaatcatatgaacttaaggttcaccagcattatagttggaaaatggaataattttaattattttaaaatagttggggtttgttttatgacccagggtatggtctgtcctggtgcatggtccacggtagcttaaagggaatgaatattctgttgtagggtggagtgttctggagatgtcttttagatcctgttggttgattgttgttcagttcttttctgtctttgctaattttcttttagttctaccagttgctgacagtgaagtgttgaaatctccacctgtaatttagctttatcagtttttgttttattattttgcaactctgttgtttggtgcatttacttttaggagcagtatttttttattgatggattgatttttaaagtatcgttatgtaatgtctttgtctctagtaattttctttcctctgaaatctaccttatctgtgttaacatagccatacctgtttttaaaaaataatgttagcatgatatatcttttaacgaccttttatgtaaaactgatgtgtttgaaataagttttattagacggtatgtagttgggttttgtctgactttcattaaggtctctttgccttctctgttttttaaaatgcacttttctgaagttatttcatttccatacattgagcacagcagatgttaagtttgttttaaccgtcagtatgatttaagaaacttgatggaaaaggatggtctcttatatttaccccttcctttgctcttgtttcctttatgaaattccaagctgccttttattattttctttctttttgaagatactcctttagaccttctttaagcgtaggcttggtagtgacaaaatttttaatttgctaatacctttatgttaccttcttttttgaaggatagctttgctggttatagcattcataattaacagttttctgttgttttttgtttgttttgtttttgttttaatgagacagggtttcactctgtcacccaggtaggagtacagtgagtggcacaatcatggctcactgcagcttgacctcctgggctcaagcaatcctcccacctcagcctcctgagtagctggaactacatatgcacagcaccatgcccagctaatttttaaaatttttttgtagtgatgtagtctcactgtgttgcccaggctggtctcgagctcctgggctcaagtggccctcccgcctcggcctcccaaagtgctggggttgtaggcatgagctaccgtgctgggcccacacaattgacagtacttatgtttcagttcttatatttcagcatttaagaaatatgccactccttttgcactttcatggtttcagactgaacaccaattcgaattggtgttctagtataggtaatgtgtcatttttcttggttccttttaagactttttgtctttagttttcagaagtttgtgatgtgtcttgatatgaatttctttgggtttatcctatctggaattcgctctgtaagtttatgtctttcaccaaatttgggaagttttcctgtattaatttttcaaatcctccctcagcgtcacattttttctcctctcctaatgttagatttttcattattgccctggaggtccctgaggctttgttcatttttttgtttcagcctactttttctgcagctgttcagactgaacaattcttttttttttttttggagatggagtctcgctctgtcacccaggctggagtgcagtggcgtgatcttggctcactgcaccctccgcctcccgggttcaagcgattctcctgcctcagtctcccaagtagctgggattacaggcgtgcgccaccacacctggctaatttttgtatttttagtagagatggggtttcaccatgttggtcaggctggtcttgaactcctgatctcgtgatctgcccgccttggcctcccataatgctgggattacaggtgtgagccactgcgcctggccgaaattgaacacttctttagatctgtcttcaagttcactgatcctgtatggtattaaaggactctaaaaggtggaaagcgggtggactggctaggggacgttaggacttgaaacacactggactggagtaatttccatgcatgtgtgttggggcggtgtggtgtgtatgcgtgtttgtgtttttcccccgtgtatcccagactggagtggagtacaacttgaaattgccaacaggcataaacagcaacaaaaacaaaaaacagaaaaccctgtcctctctggccaaaggatcaggaaaagggaagcccaggagggacttgccaatgagacattttacccagtggcagtagcaggcctagtctgcccacaacagtggcccagcagagatagagtgagaagcttaccagtgaggtgactgtagaacaagccacgggaaatgctcttattcacccctcaggtctggcagtcccctacccactggcctaatcatactgtgcagcctgaggatgtgccttccaccccgctgtgtggcaccagaagctatccagtgggagctccagcagagctagaagaatgaagcagacacatattaccatcacaggggcttacaaaactcaattgtctttggaactacagactacaaaagtagaccagaacctacacaccaaacctaactgactccatgtttttctaacttccttaaatccttattttcacttaaagggattttttttttcctgttacaatatgtctggttgtgctgaatgtgagtctgcaccatcagtgaactgttgacttattctgctctctgcttctgttctctggttctatcattttaactttaaaatgtgcaactctggtaaatccctaaaattaacagtgcatgtgttctgtaggaaatgagttcctcttggtttgttggctatttccagcttattgtactttctttactgcaaatttaggctattaaaaggatattagtacctggaaactaagctcgttttcctccttttaatccttattggctaaaatattagtcatctttggttacaagttgatggctgagcagtttttcattccacagtgttgagaaactagactggaatcttgagctgataaaccagaatgcagatgtggtagatattggagtcttggaatcagcagacccatgccctagttctggctctgaactcattcaacttctacatgatttctgagaaacccgtaattaaaaaaaaaaaattatttctaagtcagtgatgttaactgctctcccagtctgttgctgcctgaaggggaatatccggtaaagagaccctgtcctgatgctctttgccacagagtgtagagctgctagcagggggagaagcaagtgtagggacattaggatcatggcatactggagagaggactagggctacagaagccacaaggacagtcagggagaggaaaggtggaatgtccatgaaacacagcactgctatcttcaaactttgactgtttttaaattgaaacatagcttataatcagtagagcacacacatcttaggtacgtagctttttaaatctttatatatgtatgtatttgattatagttaatgattttaactatcatacagacgaaaatgtagactataaagccttgcgaacacttttcatggggaaatacttttttccattcactgctttaatgaagtggttaaatattggcttgataaggtatctatatgtatagatgtatttttattttttgtcttgtgctgaaattttggatattctgtaagaaagacacgtaatgagattggtagccatcatcctcacaaaacatagtgatgtgtttctcagaaggaggatttagtaatgataggcctttgggtttgcaggtacaagaaataaggcaaggaaaatggttgcaattttggagtaaggccttcatgtagttgatgtgagatgatgatttggaatccttcaaaagctattgtataaaagtaaccaaaagaagcaagccctgtgtggggtgtaaaaataaatactgactttttttttttttttttttttttgagacagtctcactctgtcgcccaggctggagtgcggtggcatggtctcggctcactgcaagcgctgcctcccaggttcatgccattcttctgcctcaccctcccgagtagctgggattacaggtgcccgccaccacgcccagctaatttttttgtattttttttttcagtagagacgaggtttcaccatgttagccaggatggctcgatctcctgaccttgtgatccacccgcctcggcctcccaaagtgctgggattacaggcgtgagccaccacgcctggccttgacttttaataaacagatttattgaggtataattaatgtacaataaactgcacacatttaaagtgtacagtttgagttatggcccatgtgaaactattaccatagtgaagattgtgtgaacgtgtgcactctctatttccttgtgaccctttgtagaattttcttacctcccttcctaatcccaggcgacagttcttctgctttctgtcacttagattagtttgcatattatacaactttgtataagcagaatcatacagtatttactcttctgttgtctcccttctttcactcagcatgattatttttagatttgtctgtaatgttgcatgtttgactgttttagtactgcatagtattccactgtgttgctgtatcacaatttgtttatccacccacccgttgatgggaatgtgagttgtttcctcttttgaactattacaaataaagcttccctaaatattcatgtacaagtctttcattttcattcacacatacgtttcatttcagttgggcaaatacctagaaatggaatgtctggtgggttatgtgttcaactttttcagaaactactggcctggcacggtggctcacgcctgtaatcccagcactttgggaggccgagacgggcagatcacgaggtcaggagatcgagaccatcctggctaacatggtgaaaccccatctctactaaaaatacaaaaaattagccgggcgtggtggcgggtgccctgtagtcccagctacttaggaggctgaggcaggagaatggcgtggaccctggaaggcggagcttgcagtgagcccgagatccaccactgcactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgccctcttatttcatgtgctattcatgttgtctttgcttaaatgtctgttcacatcttttttgcatttttttaaattgagctgtttgttttcttatttagttgtaacagttatttacatattctggatacaagtcctttgtcagataagcattttgcaaatattatttccagtctgtggcttgtatttttacttttgtaacagtgtcttttgaggagtaaaagctaaaaaaaaaatttttaatccacctctcaattcatctttttttcttttatagttcaagatttttttcttttttgtatcctacttaagaatatctttgccaaactcaagatcactaaaattttcccgtgttgatttctaggaactttagaattttagctcttacataaattctgttattcatttcaagttgatttttgtaaattttggagcatccagattctcttttgtttttctttcccatgtggctattcatttgtaccagcatgacttattgaaaagattacttttccccaattgaattgccttggcaccctgttgcaatcagttgaccatatatgtgggggtctacttttggagtctctgttctatttcacacatctgttatctgtgtcagttttataccatcttgattactatgattttaagtcttaaatcaggcaatgttgagtcctccaatcttgttcttctttttcaaaattctttttactattttgggtcctttgcttttctgtataacttttagaatcatcttgtaaatttttacaacaaaaaacttgattggaattgtattgactgtctagatcaatttggggaaaattgctgtaacaatattggttcttttgatgcatgaacatggtatatctttctttttatttaggtgttctttaatttcttccagctgtattttgtcaaatatttatcttagtattttgatgcaattgtaaatggttttgatttttattttccagttgttccttgctgttattagaaatatgattgatttttatatgttggccttgcattttcctactttcctaatcttactactttcctatatcctgtatcacctgtaaaaattgtaccagaatcaaaaaaattctagtagaatttttataggtgttataggagatatcatgtctgtgtctaaagacagttttattttctcttttccagtctacatactttttttttctttgcgttttattggcacgaagattgccctcttaccttcatttattctttcgctatgatgttaaataggagtggtgagaaggaacaatcttaccttgttctaatcttaaatggaaagtatttagtctttcaccattaagtatgatgatagctgtatatcttttgtacatgtcttttatcagcttaaggaagttctttttgtgcccattttgccaagatcttttatcatgaatggatgatgaattttgtccaatgttttttgtctgttttttgaaatgattaattttgttttttaagtcttatatgttgaagttttttttttgaatatttaaacagtatttcattcctgggataaatcccacttggtcatgatgtttttatcttttttatacattaatggattacatttgctgaaattttgacaagaatttttgcatctgtaataagatgtgaaattggtctgtagtttttttgttttaatacccttatttgttttggggatcagagtgatgctggctttgtaaaatgagtttggagagtttctcctgtttctgggagagtttgcgtatgattttttttttccccttaaatatttgggagaactcatcgttaaatacatctaatcctggagttatctttgtgagaagattttaactacaaaataagtttcttaagtacatataagcctattcaagttagctagttttttgtgagtgacctttggtattttgagtctttgaaggaatttgtccgtatcataaactgagagttgttaattatatttgctgattagtcttctaatgtttatagaaagtatagtcgtattcagtctctcatttcttatgttcacaatacctggcttctcttttttcaaactgactagctagatgtttatcaattttgttaatcttcccaaacagaaaacttttgtttccttcgatttttctctattttctgctttctactttattgatttatattctttattatttcttttctttttttattaaaaaacaagatatggattacttatctaatatttagaatgtgatcttatagattatatatgagtatgcaatatagataactgtatggatataccatatttccaatcataaatattatattacaagatgtaatgcaagataaaatccctgcacaatagctgtgttggcataagcatcattttaactgagtgttttaagatggttgtaataccactgagtgttttaagatggctataataccactgtagtcacagacatgtcagcagcatgttcttggcacatttaatctgtggctacagtaaggataccaacctcctctgtaatcagtatttccaacttagcataatttaagtgaatttacaattgcttgatgtatatctttttaaaagagtgaatgtgttcaaacgttgagatttttagaagtcttacagtagtggttttcttttttcaaatttttggcatatattcaaactttcagaaaatttttaagaatgaaaatagtcaaaaacattcatattctttacccagattcacctgctgttgacagtttgacccatttgctttatcatttgctgttttctcctccccgtgcacaatctaatgaatgaatttgtatccatgaaagaactataagcttaaagctcttgagcagagattacattttgtcctctggttacacaatatttaaaataccatttagataaacattttagaaaagatttagggaatagaacacaaaagcatgctttttgctgttgttgacttttaaaatattgagatacaatttctcatatcatacttcaccttttaaagtgtataattcagtgggtttttgaagtatactcatagacttgtacaaccatcacaactgtctcattccaaaatatttccatcaccccaaaagaaatcctttatacaataggagtcacaccctattccttcccagcccctgacaactgctaatctaggttctttttgcctattctggacgtttcctataaatggaatactaaaatatatggccttttgtatctggctgctttcacttagcattagtcctcaagattcatctgtgagctttgtgtcagtacttcattcctttttgttgtggctgaaaaatactccattaaatggatttaccacattttgttaactgctcattagtcagtggacatttaggttgttttcatttttgactatcatgaatttgaacaatgctattatgaacactggtatataagtttttgtttgcacaagtattttcggttttcttatgtatatacataagagtataattggtatattgtatggtaactttatatttagtttttttaataactacccaactgttttccagtgtggctgctccattttatgttaccaccagcgacttaggcgttttcgatgtctccacatcctcatcaatgcttattgttgtcttttttattacagccatccttttgtttttgaagcagtatgttgttttgcttttgattaacatctgtctaaggactggttttgagcgtcttttcgtgtatgtatgtattattgtccgtttatgtatctttggagaaatgtctagtcagtttccttgtccattttttgattgggaggtttgtcttttattcattgcaagagttctttttatattctctgtatgtatctcttatcagatacatcatttgcagaaattttctcccatcctgtgggttgtcttttcactttattgatagtgccctttgaagcacaaactgttttaattttgataaagtctaatttatctgtgttgtctttgcttacctattctagttaagaaaccattgcctcatcagaggttatgaagatttacatctatgttatcttcaaaagttttatagctttatctcttacactgaggtctttgttccttctggatttaatttttgcatatgttgttaggcagggtccgtcctcattcttttccaagcagatacctagttattccagtgccagttgttgagaagattgttcttttctcctctgagttatcttggcattcatcaattgagtgccgaaatcaattggccataaatgcgagggtttgtttctggactgtcagttctattctgtttgatctatttgattaggtttatcttttatttatttatttatttttatttttagtctgagtcttgctctgtcgccaggctggagtgcagtggcgcaatcttggctcactgccacctctgcctcccaggttcaagcaattctcctgcctcagcctcccaggtagctgcgactacaggcgcgcaccaccatgcccagctaatttttgtatttttagtagagatggggtttcagcatgttggccaggatggtcttgatctcttgacctcatgatctgcctgcctcggcctcccaaagtgctggaattacagacgtgagccactgtgcccaaccttgataaggtttatctttattccagtactgttctgtcttgattaatatacctttgtagttaagttttgaaatcgggaagttttgagtcctccattgtgtccttctttttcaaaactgttttggctattcttgaatattcttatgaacttcaggagccacttgtcgatttgcaaaagagcaaggtgagattttgacaagattgcgttggatctgaatattaccattttaacattattaagtattctagcttatgaataccagatatctttctatttaggtcttttaaaatttttttcagtgatgctttgtagttcacagtgtacaagtcttgtacttgttcgagatgtataatcctttgtatatgtttctagatatgatttgcttgtattttgttgagaatttttatatccacattcataagaacatctgtagttttcttttcttgtgatgaccgtgtctgatttatgtatcagggtatgaattgcttcatataataatttggaacgtgatgttttctcttgagttttaaaatttttgttacttaaatttttttagagacagggtcttgccttgttgcccaggctggaatgcagtggtacagtcatagctcgctgtcacttcagacttctgggtttaagcaatctttctgcctcagcctcctgagtagtgggaatacaggcatgcaccaccacacccagctctttctttctttctttctttctttcttttctttcttttctttcttttctttcttttctttcttttctttcttttctttcttttctttcttttctttctttctttctttctttttttttgtagccatggtatgttgctatgttgcccaggctggtgttgaactcctaggctcaaatgatccttcagcctcagcctcctaaagtgctgggattacagccgttccccatgcccagcctgttttttgtccttctttatgctttttaaaaaaagcttgtgaaggatatgttttaattcttctttaaatgtttagtagaattcatcagtgaagccacctgtccctaggctattctttgcggggaaactttgatggctaattaggtttgttaagattttctgtttattttggagttaatttcaataatttgtgctttctagttatttgttcatttcatgtaggctgtctaatttgtttgtgtatagttgtttcttgtgttctcttttaatcccttttactgtaagattggaaagttcatttctttttgtagcattagtaatgctccctgtttctttcttttctttttttttgtatttttttttttaaattatactttaagttctagggtacatgtgcacaacgtgcaggtttgttacatatgtatacatgtgccatgttggtgtgttgtacccgttaactcgtcatttacattaggtatttctcctaatgctatccctcccccctccccccaccccattgacaggacccggtgtgtgatgttccccaccctgtgtccaagtgttctcattgttcagttcccacctatgaatgagaacatgtggtgtttggttttctgtccttgtgatagtttgctcagaacgatggtttccagcttcatccatgtccctacaaaggacatgaactcatcctttttaatggctgcatagtattccatggtgtatatgtgccacattttcttaatccagtctatcactgatggacatttgggttggttccaagtctttgctcttgtgaatagtgccacaataaacatatgtgtgcatgtgtctttatagcagcatgatttataatcctttgggtatatacccggtaatgggatggctgggtcaaatggtatttctagttctggatccttgaggaatcgccccactgtcttccacaatggttgaactagtttacagtcccaccaacagtgtggaagtgttcctatttctccacatcctctccagcacctattgtttcctgacttttgaataatcaccattctaactggtgtgagatggtattgcattgtggttttgatttgcatttctctgatggccagtgatgatgagtattttttcatgtatctgttggctgcataagtgtcttcttttgagaagtgcctgttcatatccttcgcccactttttgatggggttgtttgatttttccttgtaaattcgtttaagttctttgtcgattctggatattagccctttgtcagataggtagatggtaaaaattttctcccattctgtaggttgcctgttcactctgatggtagtttcttttgctgtgcagaagctctttcatttaattagatcccatctgtcaattttggcttttgttgccattgcttttggtgttttagtcatgaagtcgttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgttgtattatttctgagggctctgttctgtttcattgatctatatctctgttttggtaccagtaccatgctgttttggttactgtagccttgtagtatagtttgaagtcaggtagtgtgatgcctccagctttgttcttttggcttaggattgtcttggcaatgtgggttcttttttggttccatatgaactttaaagtagtattttccaatcctgtgaagaaagtcattggtagcttgatggggatggcattgaatctgtaaattactttgggcagtatggccattttcatgatactgattcttcctatccatgagcatggaatgttcttccatttgtttttgtcttttttttttttttttgagatggagtctggctctgtcgcccaggctggagtgcagtgccacgatcttggctcactgcaagctccgcctcctaggttcacgcaattctcctgcctcagcctcccaagtagctggtactaacaggcgcctgccaccacacccggctaagtttttgtatttttagtagagacggggtttcaccacgttagccaggatagtctcgatctcctgacctcgtgatccgcccgtcttggcctcccaaagtgctgggattacaggtgtgagccaccacgccaggccgtttgtgtcctcttttatttcactgagcagtggtttgtagttctccttgaagaggtccttcacatcccttgtaagttggatttctaggtattttattctctttgaagcaatagtgaatgggagttcactcatgatttggctctctgtctcttattggtgtataggagtgcttgtgatttttgcacattgattttgtatcctgagactttgctgaagttgcttatcagcttgagatttggggctgagatgatggggttttctaaatacacaatcatgtcatctgcaaacagggacaatttgacttcctcttttcctaattgaatacccctttatttctttctcctgcctgattgcttggccagaacttccaacactatgtagaataggagtggtgagagagggcatccctgtcttgtgccagttttcaaagggaatgcttccaatttttgtctattcggtatgatactggctgtgggtttgtcataaatggctcttattattttgagatatgtcccatcaatacctagtttattgagagtttttagcatgaagggatgttgaattttgtcaaaggccttttctgcatctattgagatagtcatgtagtttttgtctttggttctgtttatatgatggattacgtttattgatttgcgtatgttgaaccagccttacatctcagggatgaagccaacttgatcttcgtggataagctttttgatgtgctactggattcagtttgccagtattttattgaagattttgcatcgatgttcatcagggatattggtctaaaattctttttttcctgtgtctctgccaggctttggtattaggatgttgctggcctcataagatgagttagggaggattccctctttttctgttgattgcaatagtttcagaaggaatggtaccagctcctctttatacctctggtagaattcggctgtgaatctgtctggtcctggacttcttttggtttgtaggctattaattattgcctcagtttcagagcctgttattggtctattcagggattcaacttctttctggtttagtcttgggagggagtatgtgtccaggaatttatccatttcttctagattttctagtttatttgcatagaggtgtttatagtattctctgatggtagtttatttctgtgggatcggtggtgatatctcctttatcattttttattgcgtctatttgattcttctcttttcttctttattagtcttgctagaggtctatcaattttgttgatcttttcaaaaaaccagctcctggattcattgattttttgaagggttttttttgtctgtatctccttcagttctgctctgatcttagttatttcttgccttctgctagcttttgaatgtgtttgctcttgcttttctagttcttttaattgtgatgttagtgtgtcaattttagatctttcctgctttctcttgtgggcatttggtggtataaatttccctctacacactgctttaaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcaccatggtctgagagacagtttgttataatttctattcttttacatttgccgaggagtgctttacttccaactatgtggtcaattttggaataagtgcgatgtggtgctgagaagaacatatattctgttgatttggggtggagagttctgtagatgtctattaggtctgcttggtgcagagctgagttcaattcctggatatccttgttaactttctgtctcattgatctgtctaatgttgacagtggggtgttgaagtctcccattattattgtgtgggagtctaagtctctttgtaggtgtctaagggcttgttttgtgaatctgggtgctcctgtattggtgcatatatatttaggatagttagttcttcttgttgaattgatccctttaccattatgtaatggccttctttgtctcttttgatttttgttggtttaaagtctgttttatcagagactaggattgcaacccctgcttttttttgatttccatttgcttggcagattttcctccacccctttattttgagcctatgtgtgtctctgcaggtgagatggggtttcctgaatacagcacactgatgggtcttgactctttatccaatttgccagtctgtgtcttttaattggagcatttagctcatttacatttaaggttaatattgttatatgtgaatttgatcctgtcattatgatgttagctggttattttgctcgttagttgatacagtttcttcctagccttgatggtctttacaatttggcatgattttgcaggtggctggtaccggttgttcctttccatgtttagtgcttctttcaggagctcttgtaaggcaggcctggtggtgacagaatctctcagtatttgtttgtctgtaaaggattttatttctctttcacttacgaagtttagtttgggtggatatgaaattctgggttgaaaattcttttaagaatgttgaatattggcccccactctcttctggcttgcagagtttctgcagagagatccgctgttagtctgatgaccttctctctagttgttctacccatgtttgaaagtgggatattgaattctccaaatatttttattgaatttcttctttatcccttcatcctgcatgtttttatttcctgtgttttggagctctcttgttaggttcacgtatgtttataattatgtcatcttaatggagtgatccctttattattattaaatgtcttttttcctcttgtagcaatttttatcttaaagtctgaatttttaaaatttattttttaatagttgctgtgagaattacaattaacatcaacttgtaatagtttagtttggactaatgtcacctattcttcaaatattcttcatgcctttttttctctcctcttctgagactcctgttgtacagatggtgttttgtagtcactcaggctcttttcatttttcttcatttttatttctgtttcccagactggataatcttaaccaacctatttttgagtttgctgattctttcctttgcctgccaaaatatgctattgagcccctctgatgaattattttagttattgtacttttatgtccagaatttcaatttgcttgttttttccagtttctttctctttattgatattttctgtttggtgaagcgttgttctcatactttagttttgcacgtggtttccttttttcctttgaacatatttaaaatagcttatttaaagtcttctagtaagtcctgtcctcagggaccattactgttgattgcattttttcctatgtatgagccatactttcttgtttctttaaatttatttgaaaactgggcagtgggaggggctcatttcagttactgtgcttttctatttggttattttaataatttctttctcttcttaatattctccatttggtgtgacttttagttctttggacattatttcctttagttctttgaatatatttaatatagctgaattaaattattcagtaattctaaaacctgggctttctcaagggcagtttctattaaatactttttgtccctttatacttttttgtttctttgtatgtctctcaattttttgttgaaaactggacaactaacatataaggtggcaactctggaaattagattttcccctccctaaggtttgttgttgtttttgttgctgtttgtttagtggctttctgaacaagttattttaaatctatattatttgtggtgcatggctactgaagtctccgtgtggtgagcttcatagtcatctaatgattgaacagagatttccttaaaaacctggaaccagtaattctccccatctttgttgagaggcctgtgtatttgcgtacatatgtgtgtgttggggcacatcaaaacactcagccgggcagttgacagctgttccttagccttcccctcctgtttacacaaagcctggggtcagccccaggtgtgagagcttagggatgtctcaggtttcttctgagcacaggcagagccagagcccgatgcgtacacaggaccttctagattggcaggaaggtgtcaacactttttacagcccctgtggacatcttattcccaacttttccttttaaacttttgggtctgcttattgtttggcccaactgtcatctaccacattgttctgcagccaaatttttaaaaatttcccctaaaggtttttgacaactgttaccagggtcgaggcttttcacagtgggaaagctctgagtcaggtcaaataaaagtagccttccaggtggggcctcactgggactcaccacacagatcagataaagacagttctctggaaatcaggctttcgaggagctgcagcattgttctgccacccttattgcctgtcaggctgctgattttcactgtgattgggctgttggttatagtgctgtcacagagctggagagaagagaatgagaatagaaaagttaaatgccacatatttcactgttcttgttgagattcagctttttaaaaatgtattaacattccatggattgctgcaagcttttggagattgctgcaagcttttggttaattgccagagttcttagaaagtttattctgatgctgccaattttcttgttcttgttagaattttcaaatgtccctaactttgccattttcactgacagtacctctgttgcttttttttcttcttctgtgctattttgtttcttcaaactattctcaacttttgctgtcaaaaccagttgattgaattaacattgataatggcatgtaggtcctgaaattaaatttcattatcttaatattataaatattaacccatttaagaatcactattacaaaaacattttgaagataaactattgagcaggtagaactaattaccagaatttatcattagctatttcattttttaatacagattcttattgagatcattttagaatcatacactgttataagaagttatacagagagatcctgtgtagcctgtacctggttcctcccaatggcaatatcttgacaaagaatactacaaagtcacaaccaggatgttgatcttttgataggaatgggtatttcattttcaccatcctgatattgtggctttcattaccatttccctgatggttaatgatgttgaacatcttttcacttgcttattggattgttcttttctgtttgtttttgagttctttatatagcctagatctttagacttttgttaaatatgtagtttgcaaatattttataccttttcgtagtttgtcctgtcctactcttaacagggtcatgtgaagggcaaagtttttaattttgaatgaggtacaacaatttatcattttttttttctggattgtgcttttggtgtcaactctaggaacactgccaaaccttagatcctgaagatcttctctatcctttttaaaaagttttatagttttacattttaaatttagagcagtgatgtattttgagttaatttttgtataagttgtaaggattaggtcagggttctttaagaaaaatattgttttggtctatagatgtctcattgcttctgtgctatttgttggaaaagctgttcttccaatgaattgcttttgcaattttgtcaaaaccagtgaggcatatatggttccgtttctaggtgttctactctctgcaagtgatttatgtgtctatccctctgccaatatcacactgccttggttactgaagttatgcagtaagacataatgtctggtggagtgattcctctcactttattcttgtttttgaagattgtttttagcaattctagggtttgttcctatctaattttttgtataagcttgtcaacaaaaaattatcctgggatttttacagggtttacattaaacccacagattaatttgggaagaattaacatctttacattttgagtcttttaatccatgaatatagtgtgtcttcttgtttatgtagatcttctttgatttatttcatcagcattttgtatatttcagtacatatgtcctgtgcatgctttcttagatttatatctgaggtacttcattttatttggagtcgtaaatggcgttgtaaatggcattttaatgttgatttttgcatattcattgttagtatatagaaatgtactggattttaggatttagaccttgtattctgcaactttgctatatgtacttattacctttaagaaggacttttctttttgagtccttggggtttttacatagacaagtatgtagcctgcaattagggagttttatttcctttccagtgtgttcgtcttttttttttccttgccttgttaaagtggccagaacttctagcacatgttgaatagagtgagagccacatccttgacatgttcccagtctcagggcctatatattcagtcttttactggtaagaaggatattacctagaggttgagattgaggtagttctacatttctcctatcttcttgagagtttttatcatgaagaggtgttcggttttgtcaaatactttttctgtgtcagttgatatgatcatgtgtttttcctctttagcctgttgatggggtgaattacaatgatcagtttttgaattttgggtgagtcttgcataccttgagtaaaagtcacttggtcgtgatgcataattttatacattgctgggttcaatttgtaattttttttttgtctaagttaatgagttttgtagtttttaaaataacatgtatgtagcataaaattcagcatttataactattttaagtgtacaattcagtagcattaatcacaatgttatacaaacaccaccattcttttttcattaccctagagactcagtaaccattaagccacaactcctcacttccccctaccctgttgcccagtaacctctaatctactttctgtccccgtgaatttgcttattctacatttttcatgtgagtagaagcacagtatttgcccttttttgtctagcttatttcacttactataatattttcaaggtccatccatgttgtagcatatatcagaatttcattcttttttgtggctgaataatatttcattatgtaactgccatgttgatccattcatctgtgatggacacttggtgtttctgtttggagactttgggtactatggtcacgcatcactcaacgtggaaaacatcctaagtggtgttaggccatttaatcattgtgctaacatagagtgtacctacacaaacctaggtggtatagcctactacatacctaaggtatatgatacagcctattgctcctagactgcaagcctgtacaacatgttactatactgaatactgtaggcagttgtaacacaatggcaagttttcgtgtatctaaacatagaaaagggtacagtaaatacagtattataatcttatggagccaccatcatctgtgcagtccatcgttgaccaaaacattacatggtacatgactgcatttaaatactttgttttaacagtcagcctatttaggtttatcatataggtcctgactagggcctgctgttttgggctatagttccagtaatagcttagtttttagagcatttgcagtgcgagcttcagagttttagtgattttctgatactgaagctgctaagagtagttggtggttcttgagcattagttctacattttataactgaagtttacagatctttttagatgacttagattctttaggataaggtgaaaattaattatggtattttgtctttagctataaaattaattttgaaaaacctttctggctcatctttttagatgtatggtatatatcctgcacatctgaattacataggattatattttgagttttagtaaacaacatgggcattagcttctttaggaagttgatgatattgagtggtcttgataaaattaaaatatggtttatatgagttcccttgtacttctaatgtggcaagaagacaagtatatgttacatttttcagataataaaactaatgagggaagaaacaaagctttgatcataaaatgtctttaagctcgaagggacccatgtggacctagtccaggatgttttaaaattgctattgagccctttgttgaaacaaaatattgagcaagtgtaactgtaaaagagatattgatgtatttaacaatgttgaattctaaaatagcagtgtctttttttttttttttttaagacagggtcttgttctgtcacccaagctggagtgcattggcactatctcagcccactgcaacctctgccccctgggctcaagcacaatgtcattatcctaaccagaatttcttatcttatgtttttcagacttgcttctaggcacagattattgacaagcaaaccaggaacttttacagattgtgataagaattaagatagggaatataatagaggataactgggctgctctgagaagccaaggagggccacactgtgagtggggtcaaggctgagacttgaaggaggagaagatgccagccataacaacagcatgctaggcaaggtgactctgtaacacagctttggggaccctcctgaggcctgcctgtgtggccctttcttctgttcctagtttttgtagaagaaagtttaaaaatcgctgatttgactagtccagccttctccttttgtgggtgaggagattgtgaaggctagaaggtaaagatatgcaatgacaacctaggttcctaatgcctgataccaccccccacaatatggcataaatttttctactagttatttacagcatttgtttttttcatgagttattttagatgtattaaaattgcaaattatatttattcatcagttgtaatattcagaaaaataccttcacctaaaagaaaaacaaaaacttagtagacaaagatttgtctttaaagtgaaagatatttttaatcttaactaaatgaaatagggaagtaaacagtttgtgaacttctgttttgaaagcaagtgttcctattttgaaacaactgacacattgacatttttacactgattataaatggctttgttactcacagacagcttagagatgtgggtcggtgtgaggagcttaaagtagatcttactgagcccagcttcagagtaaatatgagtagaatcgtaaaagccagaaatgtaaatccttttctttcctttgtaaatcttcctttcctcacttattgtcagaaatatatgcccaattaaaaaaatttggttgctaaaaggtgctgttagtcatgagcattctgtaaagtttattttgaaaataaatagggatgggtttagaagcacagattcacattgccagaattcatacttttctctagccactttcttgctaagtatatctctctgtgtgtatttctttaccttaaaatgggatcataatgtctgtgtcatagggttagtttgaatattaacaacagtgatcagtaattattagtttatttttatttcaattacagttgtttgatgcttgaactagggaacatcaggaaagtttgggattcattaacagcataaaattaggggaaatatttttgggagaggaagctgttactagttctggttttgaatctggagatgtgataacttgactgacttttgttacattttatattttatagcttaataactgcatgtgaaatgattaagtctgtatctagtgttctgttttttgaggcatataattgaaaggtattataattggctgtttaaagcaaatacgttaatttgttttatgccagagttgaatcctatttatctctacatcttttaaggaaagccagtgatgtgtaacatagtattttccttttgagactttataatcagctgctgttattaatttttttaactaacattcatatttttaacataactcatactttttaaaatatgaattcataattcataatagaatttttatatatttttaaagcttctgatttaaaaagcagtatacccaaactactgcctttatgtagttctcttcagttagatcagcatttcttctggctcaatggtgggaactcattcagtggtcgttctattggaactcttaatagcagccacctatagctcgtttccagttgtttcttgttggtttcctctgccaattagacataaagcttctaattagaggccttgactttatgtcttttacattgtgaacatctggctgttcagttatttcttgttagttcattgtgttcttatgttaataaatttgtcttcagtagggaataaccaaaaaattctctggatcctgtgaaatttcagtttgtgttaaaaagtggggggaacaggtgaggaatgggatgggtgagctgagcagagccttttatattcatagtcctttattgtaatgagtttatcactttacttagagacattctaagtatactgtgtcagtaattctgttggagccattagctctgatcttgatattgaaattccactataagccaggactagagataacataaccagaaaaaggtcatttgcatcagtaagtacaaatgccagtgcttattgtacctgagcaaaaaggtgggacatcattcatgctttcagtatttattgaatattctctatatgccacagactggttaggggatgaatagaagtggagcaggttggcactgtcattgaagagaaacacaggaaatggaggacaggagttttcccaaaataaaatcaggatgtgactgctagactaaggagaaaaggatgcttggcaggcagaaaaaacatccaacgaggtaatgtaatctaattaactagtatcttattctgctgcttgactgtccacttttgtcataccggaacagccaggtacatatgtgggacagtgagtgtcttccctgatttccaaaagaccaacaaatgggagtcagtgaattccatattaagccaaatgaaatatcacatagttgaaattctgcatgtgaaatttgtcccttttctcccatttattcagcaatttatagcaatatgggtttatggatatttattttatactttgggctacatctagtacttcttcattttgttgctcagattgtttcagctttggtcatttgggagctctttctgttgattcttaccttcctttctctatccccatcagtgtaggatttgggtggttttctctattttttactttccggcactataggatgctccattctcatctcgtgtatttcctgcccctgtcctcaaatcggccattgctccaggaagccctggtttcttttattggaaaataatattagaacacaagatctgagttccaggtgtgttctttgctattggcatgtcattgctttaggctcttagagctgacagagcaaggaaatacatgtatgtatactaacctatgaatatacacatctataaatattcttatatgtatgtaataatgtatatgtttcactaaacatgaattcttactgatatcactgactcttaaccattaccacctggatcattttggcctcccccgccttgtttctgtataaattgctcttccaacagtgagacacctggctcccagtatccaccatctgtgtacttaattgttcgatttcagtgtacatgtatagtggcatcagaatggttaacccaaactcccatgggaaaaagcattattaactagaatacattgcgtgtgtatggtttcttttgcctttagtcttacagattctattcatttccagaattacttaggtgagcactctcccctctccccccacttcagtaaggttgattcattcatttgtaatacagttaaattgttttgtcattttatgcattccatcctggagtctcccagtcttctaaataaatttttaaaatttgcatacatttagattcactttttgtgctgtgaagttctgttttgacaaatgcatcatgtcctgtatccaccattacaatttgataaagaatggttttaccaccctaaaatatatttgtgcttcacttattcaacctttcccatctccccctgatctcctagcaaccactgatctttttactatctccataattgtcccttttccagaatgtcatgtacttggaagcatacagtatgtagccttttcttttagtaatattccattgtatagatataccacagtttgtctgttcacctttgatggccatcttgactatgcccagattttggtgattatgaataaagctgctttaaggaattgtatgtagatttttgtatgtaaggtttcaaatcagttcagtcaataccagaagcacgatcgccagattgtatggtataactatgttagcttttaaatatattacctttgcattgctgtttcttggatcagaataatcttttgctattttccctgcccacttcctcaccaaatccctttgactgtggatcccaggtcatatcatcactacaaaaaagcagatgataccgaatttcagctgatcatttcttgggggaaatataatactgtagtgatcttttctatatgcttttgatattttcaattaatctatcagggaaaataattagttgcatcttgttgaatttgactattttgtgctttctcataatataacagtaatggatattttgaagttgatgcatatagcctgtaggttgttgaagttactttattatttgttttattttaaagtatttcttagtttgtaaaattctgaagtattagtcatatttttcttttcaaccatcaccattaagcagtccatttttagatataaaattatattaattaactttaaagtcaaagatgttatgaaaatcaaatttatgttcctgtaagtgatggtatgttttgttttcttcacagcattcgttcagtcagagagcataatagaagtactgcgttttgatgatggagggctactacaggtaatttttttttaagtagacaagttattgttaagccttgaataatatctggttattatttttcttttaaaaatgtaattggtttatctgaaatatatttatattttatgagctttgaagataggtcagtagagtctttagtaatataaaaacctctgtagttacgtgagttttcttttagattaaatatttctttaaaatgcaaactcattgtggtattaaaaccttgtaaataagtacattatcattcttatctttacgtaagaggtgttgagaaatgtaatagagagtggttgcatagtatttgcctagagtcagctttgtatattttaaaactgaataaaaactgaacataatgagctctaattttataaagccttcctactaaaaaatgatcttaagtctcttttttctagttctttaatctgtttcaaggtgagaacttggagaacctatgggaacaaatgttttaaatatctccctttaggtggttgtttataggatctggatggcagacaaatcaggactgaatttctggaaaattccctaagtgtgtttgctctgtattgattgaggaaggatttgtgtctgttaggaactggacatctaggttgcaggttgataatccattctaaaaattctggagcatgatttgtatttttgctgagggaggctgctaatttgtatctagatggagttggctatggaaaagcttgtgaactgggatgtgattcactaatagtctttggatctgctcagatgcttggacaggagcttgggtgagatctcagaattctgtggcaaaggtaattttggtctagaaaaatgttgagggcaagtagtatcaattggttacttaagccacaaaaaaacctaagactcctacagaatgtctaatattgagatgctatataatgtagtatatggcccctaaatagctgaatagaagacccttttgaatagatgtaaaattgttcattttaatgttgaagagtgtttctcagaaacaatttttattttgacataatgttatctttttctgactgtaatttaccaataggtttaacgattttaaataactcctggtttcttatgctatgattagaacagaaaaatgtacatgtagcatttctatggcagaatatatatcctttctctaatttaaatttaagctaaagcagggagagtgtcaaagcaacaaccttgttttacattatttaaaatgtgaattttgcccaagaacattccttcttagatctgcaattcatgtacattcatgtggcttggccatagtaatttttttttttttttttgagacagggtctcgcactgtcacccaggcctggagtgcagtggcgcgatctcggctcaccacaagctctgcctcccgggttcacaccattctcctgcctaggcctcccaagtagctgggactactggcgcctgccaccatgcccagctaattttttttgtatttttagtacagacggggtttcaccatgttagccaggatggtctcaatctcctgacctcatgatccgcccgcctcggcctcccaaagtgctaggattacaggtgtgagccaccgcgcccggccaactcatagtaatttttttaatcctcaaaaatcaactgataagaaatcagtaaaaaaataaattttaaaaattgccaaaaagattagacttgttttctttatttttagataaggaaaattaggtttatggaagttaaataatttattctgtagtactcaattgctagagcaggaattcagtgtccagtaagtaccatactcaccatgtctaatttcaaaactctccacggcacgatgcatgtgcagtgctctcagatattccatgggtttgcacttgttatgaatataaattataacccccatagattatgttttctatagttgatgctttggccattgtcattcctgtttggctggactaagatttagcatccagaatacgtaaagatcagaccgttcctaagatgacacggactctgaggaatctgcatctcaacagaagaaatccacattaaggccataaccacaggatgccctggtcaggtatctcaaaccatcattcccatcctaactgatcagaatggttggctcttctaacctgttcctttgaaagattataaaatggaataacaaaagattctttcatttacaagcataatttaataaacctgaatctgcttcctaatctaactttctttttaaaaaaaatagaggcaggggtggacacagtggttcacgcctgtaatcccaacaccttgggaggctgagacgggtcagtcgcttgagtccaggagttcaagaccagcctgggaaatgtagggaaaccttgtctctacaaaaaattagccaggtgtgttggcacacacctgtggtcccagctactctggtgtctgaggcaggaggatcgcttgagcctgggaggtcgagacttcagtgagctgtgattgtgccactgtactccagcctgggcagcagagtgagatcctgtatcaacaactacaaaaaagtgttccctgagttcaagtcccttaaatttattttgcacctcattttaaaggggggttgagagtcctgagctaaagtggtgagcaaagcccccattattgcccagccattcctcctctaagaggttcacgcccttggccaaagtcctcaaaacctggagcatctcagccccagctccgcattggaatcaccttgagagctttaaaaatttctggtgacaggtactttcctaagggcattacaggaacgaactcacctgggcctcaccagcaactgatggcatggtacccaagggtcccattgtacaggtggtgggatgtggtggggacaggggccaggtgtaccacaggcagggagatggtggctgagctggggtaaaaaatgcatgcctgtccccacagggccagtggacccccatgtcctgaccttggaggtccagagagcacatcagaacttggccagcatacggagctccacagctgactgaccacacagttcatagagacagggtctcactctattgcccaggctggtttgcagtggcgcaatgacagctcactgcaaccttgacctcccgggcccaagtgaacctctcgcctcagactccagagtagctgggactacaggcacatgccaccatacccatccaattttttgtattttttatagagacagaggtctatgttgcccaggctggccttgaattcctagcctcaagccatcttctcgccttggtctcccaaagtgctgggattacagatgtgagtcaccatgctcggcctctaatctaacttttttttttttgagatggggtctcgctctgtcacccaggctggagcgcggtggcgcagtctcggctcactgcaagctctgcctcctgggttcacgccattctcctgcctcagcctcttgagtagctgggactacaggcacccgctaccaagcccgactaattttttgtatttttagtagagacggggtttcaccgtgttagccaggatggtctcaatctcctgacctcgtgatccacccgcctcagcctccccaagtgcggggattaggccactgcgcccggcctaatctaacttttttatatgaagataaagctcaggaaaaaagctagctctgtatttttttcactatcctgccagaataataaatagaattttaaaattttggaaagcaagctctagaatgtttgtgagttgaaaacacaaacagaattttgtcttttttttttttttttttttaaaaaaaagacagtgtcttgctctgttacccatgctggaggccagtggcacaatcatggctcactgttgtctcaacctcccaggctcaagtgaccctcctccctcagcctctcaagtagcggggactacaggcacatgccaccacatctggctaattattcattttttatagaggtaggttctcactatgttgcccaggctggtctcaaactcctgggctcaagcagtcctcccatctcagcctcccaaaatgctaggattatagacctgagccactatgcctggcagaattttgtcttttaaaacttaaagtcctgttttattttatttttatttatttactttttttgagatggagtctcgctctgtcacccaggctggagtgcagtgagcaatctcagctcattgcagcctctgcctcctgggttccagcagttctcttgcctcagccaccaggattacaggcgtgtgccacaacacccagctaacttttgtagttttattagagacagagtttcaccatgttggccaggttggtctcgaactcctgaccccaagtgatccacctgctttggcctcccaaaatgctgggattacaggtgtgagccactgtgcctggcaaaagccatgttttataaatggaattctaaccacttaattagagaacctatattgagccttcttgcaaagagtatacgattttgattcatttattttttttctttaaagtgtttattgtgagatataatttacatatagatgcttaaatttggggagggaatgcaaggcaaatacctgtgtaaccaccacccagattaaaaactaaaaacaggccattaccctccaaagtttcccctcaagctctctcctagttactacccataaagttagccattttccagaattttataataattgcctttccctgtaattttaacatctgagtgtatatctctaaatactacagggtcacatattttttgaagttcatacagtttgtattttttttttctggctcctttttctcagcattatgtttctaagattcacagcattatgtgttgagtgtaactgtagttacttcagtttcattgctgaatagtgttgcattgtatggatatgccccaatttatgtattatttctgctgtttatgtgtattttggttgcttcttgttttttgctgttaagaataatgctgtctcttggtgaacataatatatgtgttcaaatgatttttttctgagggattagaatgcagttgttgggtcatagagtagggatccccaacccccatgccatggaccagtaccggtctgtggcctgttaggaacagggcgcacagcaggtggtgggtgaagaagtgaacattacctcctgagctcagcctcctgtcagatcagtggtggcattagattctcataggagtgcaaaccctattgtgaactgcacatgagagatctaggttgtgcgcgtgccttaggagaatctaactagtgcctgatgatttcaggtggaacagtattattctgaaaccatcccgctaaccccccatccatggaaaaattgtcttccatgaaaccagtccctggtgccagaaatgttggggaccactgtcatagagtatgtgtatcttccattttaatagataatgcatatagttttccaaagtggttgttttagtttgcaaacctgtcatcaggaattcctctgcaacaactttgtaaagtgttttcttccttccctccttctgttctggagaatggctaatgatctgtaatttccattttattttcgtttccctgatttctcataaagctgagcaacttttcatgtttacttgaccatttggatatcttcctttgtgacatccgttaagtcttttacccattttgctgttggtttgcatgtcttttttcccattgttttgtagaggttctttataagttctgaatacaagatctttcctggagccgtaacctcacagcagtaacaaaaatcagttccattacatgagttctttattggttacatatattgaaaatagcttctctcactggatggattgcccttttggcttatgtaatggtgacttttagtgaacaggaattcttaattttaatgaagttcagtctgtcagtattttccattatggttaatacttttttattttgtgtcttgttcaatgtttttctatcccaaggtcgtgaagatattctcccgtattctagaattttactgttttgcctttcacagttagctcaaattctgtctggaataaatttttgttattgatgtgagatcaagattttatttcttgtatttgattgtctcagcatcctttattgactatttcccaatgttttctttccctagtatttgtcagtgacaccttattcataaatcaagtgtccatatatgtgtgagcctgtttctgggcactgtattggatttctttggcttatttgtctatcctaataccagggtcaccgttttaatgactatagtttttaaagttttgatatttggtagaacaaatcctgacactttgttattcttctcagtaatgtcttggttattctcagttctttgccttccatatgtatcttttcaattagctttacacacacacacacacacacacacacacacacacactcgggattttttattagcgtcactcagaatctgaagatcaatttggcaagaattaaaaatctttcagaattttcagtattcagtctgacagtctgagacagtatatttttcaacttatttaggtcttctttatctcataattttatattctgcataaagatcttgaacatctttcgatagatttatttctggggctttggtattttttaatactactgtaagtgacattttttcaaaatgttcgctttttgtcattattaggttgaagcatattgctgatgcccggcctttattgatctataaaagtggcaatttcatacgactcaacataaaatgtagaaatgtggttgcttttaatatatttgctgtgtatcctgaaaacttgctaaattacttattgattctaataacttagctgtagatgcttttgaacaacctccataaactatcatctgagcttgatgacatttcttcagtttggcactcaaaatcaactgtcacacattctaccttttctttttcttaccttaactttactagctacagccagtatgatgttaatacagtgctatttagtagtcctctttgacactttcctcatctcagaaatacaacattcaatatttcacggttagatacgattttttcttcactgccccctttgccacccccacccaagatagcctttatcacatgtcagtttgagttctcaacaagatcctgagacagaattaggagtgcaagagattgagggctactgcctgtgaaaaataagctaaagaaagcaggattgggcaaggagagtctcagactgtgatgcagaatctcggccaacccagtggggagctctggagcaaagattgcccattggaagcatcctgcactgggtagagttggccaggccctagtatacctgctgtgctcattcattgtctgggaggagcccaagaagaacgtggccttacctcaaatgccacagttgatcccagagtacataggtggaggctggtagccaacagtgtttttcacaactgaatgccaagttcttccttgtagggagatctgagctgttcatagaaaaaatattggaaatcaaagccaggctgggcgcagtagttcatgcctgtaatcccagtactttgggaggctgaggcaggtggatcacttgaggtcaggagttcgagacaagcctgaccgatatggtgaaaccctgtctctactaaaaataccaaagtagccaggcatggtggcacatgcctgtaatcccagctactcaggaggctaaggcaggagtatcgcttgaacccgggagacggaggttgcagtgagctgagatcgtgccattgcactccggcctgggcaacaaaggtgaaactccatctcaaaaaaagaaaagtcaaagccaaagagatacattctaaaagcaactagagaaaaagagagaccttcaaagaaggtagaattagcctgacagctgacttatagactgaaacaatgagaggcaaaaataatatataataaaatttactgaaaaaatttgccaaactagaattctatacccaatgaaaatatcctttacaaatgaaagtgaaatcgacattttaaaatagataagaatggagagaatttgtcaccagaaaatttgtgccaaaggaaataatacagtctttaggctgaaggtaaatgattttagaagctcagaaacgcaaaggaataaagaacattaaaaatgtttaagtgtgtggataactaaatgaatgtatactttgtagaacaataataataatgttttgactaatgcattgtggcagaacattttggtaccactaaggctaaatcttatgaagcttgacaacttctacctgggtctgtcagttttggaacgtttcttttgggaagtgaatcaccgtgatgtgagaaacttaagccacatggaaaggccacatgtagtcttctggtcagcagtcccagctgagctcccagctgacagccagcatcactttcccatcacgtgaatgagccatcttagacaaccaacacatttgaactttcagacaaatgctgcctgaaatcacatgtaactgcaatacaaaagagactttaagtgagaataaattgttttaagccgctaaaccttagactgctttattatgcagcagtagataaccagaatgcttgatatatcatatcagacttggttggtctgtgttcagttttcttccactgcttcagaaatgcctttttgcatttggtttgtccaaaacaggatcgagacaaggtctacacattgcatttggttgctatgtctcctaagtctcctttatgctatttcccccacccgcctttttgttgttgtttttgttgttgttgttgttaatgaaattggctcatttgtctgtgggatttcctacattctcagtttggttattttcatcctcttggtgtcatttaacattcacttatggtgtgaattttctgtaaactgttagctaaatctagagtcttgattaggtttaaattcatttgtttttcttggcaagaagattttatagctagttgtgcagtaatctggtctttgtctctggtcctgaagatgctctaaatcttggaattttcttaataataagagtgtctttgttattcatgagtcccttggatcacatctgagtttatacctaatgagaatactcaagatgggggttggtcatcagaaaaaccaaccatgttggccgggcgcagtggatcacacctgtaatcccaacactttgggaggctgaggccggtggatcgcctgtggtcaggagttcgagaccagcgtgaccaacatggtgaaaacccgtctctactaaaaatacaaaaattagccaggcatggtggcatgcgcctgtagtcccagctactcgggaggctgacacagaattgcttgaacccgggaggcggaggttgtagtgagccgagatcgtgccactgcactccagcctcagtgacagagcaagattctgtctcaagaaaaaaaaaaaaaagagagaaaaaaaccaatcatgtgattagagggttgggctttgagccaacccaccctcctctagggaagccgaaatgtgagttgggtcacatggtggtcagtgattgaatcagccataccttacctacctgatgaaactggatactgaagcttgctagaacctgctgggaggtaattgaatcatggcggcggttactcccatgctgttcttgtgattgtgagttctcatgagatctggtggttttataaggggcttttccccctttgctcagcacttcttgctgctgccatgtgaagaagaatatgtttgcttccccttccgccatgattgttagttttctgaggcgtcccaagccctgcagaactgtgagtcagttaaacctcttttctttatgaattaattacccagtcttgggtatgtctttattagcagtgtgagaacagactaatgcagatggttagcatcagaattgtactgcagttcactagtgggactgtacattgtctgtatttttcttgaggacatgctatgccagattgccttagatttttaggtcacagattttcttatgtagggacttaatgattctggaaataagatattgtggcattatttctgttgatctaagccagatgttggcaaactttttcggtaaagggccagatattaactacttcagggtttgtgtcccgaatggtctctatcacaactattcaactttggtcatcgtagtgtgaaagctgccgtaacagtatgtgagaaatgggcataaaactttatttgcaaaagctggcagaagactggatttggctcatgggctaatagattaccaacttcttttctaaattgtcttggaaatgggctttaatgttctcccaggagaaaaggaaatggagaaggagctgtgattttgacttgtaaggaggcctagaagtactcatcttttgttttaaattaaaggacttctattataaaagaaatataagcttgtagaaaatttgaaaaatgtgaaaaaataatataagtcatatttattgggtgttgacaagtcaggtactcttctaaattcttaaatacatgagatggtattcattttatgatcattttacaggtgagcatattaaagtgcagggagtttaacctaaccaaataaatgattattaagtgataaagctagaattgaaaaccaagcatttgactctgaggcctaagtttttaaccgctctgcaataacaggggtcattacccttgtatcccactgcctaaatgtactacaaggtagtgctttttgttttttcagttatttttctctctgcaaacaaagctagattttctcactctacattatcagttttacaatattacaactaattttgtactcaaaacagccacttcatgtcatgtcaagttgattacctgtggctgaagagagaagtgggtgggacactagaaagccgtcatcagaggccaacagctctgcagctccttgtagttggcagaatgctgcttttacagactttccccaagggtatttggctagtgagggcagagctggtgtttgcacacaggtttttattttctactttaaattttgagtcttctcagaaatacctgctccccacttcatcctcattttgattctccctttactactatttcctgccctctattgtagtacaataagtggtacaaaagaagaataaatagcgggttcagaaacagccttaaggctgggtgccgtggcccacgcctataatcccagtactttgggaggctgaggcgggtggatcatttgaggtcaggagtttgagaccagcctgaccaacatggtgaaactccatctctactaaaaattaaaaaaaattagctgggcgtgctggcacatgcctgtagtcccagctacttgggaggctgaggcaggagaattgcttgatctcgtgaggcagaggttgcagtgagttgagatcactccactgcattccagcctgggcaacaggcaaaattttattttattaaaataaaataagaaacagccttaaaaactaggaataaagaataccacagaatactaaaatggtatgcaaagtctgaatatagaaagatctcacaccttaaacaaaaactaactcaaaatggatcatggacttaatgtaaaactataataaaacctttagggagaataaaactaagaggaaagcttcagcttacagggctaggcaaagagttcttgacaccaaagaattaataccagatgtgcaatgtataaaggaaagatcgatgaatttaaaacttgctctgggccagacgcagtacctcatgcctgtaattctagcactttgggaggccaagggaagaggagccattgagcccaggagtttaattaagaccagcttaggcaacatagtgagaccttgtctctagtaaaataaaaagtaagtaaataaaataaataaaaaattgtccaggtgtggtggtgtgcacctgtagtcccagctactcaggagtcagaagcagagaatcttttgagcctgggacatcaagcctgcagtgagccatgatcacactgctgcactccagcctgggcaacagagccagactggtctcacaaaaacaaacaaacaaaacctttctctgcaaaagaccatgtgaagatgtaaagataaatatagactaggagaaaatatttgcaagtcacacacctgacaatggacctagtttctggaatatagaaagaactctcgaaactcaatagtataaaaataaaggaaacagggaaaagacatgagcacacatttccctgaaggggaaatacagatggtaaaaacgacatgaaaacctgttcaacattgttagccaccaggcaatgcaaattaaaacccaaaacacaaaacagtgacaacaccaaatactggcaaggatgtggagaaactggatcacgcatgcattactagtgggtatgtgagtgatacagctactctggaaaaaacagtttggcagtttcgtataaatctaaacatgtggttactataattgacctactaattgctctcttggggattctcccaaagaaatgaaaatttatatttgcattaaaacatgtatataaatgttcatagcagctctgtttataatagccccaaactggaaacaacccagatgtatttcagtagatgtactgttaaacagtgatacgttcataccatggaatacaactcagcaataaaaaggaataaagtgttggcacacacaacaacctgggtaagtctccagagaattaggctgagtgaaaaaagccaactccaaaaggttacatgtgcatgatttcatttatatgacctttttaaaatgaaaaaattttagtcatgaataatagaggaatggttgccagggcttggggggaagggcaggaggaagatgagtgtgattataaaagcgacacactggattctcagggtgctgacactgttctgtgtcttgactggtgttcatgaacctacacagcagagaaaattgtgtagaactaaatacatgaacaaacacaaatgaggacatacaaaactgagaccttctgaacaaggcaggtggatcgtaccagtgtcgctgtgctgcttgtgatgttatgccatagtgtttgcagaatgatacagtggggaaactgagttaaaatatagctctttttactatttcttgcaactgcatgtgaatctacagttatctcagtgaagattcatggtaaaaatacaggcacacagagaagcacaggacgcaagacaattagaaagtcaggtaggcccccttttgtgagttaaacattctaaaagtcgctcagcgagatgtcatccattttcactatgagatgatttgcagagaactttgtgggggagattgggttgataagaagtaggattacatgttgagatcttcataatcaaaagcagacctcatcctctaccttcccccaacccagtcctggaggaagtatgtaattttgtctctaaaggtgacagagaagcatagtctcatcgcctgcaaggaaactggctcccaggtatatccctggggaaagctgcccagtatgtaagtaatactcaaatggcgcctggtgtggcttcctggtaccacgggtttgtgtgcatgtgctgcctgtaccatcaagaagcttaaattctagggtgtgcagaccttgtcttatttctaagcatccatgccgtgtgcacaactgccacgtacctcattctgaagtgaatttcattttatttttctaacaagattaaatcttctgtttaacaataatgcagtataaaagtatggccatcttaaaatttgttagcaataatatagccaacttcagctcatgtaagctaaaagttggttttaggcatatgcagttctgtcaaggataggttattgtatgaatgcagtactagaccagatcgaaggatttgaattctaactcttaccatttgctaatttagaacatttagaggcttagtttctttatctgtaaaatgaattctgtatttatctccagtgtgttaagaactgcaaggaccactggaaatacaaacacagttaagacagtaacgcactttgaattaaaaggcaaggagatgttattacaaatgaacatctaaattattgatatctctataaaattgaggttgtagtacgatgttcagtcttggcctgtgtacgttttggaccagataattggttgtagggtagaagaaagagcgtcctgtgcattaccgggtgtttagcagcaggccggactctacacacttaatgttagtggccccctgatttgcgacaaacaaaaatgcctcttagttttttaactcttttagaatttgtccagcatgttttttggtgttaataaaaacccgcacacagagaaatgcttctggacgttgccaaattcccccagggaaacaaaattgccctcggttgagaaccactgagttacagggataaaattatcagatgtgttcgttttataaaagaatttaataatattttaaagcatatcacatatatttttgccgaggctggtctatttgattggaagaagagtccattttcctcccgcatatccccttttggagttgggagtgcattctgagagaagctgtgctcagattatttggaatctgcaccctagtgaggagcgaggttgaagctgaagtccttaagtatgacagaagcatgggtgggaaggtaccgaaagaccaaagaatttggggatggggaggtaggaaaggtgtctccaaactcacatgcatatacatattttccttaacacctgaggtgaaagaacacccctgttatatcttgtctgttctaaagagatgtggtgaagagaatttgcagtgagttaagaatcactaaagtttctgtgattcagtgaaattgcctttgaaacattgtaggagtgtcttatatttgatagaagattaaaaaaatgcatggcatgggcattttctagggctctgagtactcttaatagacccttatctctggatgtgaattcatgaggttcaaaggtccctgccagtcaaatggcaaactatggaatttccctgtcctctagagattgctttactgtctactgaggttgatcatctttttcatatggttattggccatttatttttctttagtgaattgtcttcttgccctttgcttacatttcagtcacaacattggttttcccatttctttttttccttttcactgtcgaattataacagtttttatgtatctttacattgtaaagttattaatgttgtaatccttatttgcctgtttttatccttattcagtgtttatttttgcccattctctgacctttgacatttctgcattttgtattaaattgttatagttaggttccagttgtttgatgcaatccttttgtctttatataaacagttgagtttatcttatttagtctcactgtagatgtgtttaatcttttccatctgctttttatgcattcatattggcttttgttttgtttttaatctcttgataatggggctcaattttcagatatacttttaagatatgtttatgcctttatttctcaaattgcttcagaaacaaaatagtgtctattgtgatcttccttattctcataacacttaaggatgtgttggcatgttctgagatttttattcttgtttattacagttaaatgattatttttctgttttgtggcatatacttcaaaaacaatatttattttctgattttctaactttatttccacagatcctttgcattgagtatctgcttatctttcacaagacagcttcctcatttgtgagtcttcgtatgagtaatttcagtggtcagattctgtcttcatgataatttttttctcctcaagaaagtgcacatgagtgatacacgtcctgagttccttttctgtagacttcatgtgagaccatagcttctcatgctctagaattctgtcataaccattattgatgtataaatgacatacaataaactgcatgtgtttaaattatgtaatttaaaaagttggcataattatgtacctgtgaaattattactacaatcaagataatggacatacgtgtcacccttaaaagtctacttgtgccccttggtaatccctttacgctccttatctttaggcaaccaccagtctgctttctgtcactgtcaggaagtttacattttaaaacactttatataaatggagtcatacagaatgtacttttttgagggtctgggttgttccactcagcataattattttgagattaatctgtgttgttttgtatatcaatagcttattctttttattgctgagtcgtattccattgtacggatataacacaactcatgtgtctgttcacctggatacgtggaagtttgggctggtggaaatttgggctgttccaatactgagctgtaacaaagctgctacgaacatttatgtacaagccattcattgtacggacaaatgcttttgtttctcttgggcatatatctaggagtggagtgatttggtcatatggtaggtgtatgtttaactttgtaagaaattggcttcaaactatactacaaggctatagtaaccaaaacaacatggtactggtaccaaaacaggtatgtagaccaatggaacagaacaaaggcctcagaaataatgacatttatgcagccaacaaacataagaaaaaaaaactcatcatcactggtcattagagaaatgcaaatcaaaaccacaatgagataccatctcacaccggttagaatggcaatcattaaaaagtcaggaaacgacagatgctggggaggatgtggagaaataggaacgcttttacattgttgtggcatgtgtcagaattttcttcctctttaagactggatcgtattcccttgtatgtataaatcacattttgtttatctgttcacctgtcaatgggcatttgggttgcttctaccccttaatggttgtgaataatactgctgtgaatgtgggttcatgcagtatctttttgagcccctgttttcagttctttagggtatatacacagaagtgggattgcgggtcgtatggtaattctatgtttaatttttttgggaaccacaatactgttttccatagtggctacaccattttaatattcacactaacagtgcacaaaggttccagtttcaccacatccttgccaaagatccttattttctttttaaaattttaaatagtagtcatccaaacaggtatgaagtggtatcattgtggttttgatttgcatttccctaatggttagtgatgttgagcatcttttaaagtgcctactggccatttgtgtattttctttggagaaatgtttgagtcctttgcccaccttttagtttggttgttcttctgttattgagttgcaggagttcttgatatattctagatattaatctcatcagatatttgatttataaatattttctcccactgcatggggaatagatgtaattttcataataaaaagttaaagaaatttttctttacagaaaatagaagagctcaaccaataccaactcatttaccacccagactcaacggttattaccattttgctgtgtttgctttatccatacacctccccacacacacaaattattttgccaagacatctcaaagaaaattaaggacacccttacactttacctagtacgcatcttgaaaaaattaggacagttttctacatctgccacattttctgcataaacagtctccaaaatactatttcaaaataatatatattattgggaaaaaataatgctgttttttctcattttgatgtagcagataaccttttgggataagttcactgatggtattccttatagcattggcattttctcgtacatcaataagaacttccatttcttcatcacctgaactacagctgttgcctccaacttcctactttttctcatcttccttatctttaaaacctaaagtagaccaaacttcttcccatgacttccttacaaggcagagcattatctggcctctgcttagccctccagtctcattttctccttctctcccagctccagcagagagacctgccatctgtttcttgaacataccaacctctgctctctatgagggccttcacatgtgctgttttctctaccaccatccatcccactgccacactgctttttttaatccttcaggtttttatgtaaatattgtctcttcagacaggccttccttcatgatgtgtttaagtatggcaactatttattcctgttcacagcaccttttcaatattttgataatcctatttcagtatataaatatgtatttttaaatgactatctccctcacacacaccacccactgtaccttgagttccatgacagtgggaatcattaccaccagcacctggcaagcagttagtgagcagggaacagtccgaggcacagcagcctcacaaagtgattgtcaaaggggctgttctcaggatgtgtcggtttggcacacttttaaaaatccatcgcattactttctgttacttcatgtgtgtttacaatttgatctagtcattgtatgtgatttggagaccaggtttaaccttaaaatccaaatgggtataaaatgaatgttgaaactaaaatagaatattttggatattccatatgtctgtaatataaatatttggcttcagttttttaatcattattttattccttttacagaccgagacaacacttggactcagttcatatcagcagaaaaggtaagtatatttagtaagataattaacatactttcggttccttctgggggattcctgtggttctccctcctctttccccttgctcattttggtgaagaaggaatagcaaattgtaaatcacattatatgattatttctaagtgttgtgtgtgggaaaccaggtttaagtttgaatgtgcacatcatgcaattgtgtagcatgcctcccctgtcgtgtacgaagggctgttactcagctgaaactccccttgctttgtgagaggatcagctgtgtaactccttagaggcttctcttgtggctatccctgcttttgatgtactgaccactgctgcccccagttaccaggggtctgcccgcaggcccccagagaaggatctcagacctgcgaaacccagtcttgtgacttggagagaccgcttttaaatacagcttccctgtgataacagggggatggttttacctcaggtgttaaggaaaataggtacatgcatgtgaatttggagacacttttcctgcctcctcacaaccaaattatttggtcttttgataccttctcacatctgtaaagagacatactgtgctgattctctttctatatgcggtgaaagtctgttctggtgcctaaaggtgagagagagctttctttgagttggataaaacagtccctccagcagctattttgtgttcactcccagcccttaatgattgctccccggaggaccatagatgtaaaggaagttagcttagaagattcagcgtaatggtatagttgctcttcctgtttgccagaaacaactagtcaggcaccagtacctgttctagtgagcgccctttagtaacaattgaacggctggcagtggtgtcaatagggctttcaggtaaggagcccacatcatggatttaagaacccagttattttacagtgtgtgtttttagaagtatgttttattctgtcagtatatttattccttaaatgacagcaaggcaaatttatccttaaaaattattactatccactgaaatcagacacttagctaccaaagtggctatggcaacagaaggtgtccccacccttgctgtcatcactgcagtttccattctgatgtagcaggaacagggaagcatttgttcctcctaggccttcatgtttaaagtacatctatgaatgtctccagactagcgaaatgcagactgcatcaacaaagaattttgctttgagagagaaatataaaatattcagactattaggaggacaattaaaacttcttacctcataaataatgaaaattctttagtattcactattttttctctttttactctttcatctctgcagtaacatggcccttttcccccattgttctgtcattctctctaatattatatgccctgttgggacctgccctgtctgtgaatcttgcccaaatatttaacactggcatgggttgtctccaaaccactgcatgtttagcctgattcctccttggctggaccatctaagaaccctagaactctctaaccacatctagagccaaaataatggtgagaaaaacatatatgttatcttgtgattcttccttgattctttattccagcaattaggaaattagctgtggaattagactgcactacatttacgaagatgaggatgttcattcgtgatcaaaatttgggctttaagtattttcctagtataatgaagaattgacatcagtacataattatattctcatctcatgctctacttatctattatctacttctatctaaaagttagtggcataaaataaccattttatgatgctctcaaactctgtcagaaattcaggcaggggacagcaaagacagcttgtctcttctccatgatctggggactcagctggggagatttcagagttggaaatgacttgatggctgggagctggaggcatgttcattacatgttgatgctagtttctagctgggacctcagctgagctctcaactagaatgcctatatgtaggcctctttgtgtggccttcacatgggctagtttgggcttcctcctagtatgatggctggactccaagagtgaatgtcccagaggaaactagtgaaagctgtatcaccttaatctgcccttggaagtcataatattacttctgctgccatatgctattagtcagcaagtcacttagattggcctagattcaagataagggtggggagaaagagctccgtacctactgatgacaggaatattaggtttgtagacacaatttacaactgtcacattttacattttgtgtgtgtgtgaccaggatcatgagttgggtaaatatttaattcaaattagtatgcagattgggtatgggactgggttaagccctaaaacatgtcttagtgagtccaggatgctataacaaaataccatagactgagtggcttaaacaacagacatttatttctcacagttctagaggctcagaagtctaggatcaagggcttgcagacttgggcctggcagactgttttgatgctgatgaaagactgataaccatatggaccactaacatataccttaggtgtcttgataccccttacaactaaaccctgagaggcttacagcatccgtttataagaccctcttcaaaagcacagctttcttttagagtagattgcattttgtcatttcatcaacacatatgctttataacctcatcagaagtggtgtctccaatatcctccagaggtatttgggtgtgtttaacggccagaggatattggcagatctcattttctacaggctttgtgctacagaggcttatcttgaggagggccggtggcatccaggtgatgcctgttcctctacagagaatttaatacatcaattttatgtgttcagcaatttaaaggaagacatgaacataatgagggaaaatggacagtatgaaaaagaaacaaatgaagcctctagagttgaaaaatgttgtttctgaaatgagtatttcactggataggattaagaacaacctagacattgcaaaagaaaagcttagtgagtttgaagacagtgacagcagtaatttaaactgaagcacagggagaaaaatgactaaaaaacaaataaacccttggtgacctctggtacagtagtagcaagcagtctaacacatgtctaagtgagttcctaggaattgggagagggaggagctgtcaaagaactttaataaacctgaagcaagagtaacacagaaagtcacaccaagccagataatattcaagttgtcgaaaatcagtcataaatagagaaacagccagggaagaaaactaaatatagtagttcaaaagataggaatgactgctggttgttcatcaaggacaaatgccaccccaaaaccaatgaaatgacatttttaaagtaccaaaagaaaaaatcgctaatctaaaacactgcttccagcaggaatatccttcaaaaaaaatgaagacattttcagacaaaactgagaaaatttgcagtagactggcacttttaagaaatgttacaggctaaaggtagttaaccatttgaggtgaaaacacggatcctacgaagaacaaagaccaccaaaaaggcaaaaatatgtggaaaaatataaaaaatgttttctggttaacaaaatgttaatttctaacattttaaaaacaaaaatgattgtttataacatgtatacattgcatatgtgataacagcacaaaggacaggagggttgcatggaagaattgagttgtaaggttcttagatgttatgtaaagtagtacaatattatttgaagttaaactgtggtaatatgaaataagccccacacgaaacattaaaatcaaaaaaaaaaaaagaactatagccaataaactagtcacgaagatagaatgaaatactaaatgaatactcagttgatctaaaagaaggcataaacagaacaagaggaataaaaagcagatgggaaaaatagaaaacaaatggcaatatggcagacttaaacccaaacatatcagaaaccgtagtaaatgaataatttcaacaccaattgtcagattatatttaaaaagcaagacccaagcatattttgtctacaagaactttattttaattttgtatttaatattttaccttttgttttgaaataattttagagaaaagatggaaaaatagtacaaataattcttatatcttcttgacccaaattcctcatttgttaatgttttttcatatttgctttatcactcctaatctctcttttttaactctctccttttccttccctccccatagctacctttttatacatacatgtacatgtatttataatttttctgaagcatttgaaaatcatttgtagacatgatgctattttacccctaaatatttcagtgtatatttcttataaacatgaacattgttttagagatcatcatatactcatcaaattcaggaaattaagactgtctcatactgctgtttaatctagaggcctcattggaattttgtaaattgtcccattaacgtcttttattttaaaaaatttggggtccagggttcagaccctcatatttaattttcacttctctttagtctctaatgtagaactattgatttgtctttcttactctcttagaactttgacatttttgaagagtagatgctgtttattttatagaataacccagatgggcctgggcacggtggctcacagcctgtaatcctagcactttgagaagctgaggcggtggattgcctgagtttaggagttcgagaccagcttgggcaacacggtgaaaccccatctctactaaaatacaaaatgcgcctgtaatcccagctactcaggaggctgtgacaggagaattgcttgaacccgggaggcggaagttgcattgagccgagattgcgccattgcactccagcctgggcaagactccctctcaaaataaataaataaataaataaacaaacaaacccagctagagttttctgatatttactcattatttgattcagaatttgcatttttggtggaatattactgaagtttgtgtctctcccaatgcatcctatcaggaagcacttggcgtctctttgttccatttttctcttataattcataagtgtcttgcagagaagtactttgagactatgcaagtactgtgttttacatgaaactctgactagttttagaatctactgatgattcttgcctggaacagttattgcgctggctgggttttctaaaaattctatcacacttaatctatgtttcttagttgacattctgattgaagttaagattgaggtcacagttcatttttatccaggtatttcaccatcatttgcgctgtcataaaaaaatcgcacgtgcttagttaggtctattctgtgtcatttacgtgtccccagcaatcattgagcacttcttactttctggtatgttaggatgttccaggcttgttttgtaatttccttgccacagccctggaacaacctatttcttgaaagactcctgcttcattttagtggaagataatattgaaaaattaatctttatgtgccatgtgtactcattgctactgtaatgtattaggattctcttagagggacagaactgttaggataaatatataaaggggaatttattaagtattaatttacacgatcacaaggtcccacaataggccgtctgcaagctgaggagcaaggagagccagtctgagtcccaaactgaagaacttgggagtccagcgttcaagggcgagaaccatccagcacaggagaaagatgtaggcttggaggctaggcccatctctcttttcatgttttcctgcctgctttatatttgctggaagctgattagattgtgcccaccagattaagggtggatctgccttccccagcccactgactcagatgttaatctctttttggcaacacccacacagacacacccaggattaatactttgtatcatatccttcaatctaatcaagttaacactcagtattaaccatcacaagtggtgtcattattagtgaggtgtcattatctctagactcttagtaaaaggaagaaaatgtttatgtttatgtgtataaatatgtacagtatacacaaacatattcctattcttgtatctgtgtatattaaaaaccgtgagttactgatgcctccaattttgatacaaaaccagtgttctgtctattctgtttctgtccattctccaacaatgagaaatctggctccagttatctgtctacagtaagtgtattgatttgttcaatcctagaatacagataaattagtttcaaaattgttaactgttacagccataaaaaaagagtacggtgtttagagttcatgttttttctttagtctgagtgtatattgtcaaaatactgtattctaaatttacatgggttataatgttcttcatctttctcttcatccttctcccacccccacacccatctgtgttgtacattttaaatgaagtttagtttatttgtttctctctgtatcccatttaggatttttactctactttaaaatttttttttattattgcataatacatattgatggggtacatgtgatagtttgatacatgcatagactgtgtaatgatcaaatcagggtgtttaggatatgcatcaccttgaacatttatcatttctttgtgttaggaacatttccaatcttctcttctagtgactttgaaatatgcaatatatggttgctaactatagtcactctgccctgctgttaaaaactagggcttattccttctgtctgttaataactgtatacttgagcccagtagcctacctctcttcatcctccctctcacaccaaaaagcaaatgcttcccagcctctggtgactgtcattctactctttaccttcacaagataaacttttttagctcccttctataagtcagaacatgcaatatttgcttttcagtgccttgcctgtttcacttaacataaactccagttccatctatgttgctgaaaataacaggattttattgttttttatggctgaataatattccattgtgtttaatatatacctattttctttgttcatccattgatggacacttaggttgatttcatatctttgctactgtgaatagtgctacggtaaacatggggttgcaggtgtatctttgaaatactgatttctttccctttggataaatagccagtagtggaattgctgggtcaactcttatctctcaccatatacaaaaatcaactcaaaatggattaaagacttatatctaagacccgaaactataaaactacttgaagaaaacgtagaggaaatgttccaagacattgatgtaggctaagattttagggctaagatctcaaaagcataagcaacaaaaatatccccatttaaaaaatttacttttgtgccattatttttttacccactgtcctatatatgagcatttcatttgtttcccgtattttgcaattgcaaacagtgcttcaaagaataatctcttgtgtatgtattttcatatttttgaaggttatattcagggtaaattcctacaacttgaattgctcaatcaaaagataagtgtagctgtaatttgtattgttgaatgtatatgtttagaaatgactaacggttatatgaagaaatgctctgcatggccagtcatcaggaatgctaatcaaaacaaagatgcattatcatctcacacctgttagaaaggctgtcatcaaaaagacaaaagataacaaatattgaccaagaatgtgtagaaaagggaaccctggttcactgttggtgggaatgtaaattaatataggtattatggaaaacagtgtggcagttgctaaaaaaaattaaaaatagaactgctatgtgatccagcaaattcataactaggtatatatacaagagaaatgaaataattatgtcaaagagatagctgcattctcatgttcattgaagcattattcacaatagccaagacagggaggaatcaacctaagtgttcatcagtggacacgtggataatgaaaatgtgggggtgtatgtgtgtgtgtctgtgtggattcttaatagtattccacacatatatagtggaatactgttaagccttaaaaaataaggaaatcctgtcatttatgacaacatggatgaacttggaggacattatgttaaatgtgataagccaagtacagaaagatgaataatgcatgatctcacttaaatggagaatatagaagcagagagtagaatggtggttaccagagcttgagggtggggaccagggagatttgagagatgttagtcaaaagacacaaaatttcagttagaaggtgtaagttcagcttagcagtttttggactttatgatggtgccaaagcacagtatatgttcagtagaaacagtatttcacattttgaattttgatctttcctgggctagctgtacaatactcttgcagctttcagtcagccacacaattcagagagtaaacgactgatactctacctgtaccatgttaccagatgactttgcccaacagtagtctaatgtaagtgttctgagcatgtttaaggggagactaggctaccttaaaagtaagttggtgtattaaatacatttttgacttgtgattttcaacttatgatggatttattggtatgtcacctcatcataagtcaagaagcatccgtattgtgtacttgaaaattgctgagagagtagattttgtgttcttaccataaaagacaactatgtgaggtaatgcatgcattagctcaatgtagccattctacaatgtgtacatattttaaaatatgttgtacatcataaatatatacagttttcacttgtcaaatagggaaagggatagatataaagtttatgtgtaggataaattcctggaagtggggttggtgagtcaaaagtaaatgctgacattgtttcattaagcattgacagattctccttcaaggtctgtgccaccttgcattccctcattggtgaaaaaaagtgcctgtttcccacatcctttccaacagaatgtgttacattttttatttttgctgatctgataggtcagaaattttatcacagtgtagttttagtttgtctttaattatgtgtgaggttaaccatctcctggtatttaagagccatgcttatatttgtctcttgatgttgtctcttcataactgttctacccatttttctatagtgcttttaattttttctgattcagttaagagttctttatatattggagatattagtcctattttgcaagtgtcttctcctgttcatcagtagtcttgattttgaagaaatacacttcttcgtaagtatgcaagtaggttaaatgtaaaaagacctaggaaaacaagtaaacactaatctttaaaatgctgggatggttatgttactctcagacaaagtagactttaggacagggaatattatcagagataaagaaggacattttacaattatgaaggagacagttccccaggtagatacaacaatcccagattctaatattggagctttaaagtacgtgaaggaaaaaaatgaataaaactaagggaagatttcaacattcatctgttagtaactgataaaatagatggaaaatcagcaagggtgtagatttgaagaacactattaagtaacttgacctaataggtatttattaaacactacatccaccaagagcagattatatagattatactctctgattatagcaaaattaaattagaaatcagtaacaatgaaaatccagatattttataattagaaattaaaccagaagcttttcaatactcatgggttaagaaagaaatcataagggatattagaaaatgctttgaaaacaaaagtacaacatatcttagtctgcttgggctagactgccataacaaaataccataaactgggtggcttaaacaatagacatttattttctcacagtttggaatctggaagtctgaaatcaggtgtcagcgtagtcactttacactgagacctgttttcctagcttgtaggtggcagccattccactgtgtaactcacatgccctctttgtgcacatgtgtgcatgggggctttctggtgtctctttttgtaaggatactaatcccattatattagggcccccaccattataacctcatttaaccttaattgcctgcttatagaccctgtctccacataatagtcatagtggggattagggcttcaatatgtgaattttggaggtagcgggtggggtgggggagaattcaattcatagaacaacataccaagttttctggaatttagccaaagcagtatttaaatagacatttatagctttaaaagtttatatcagatagaagaaaaattttataatgaacaatttacatttccagtttaagacatagagcatcagctttaaatagaagaaaataaaggatatactagaaatcaattaaatagaaagtgaaaaaaaatcaatgtaaactaaaactgattctttgaatgtagctagattggttaagaaaggcagacaaaaaaaatcagtaatgaaataggggatatcactacagatcttataaacattcaaagaataagagaaattatgaatcccttcattctcaaattcagcaatttagatgaagtggtcaaatacttgaaagatacaaattattaaaactaaccaagagagaattagaaaattagtttttaaatatctgttaaagacatagaatttacagttttaaacctttccacaaagaaaactgcaggctcatatgactaaactggtaaattcgatcagacacctagtgaaaaattactagtcttacataaacgcttttagaaaagaggaatagaatgtccttccttacacgttttatgaggtgattattgcaggcattaaagaaagctagaagcgacatctcttcaaacatatattcagaaatctctaacagaatattagcaaatcaaatccagaaacgtgataacagggtaatgcatcatggccaacagggttttatcctaggaatgcaagattattatttgaaaacaatataatttttcttgttaacaaaattttaaacgcctttgtaattatttgaatagatgtagaaaaagcctgtgacaacattcagcatctgttcagcacattaagaatagagaagaatgtctttaacctgataaagagtatctatggaaaagtaacagttaacatggtattaatggtaaaagattgaatgctttctttctaagattgggaaagtggcaaggatgtccactttcatcacttacattaaacattgtactggatgtggtagtcattacattaagacaagaaacagaaataagagccatcagattggaaaggaaaaacaaaaaggattttgtctacaaaccatgtgattgtgtgcatagaaagtcctaaggaatataccaaaaagtaatacagtcagtaatcagaagtaactgatttcttcataacaaatacaaaaataaaatgttgtagaaaaatgtgatttacaatggcataaatcactgcatactttgggataaatttaacaaaaaaaatgttgagacctgtacactgaaaactgtaatataatagagtaattaaagaactcctagatatattgagaaagattccgcgttcatggattagaagactgtgaagatgataattctccccagatcagttttagattaagcaattccaatagaaatttcaacagacaatttttttttttagaaattgataagctgcttttcaagattagatggaaaacgttaagcatctagaatagaccaaacaagttttaaaaagaaaaacatcagaagatttaaactacatgttttgaagatcaagtttaaaacttcttgtccagatgtgtcaaggtaattcaatggcacaagaatactccttttcagcaggggttacaatcctagtctctgatgaaacagacttgaaaccaacaaagatcaaaagagacaaagaagggcattacataatggtaaagggatcaatgcaacaagaagagctaactatcctaaatatatatgcacccaatacaggagcacccagattcataaagcaagttcttagagacctacaaagagacttaaactcccacacaataatagtgggagactttaacatccactgccaatattcgacagatcaacgagacagaaaattaacaaggatattcaggacctgaactcagctctggaccaagcaaacctaatagacatctgcagaactctccacccctaatcaacagaatatacattcttctcagcaccagatcacacttattctaaaattgaccacataattggaaggaaaacactcctcaacatatgcaaaataacagaaatcataacagtttctcagatcacagtgcaatcaaattcgaactcaggattaagaaactcacttaaaactgcacaactacagggaagttgaacaacctgctcctgaatgactactgggtaaataatgaaatgaaggcagaaaaaagatgttctttgaaaccaatgagaacgaagacacaatgtaccagaatctccgggacacatttaaagcaatgtgcagagggaaatttatagcactaaatgctcacaagagaaagcaggaaagatctagaatcgacaccataacatcaaaattaaaagaactagagaagcaaaagcaaacaaattcaaaatctagcagaagataagaaataactaagatcagagcagaactgaaggagatagagacacaaaaaacccttcaaaaaatcaatgaatccaggagctgtgtttttgaaaagaccaacaaaataaatcactagccagactaataaagaagaaaagagagaagaatcaaatcgatgcaataaaaaatgataaaggggatatcaccatttatctgacagaaataaaaaactaccatcagagaatactataaacacctctacgcaaataaactagaaaacctagaagaaatggataaattcttggacacatacaccctcctaagtctaaatcaggaaggagtcgaatccctgaatagaccaataacaagttctgaaattgaggcagtgattaatagcctaccaaccaaaaaaagtccaagaccagacagattcacaaccaaattcaaccagaggtacaaagaggagctggtaccattccttctgaaactattccaatcaatagaaaaagagagaatcctccttaactcattttatgaggccaacatcgtctgatccaaaacctggcagagacacatcaaaaaaagaaaatttcaggcaaatatccctaatgaacatcgatgcgagaagcctcaataaaatctggcaaaccaaatccagcaccacaccaaaaggcttatctaccacgatcaagttggcttcatccctaggatgtaaggctggttcaacgtatgcaaatcaataaacgtaatccatcacataaacagaaccaacgacaaaaaccacatgactatctcaatagatgcagaaaaggccttcgacaaaattcaacaccccttcatgctaaaaactgtcaataaattaggtattgatggaacatatctcaaactaataagagctatttatgacaaaccaacagcgactatcaagctgaatgggcaaaaactggaagcattccctttgaaaactggcacaagacaaggatgccttgtctcaccacccctattcaacacagtattggaagttctggccagggcagtcaggcaagagaaagaaataaagagtattcaaataggaaaggaggaagtcaagttgtctctgttcgcagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatacaggtgatgggttgatgggtgcagcaaaccaccatggcacatgtatacctgtgtaacaaaacttcacgttctgcacatgtaccccagaatttaaagtatattaaaaaaaagtctttttcaacaaatgatagtaggcctactggatatttacagagaaagaaaaagtgaactttaatctttaactcacaccatcgccacaattaacttaaaacagacaataataaataggctcatgtctaaaagttaaaggtttaaaatttttaggataaaaccaagcttttcatagaaatatttgcaaactggacaaagctttaaaataccaaaaacacataccataaaagaaaaaatgaggccaggcacagtggctcacgcctataattctaacactttgggaggctgcagtgagaggatcacttgagactaggagtttgaaactagcctggggaacatagtgacaccctgtatctacaaaaaataataataaattagctagttgtggtggtgtgtgtctgtagtcccagctgcttgggaggatgaagcaagagggtggcttgagcccaggaggtcaaggctgcagtgacccatgattggaccactaactacactccagcatgggcgacagagtgagaccctatctcaaaaaagaaaaaatgatcatcatttcgacctcatcagaatttaaaacttaggctcttcaaaagacaccattaataaaaggaaaaggtaaaccaggaccagggtaaaaatatttgcagcacgtaacagagaactcttacaactgaataataagacagacattccagttaaaaaactttccacagacgtttacaaaagatacctaattgtacaccaagtaaatggaaagatggtcaacattattcatcattagggaagtgcaaattaaaaatgtgtttatgggagaatatatatcatataggagaagtcttattcatttaaatcactgtttatttagctggctctttaataaaaatcatatttgaaatcaatttaaactgctggtgactttgatagttttactggttaaggcacttccttccccacctcttatttgtggctgtaatgtttgtggatcaagatgcaaaatagtggctcctaaatgtgagggtgcttaaaaatgcaggtttctggggtccattctgcttacaaggaattagattctggaggtggggccccagaatctgcatttccacaaacattgtaggtgtttatgatgcaaatacatcacaaacaattgttttaaaaatgctgggccaaagagtatcttttgtttaggtagtagttgatcctaggaaaacattttaaactcccagagacccaagaagcccatatgtttgatttgggagtttcctgctcaactttgacctgacagttcaacaagcagtatgaccatttcccacaagatttcttgtatctcttcagttgtttcctagcttgaaatcagaaaatagtcttcattcatctccatataaataagattttaggaaaatttataaaaccaattgtattgacacttcagaacatgtgtaatcattgcagaaagcataaaataatgcaatatgctatcataatgtctcagattttgttgctttgaaattgtcaaagggtgagcccagcacactggcatgctgcatctgtagtcccagctactcaggaggctctaacacaggagtttgagaccagcttgggcaacataacgagacccctgtctctcaaaaatagtaataataataattttaaaaatcagggaaaaaactgcaatgatattagcaaaggccaccactctttatattgcatcttccctagtttgtttttcaatattacatatttgcagacatttgctttctgttaataaagcactaaacagtgccatgttaaataaacgtggataggaaccatttgaatcagctgtggagacagctgtgttactgcatttttggtttggttaacataggattgtacctgtgtcaacttgtatcgtactcactcggatattaaactgttccttagatatagatctggtatggttttgaaaatatgcttttatttatgagggaatcatatttgatgtactgtttcttctatatcattctgtgagcactttgtaaatatcacagtaacagttgctggacatcacatctttgaagcattttacaggagatcttagcacaagacataaaaaataaaacttatctaaggatttgaaaggaagaatcaaattgttacttgcagatgatttgtctacagtgatcatccaagatagtgctcattttggcagcacatatagcagcagtggaaaatcatgagagaatctagacagactgttggaattaaactcaccaaggtgactaggtataagatcagtacgtgaaaattagtaactttttaatatgaacagtatccatgtatagttactttatgacatctccatctagataagacatctaaatttaaatgtctaaaacaatgctcttgaaaatctacctcttcccacttccaacccactcctcccatgtcatgactgtgtatccagtgaaaatcttagaatgagttatccttgatccctcaaaatcaatccatcagcacaacctgttttctcaagcttccaaatatattcagaaaccagccactgctcgctactctcccttgcagccaccctagattgtatctgccgtcaccagttgcctggagcactccaggacttccctgcttcccactgttgggctcctacaggaacttccttggtacttcacaaagtagccagaattaaccttatgatatgtgtcagatcatgctactccttgctcaaaaacactgtagtttgttacactttgaataatctatactcctacaaggagacctggctcttgtacctctgagctcagctcctacctcctactcctccctcactgcacagtggtcacttcagcctccttgttcaactcgccaaatacattactactttcttcccctagatctctgtcgttcaggtcttggcagcagtgtccctcctcagagaggcattttcggttctaaacacagccccgccgtgtttgatttttctttatacacacattttcacctaacatattcaacttttgttccccctactaggaggttagtgccatgagagcaggtgcttttctttattccccactgtagccccagccaatagacggtaactggcatatagtaaacattcatacatttgtattgaatggatggggtatatacttttttaccccacctggccactttagacatttccatttgtaatttgcagaacagcctcttggctctgtgagagaaaaacactgtatcttaatttcctttttctccaacatctaaacagtccatggaattaatatataggaattatatattatatataggaatatatattacattataggaatatatattatatataggaatataatattatataggaattaatgacatacagttatgccttatactttatttttccttgatttgattaagatttatgtaaatttgagtttcatactaatgaaactaatgagctgaggagcatctcttgttttaaaggcgccaaagaatgtttttgttacataacatctaagaaacagacagggcagaaagcaggaaggaatagatgccaacactgtgttgcaaggaattgtgccttcatgtcccggtgtctttagtttcatgctttagtaaaatataatcttacttttggtgtttgctttctttttttgtttgtcatcttttctgttcaacatatgcagagggattcttaagctacacaaaagaatgttctaaattggtagggctaaaaacatgtttggattttattaccttcagctaaattattccactactcagattatttaatctttatagaattgaattaaagccaaatttcctccatattatgaatgtccttgtctatttctaattatttcttgtatctcctaaatcctggatatttcctctgactccttaatcctgaatgaaattactatatcatttcaaagcttacgttactatgaatttcagtgatgatggaaataaagtagtctcacaaaatgggttttgctctgacatcatttcctagaacaaaaacatcaaaatctactattttgaaacttagtgcctgactgaatttctgactttctgactgaatttctgacactttaggcatgtgaaccaccaccactactccccctaccccaccaaaagtcatttatgttttatatcagcgttaggccctgatgttgtctgaggtttgctattcagaaatctgttctattgagaagttctggtatcaggtgggttagttagaagatgctactgtaatatggaggccaggacatcagagatcagttctagtgtattccaaactctcagatgaaatagatatttcaattcttggaagtttgtatcccaaattcatttttgtttagtcctttgccactctagttacaatctgattgtgatttttgtcttcatatattgtctgctaaatgtatgtaagttgtattaactctttattcatcatacatgtatcagaaaatccaagcgacctattaaagtatatcgttaccaattataccaaccaaataaatttcaacattcagtctgcctgagcattttctatttgcatatacctttgaagaagaaaaataatcccactttttcattttctaaaacgcaatctttattggtttctgctaatttaaaaagtgacgcacatttctgatagattgttagacccaatttttcttaaaatggcattgttatgacaaaagtcagctgtctgaatagagtttggggaaacatatattttgaagaattgcttcttatgttgttttctttttatttacagtatatctctctaccgggggaattgcaggcccatacgatttgagccaccaatgctggatttccatgaacagtaagtttaaaatttttggactgtactttcccattaaactattaaatgtattttacatgcatttgtcttgtcttttgcctgtgttacatctatgtgggaaagttacatgttctagtcatcaggaaaacaaatgatactgaatgcagtttgaaaatgggaagtaagtatctattaggagtctaacatgtaatattaacttttaaagcttgaaaaatactcgcttgttgtagtctctggttcagagactctttggaaacagcaaagaacttatagttagctgttttgattagcacttcatttttatttttactatttaaaaatcttcttatgaataaaatatattctatttgtttaatatatgtgcttttaatagacaagctcttatatatcaccaaatagtattatcaccaacccataatggcaggtaaaagcaaacgcacagacagacatggttcattcacagaactctgccttgatgagctaagcaaaccactgcacaccctcccccaagcaggagagacccccgggcctctaagcagctaatatacccaagggccagcaaagcagctacatacctgcactcagcacctaagaaagagccccacagtgcacccccaagatatttccttggcctgcccaatggccctgcacctgaaatcagggcctgaaaaacagccctgtgggcaaccaccggcagacacacctccagaccagctgagcatctctgtgcctgtgtcaggcctaagaaatagccctgtgggtcgccactagcaaacatgtccccaggccagccaagcagctttgtgctcacatcatggacctgagaagcagctgtataggctgcccctggcagacacatcctcgggccagctgagcagacttgcaactgtgtcttggacctgagaaacagccccatagggcagacacacttcaaggccaactaaacacccatgtgtctgcacccccaccctgagaaacagccccatgggtcaccccaagccaacagacacccaagccatctgagaagccatgagactgcatcccacgcctgaaaaacagccctgcgggccatccctggcaaacataactcccagttcagctgagcagcctcagcgagctcctatatgtcccttctcagattctccaaaaagagttttttcatcttgctgagtcaaaagaaagttttaactctgtgacataaatccacacatcacaaagcagtttcacagatagctaggcctgagaaacagccctttgggctactcctggcaggcatacacccacaccatccaactaaacacatgcttgtgctgctgtccagagtaacagccctgcgttttagagccagaccctaagttggccagattccaagctgcctgacccactgtgtggatgcacacatccctgacctgagaaacagccttgtgagcccaccctcaacaaagctgcaccactaccaccacagactctctcagcctaggctactgagatacttgcagacgtcaagtgtgactgacagctgaggaaagtacccagagactacactacagtgcccacctagacacagatgcaccaaagccaatgcaccccaccaatctgacactccaagacccatttataagaataagtctttccctgtgaaatgtactccataaaattggaagaaatgacttttctaccagatgtatagaaatcaacatggggacacatcaaacacaaaaaagcaaggaaacatgacgcctccaaaggaaaacaataattcttcagtaacagaccccaatcataagaaaatatactaaatgctagagaaagaattcaaaataatcttaaagaatctcagtgagatacaggaaaacttacagttcagcaaaatcaagaaaacaattcatgatttgaataagaaattcaacaaagagacaggtaacataacaaagaaccaaacagaaatcctagagctgaagaattcaatgagtgaaataaaaaatacagtcaagagcttcaacaatagactaaaccaagcagaagaaagaatttctgaacttgaagacagatcttttgaaatgacacaggcagacaaaaaaagaaaaaagggtgaagaaagcctacaggatgtattgtataccatgaagtgaacaaatatattatggtcattccagaaggagaagagaaaggagaaaggcttagaaaacatacttaatgaaatagtagctgaaaacttcccaagtcttgaaatttgagatggacatccaggtccagtaaactcaaagaattccaattagagtcagcccaaacaggttatctctgaggcacattatagtcaaattatcagatgttaaaggcaaagaattctaaaagtagcaagagaaaagtgtcaagtcacatataagggaattcccattaaactaacagcagatttctcagcagaaaacttacaggccaggaaagaatgaaatgatatattaaaaatactcaaagtgggggtgggggacctgtgagccaagaacactatataccctgcaaagctacatttcagaaataaaaaagaattaaaatctttcacaaacggccgggcgcggtggctcacgcctgtaatcccagcactttgggaggcgggcggatcacaaggtcaggagatcaagaccatcctggctaacatggtgaaaccccgtctctactaaaaatacaaaaaaaaattagctgggcgtggtggcgggcgcctgtagtcccagctactcgggaggctgaggcaggagaatggaccgggaagcggagcttgcagtgagcggagatcgcgccactgccctccaggctgggtgacagagcgagactccgtctcaaaaaaaaaaatctttcacaaacaaggagaaatgaagggaattcatcactgctagactggccttacaagaaatgcttaagggactcttatatctggaaatgaaaacataaccaccattatgaaaacatgtgaaactataaaattcactggtagagcccaaatacaaagaaaggaaaaagaatcaaaccgtatcaatgtggaaaaccacccaagcacagaaaaaccataagaaaagaagtacagaacaaaagataaaacatccagagaacaatatgacaggaacaagtctttacctatcaataaccttgaatgtaaatgggttcagttcccccatctaaaagatataaactggctgaatggataaaccccaactatatactgcctgtaagaaactcacctcatctgtaaagtcatacagactgagagtgaagggaaagaaaaagatacttcatccaaatggaaaccaaaagccagcaggagtagcattacttacataaggccaaacagacatcaagtaaaaagctataaaaagcaacaaagaaggacattatgagataaagggatcagttaagcaagaaaatataacagttggaaatatatatgcacctagcactagagcacccagatataaaaagcaactattagatctaaagggagagatagaccccagtacaataatagagttggggatttcagcagtccactctcagcattggacaggtcatctagacagaaaatcaacaaagaagcattggatttaaactacaccatcaactaaatggacctaacagacatttacagaacatttcaccaaaaagctgcagaataccatttctttcgtcaacacatgaagcattcttcaggattgatcgtatgttaggacacaaaatgaatctcaaaaaaatttttttaaattaattttatcaactatcttatctgaccacaatggaatttaaaactagaaatcgataacaagaggaacattcaaaactacaaatacgtgaaaatcaaacaacatgttcctgaatgaccaatgggtgaaggaagaaattaaatggtaaactaaaatatttcttgagacaaatgaaaatagaaatacaatataccaaaacctatggggcacagcaaaagcaatattaagaggcaaatttatataacaataaatcctacatcaaaaaactagaaagatttcaaataaacaacctaatgatgcatcttaaagaactagaaaagaacaaatcaaagcctcaaaattagtggaaggaaataagtaagatcaaaatcaaaatgaatgaaattgagactaaaaatacctacaaaaagtggggaacatctgtatttatttgttgagttacaaaaatctaaccatattatctcaatataccatttttataacaatatattgtgcatacttcaaaaaattccattgaattttctgttattttataataaagaacatcaaaatttatgggtatattatatttgttaaattcacttatttttaattgttttaaactttttattttgtgatcagtgctgaaactgatgatttaaacacaaccatgactatttcctttcctcaagagagagtcctaatggaaggatatacagaatattaaagattttaattaacctttagcctagagaacagttcggtgtcatgaacaaggagcaacttaaagaaataaaagaatcagtctatgacaagtgaggaaataaatgggatttctcatagagactgttactagtcatagagaacctgaaatctcatgagctgagagaaattgtggaagatttgtggaagaagtgtgaatgggtagatgaactccagtacaagcaagggtcagttgacacagtaaagaaaatttatttgaagcatagcaaaggagtatagttatataagactgttccccaaagcagcggatttacatgctgctccaaaatagtggaaacagacaaacaaacttcgctatagtctgaatgtgtcctcccaaaattcatacattgaaacctaatctctgatgtgattgtgttcagaggtggagctttaggaggtgtttaggtcaggagcgcagacctaatctcacaaatgggattagtgaccttacaagagaggccccatagagctactgtcccctttctgccatgtgaggacccagctagaaggtgtcacctgtgacccagaaagaaggctccacaccagaacccaaccatgccgacaccccgatctcagatttcccagcctctagatctatgaaaaataaatttgtcatttattgtgctatagcagtccaaaaggactgagccaccattctactattatttaaaactttctggatcaagtcagagaacactgagcggagtttgttatatctcgcaagtgtagaagtggatctgtagaagtaggggttgcaggcaggtgtgaaccaacatgtgtaagggttcaatcagaggcagaaccagtcagattttaaatgaatgtatatgtatatatacacgcacatgggtttataataaggaattggcttatgcatttgagagagctggttaagcaagctcaaagcccacagggccagggagtcagtaagggaggatagcgggctggaaccccaagggcacagactgaagtttcttgtccacagataagtatccagggaagatcctgaggagaggagagaaattgcaggtctagctgctgtttgaagcctcttggctcagacagggcctaagctttctttgaaagtgcttcccagtgacaaagtcacagactcacctagaataatcgtttttattaacttgaaatcagcctattagggactttaattatgttggcaaaatctctcccagcagcacttaggttagtgtttgaataactgggaaaaggtatattatgctacaaaatagctgctgtctcacttttctcttctgtctctaaggagataatattacttttaactcaccctaaccagaaacatactagaaagggagttctggggactttagttcaagtcaagttgatatcacaaagctaccccatagatacaaacaaagaggttcctaaattttgaacttctgactctagaaaatgaagagagatatggttgaaagaatttgcttagtaattttaaggtaaggttctttttgtgaaacttgaaagtagtcttgggacaaagaaaatgaaatttgtacattttcactgcagaaagtaaattatcaatgtcttcagaaagtgactgctaaaggaaaacagatattttagaatagatcctcttttaaagttattgtatgttttttccactctcagaagcatacaacttgttgattcaagttttttcctgcattaactgcatttatttttgcccccacaaatcactgctctttttaacatgaatgttattaagtgaaaaaagattagaatactgtaatacagaatggcccctcttaatacctgttagctacctattcaacatctacctcccccgccccccccccttttttttttttttttgcagttatccagcctttaggcctggcaccctgtccctagctcaggggtaaatcttgataagtcagttgtaataattccattattattgcttgtggtctgttcaagggtgagtgtgacccagttttactctgtaacaggagggcaggtcaactgaggtgtttctggggaaggattgttttttttactctaaaaagagtcacagccagatgctgtggctcacgcctgtaatcgcaaccctatgggaggccgaggtgggaggattgcttgagctcaagagtttgagaccagcctgggcaacatagtgaaacccaatccctacaaaaaattttaaaaagtagctgggcatggtggtgtgcacctgtagtcccagctattcaggaggcagaggttgcagtgagctgagatcacaacagtgcactccagcctgggcaacagagccagaccctgtctcaaaaaaaaaaaaagagtcgcaagaaagaaacgcccatcttctatgccagatactgtctgcatgcagtgcctaggatactgcggcaatcatcttgcaatcagtgaggggttctagccggaggactgatgccatgcagtcatgaaaggcaactggtctaacagagtggaaagatggaaagaacctgcgtctttcataatgttgtcgaactgctaaattaaccctggaactgccctactttaggtctttttgtttggtgacactttgatctgttggagagtgcatggcacctggcaccactgacttcttcctccctctcagatctttccctgcctatacccttgtgaaccattgtccatgttttcctcctgtgcctgaggctatttttaaaattatctttcaagggtttatgttcctctgtgtatccccaaattgtggttgtgtgcggctgcatttctttcttcacctcatttcaaccaactctgcgctttcttactgggtgggctcttccatgcctttgacatatgcctgtaatctcccaatctctgtcatcccccctcacttaccatgtgtctccaacaccacactaaactcaccatgtcttgctcttctgtatctccagtccatgaacggtaccacagtcaccaaagccagaatattcaggcttcctggattcctccctttccctcacagcactccatccccttcctgtcaaatccattccaggaaggaatcctatgaatttttcatgtctgttctgctctaatcctcactacttacccctctcctcttaactcaggtccacatcatttctcatctggactgttaccatatgcctgccactttctagtcaggattcatgctgtcaacagggaaatgtttttcacatcaaaatctgatcatgtcgtttttcccacttcccctcccccaaaattcctttaatggtttcctatttgccttcaggataaatgctaaattcattataaaacctgcctttttaccttccttatatgtcctccacacctggggagaactacatgtcatttcctgaaagcactgatcttcataagggctgggcgtgttattcataccttgagtctcccctctaaagatagttttttatggaagttttcatacatataggaaagtagaaagaacaaataatgaatgtacttttaacataaactcagggattattgccatttttgcatatttatacttctgtttttgaatcatttgaaagcagcagacctcatgacctttcattcctaattcttgagcacacactgccatacagttgatcctttaacaacatggcaggttaggggcacggactccccaccacactgcgtagttgaaaattcacatgtaacttttgactccccaaaaacttaactactaatagcctacttttgaccagaagccttactgataatataagcagtcagttaacatgtattttgtatgtaataggcattatatgtactgtatttttaccataaaggaagctaaaaaaaaatgttaagaagacagtaaggaaattctcattcattaagtggaggtggatcatcgtaaaggtcttcacctcatcttcacattgagtaggctgaggaggaagtgatagtcttgctgtcacaggtggcagaggcggaagaaaatccgtgtggaccctcatagttcaaacccatattgttcaagagtcaactgtataaggacattctgcataactacagtaccattattgacattgtgagaaaattaatagtaattatggagtgcttttaatctccctctgttttggtcaaggctgtagttatttggttgtaagtgacagaaacctgaaattaactgaggcaaaaatgataatatattggaatactgaggaccataatatatctgcaggaaagtcagagatgcagctggcacctgggaacaacagcattcacttgctctaacaccaccaggagtcttctgtctcttatttctgcctgtctatgtattggcttattctctctcactgccggtatcctttccctacagcagtgggaagaaattcgctgactgctcttcagccttgcattctgtgtcttcactccactgggaagctctgttgtaaagcaagcctttccccagtctaactagcaggggtggaaactgccttctctctgcttccagggtggtgttaatcctgctgagatgagatggagccccacccaaaatttggttcagatatcaagactgttgatgtcacatatgcacagacaccagcagaatgaaaaagtttattgtactcaccgaatgaagattctaggggatgaccatggtaggcagatgtgagaaagggctggagagagcagagaaggactagattggtttttttgtttgtttgctcattattattattttttaattattatactttaagttctggggtatatgtgcagaacgtgcagttttgttacataggtacacatgtgccatggtagtttgctgcatgcatcaacccatcacctacgttaggtacttctcctaatgttatccctcctctagccccccagcccctgacaggccctggtgtatgatgttcccccctctatgtccatgtgttctcattgttcaactcccacttacgagtaagaacatgcagtgtttggttttctgctcttgtggtagtttgctgagaatgatgatttccagcttcatccatgtccctgcaaagggcatgaactcatccttttttatggctgcatagtattccatgttgtatgtgtgccacattttctttatccagcctattgatggacatatgagttgcttccaagtctttgctattgtgaatagtgccacagtaaacatacgtgtgcatgtgtctttatagtagaatgatttatagtcctttgggtatatacccagtaatgagattgctgggtcaaatggtatttctagttctagatccttgaggaatcaccacactgtattctacaatggttgaactaatttacctgcccaccaacagtgtaaaagcgttcctgtttctccacatcctgtccagcatctgttgtttcctgactttttaatgatcgccattctaactggtgtgagatggtatctcattgtggttttgatttgcatttctctaatgaccagtgatgatgagcattttttcatatgtttgttggctgcataaatgtcttctcttgaagtgtctgttcctatcctttgcccactttttaatgggatcttattttcttgtaaatttgtttaagttccttgtagattctggatgttagccctttgtcagatggatagattgcaaaacttttctcccattctgtaggctgcctgttcactctgatgatagtttcttttgctgtgcagaagctctttggtttaattagatcccatgtgtcaattttggcttttgttgccattgcttttggtgttttagtcatgaagtctttgcccatgcctatgtcctgattggtattccccaggttttcttctaggatttttatggtcctaggtcatatgtttaagtctttgatccatcttgagtttatttttgtataaggtacaaggaagcggtccagtttcagttttctgcatatggctagccagttttcccaacaccatttattaaatagggaatcttttctgcattgcttgtttgtgtcaggtttgtcaaacatcagatggttgtagatgtgtggtgttgtttctgaggcctttcttctgttccgttggtctatatatctgttttggtaccagtaccatactgttttcgttactgtagccttgtagcatagtttgaagtcacatagtgtgatgcctttagctttgttcttcttgcccaggattgtcttggcaatacgggttcttttttggttccatatgaagtttaaagtagttttttccaattctatgaagaaagttagtggtagcttgttggggatagcagtgaatctataaattactttgggcagtatggccattttcatgatattgattcttcctatccatgagcatggaatgtttttccatttgtttgtgtcctctcttaatttccttgagcagtggtttgtagttctccttgaagaggtccttcacatcccttgttagttggattcctaggtattttgttctcttcgtagcaattgtgaatgggagttactcatgatttggctctctgtttgtctgttagtggtgtataggaatgcttctgagttttgcacattgattttgtatcctgagactttgctgaagttgcttatcagcagcttaaggagattttgggctgagtcgatggggttttctaaacgtatcatcatttcatctgcaaacagatacaatttgacttcctccttttctatttgaatacccgttatttctttctcttgcctgattgccctggccagaacttccaatactatgttgaataggggtgatgagacagggcatccttgtctggtgccagttttcaaagggaatgcttccagtttttgcccactcagtatggtattggctatgggtttgtcataaatagcttttattattttgagatatgttccatcaatacctagtttattgacagtttttagcatgaaggagtgttgaattttgttgaaggccttttctgcatctattgagataatcctgtggcttttgtcattggttctgtttatgtgatggattacctttattggtttgcttatgttgaaccagcctttccaccccagggataaagacaacttgatcgtggtggataagctttttgatgtgctattcagtttgccggtattttattgaggatttttgcaccagtgttcatcagggatattggcctgaaattttctttttttgttatgtctctgccaggttttggatcaggatgatgctggccttataaaatgagttagggaggattccctctttttctgttgtttggaatagtttcagaaggaatggtaccagctcctctttgtacctctgatagaatttggctgtgaatctgtctggtcctggactttttcggttggtaggctattaattactgcctcaatttcagaacttgttattggtctattcagggattcgactttttcctggtttagtcttgagagggtgtatgtgtccaggaatttatccatttcttctagattttgtagtttatttgcatagaggtgtttatagtattctctgatggtagcttgtatttctgttggataagtggtgatatcccctatatcattttttattgcatctatttgattcttctctattagtctggctagtggtctatctattttgttgaccttttcaaaaacacagctcctggattcattgatttttttgaagggttttttgtgtctctatctccttcagttctgccctgatcttagttatttcttgtcttctgctagattttgaatttttttgctgttgcttctctagttcttctaattttgaagttatgttttcgattttagatctttcctgctttctctgatgagcatttagtggtgtaaacttccctctacacagtgctttgaatgtgtcccagagattctggtacattgtgtcttcattctcattggtttcaaagaacatcttttttctgccttcatttcattatttacccagtagccattcaggagcaggttgttcaacttccatgtagttgtgcagttttaagtgagtttcttaatcctgagttcgaatttgattgcactgtgatctgagaaactgtttgttatgatttctgttatcttgcatatgttgaggagtgttttccttccaattatgtggtcaattttagaataagtgtgatgtggtgctgagaagaatatatattctgttgattaggggtggagagttctgtagatgtctattaggtttgcttggtccagagctgagttcaggtcctgaatatccttgttaattttctgtcttgttgatctgtctaatacggacaatagggtgttaaaatctcccactattagattgtgtgggagtttaagtctctttgtaggtctctaagaacttgctttatgaatctgggtgcttctgtattgggtgcatatatatttaggatagttagctcttcttgttgcattgatccctttaccattatataatgcccttctttgtctcttttgatctttgttggtttaaagtctgttttatcagagattaggattgcaactcctgctttttttcatttccatttgcttggtaaatattcctccatccatttattttgagcctgtgtgccttgcatgtgagatgagtctcctgagtacagcacactgatgggtcttgactcttttttcagtttgccagtctgtgtctttaattggggcatttagcccatttacatttaagtttaatattgttatgtgtaaatttgatcctgttattatgatgctagctggttgtttgcctgttagttgcagtttcttcatagtgttgatgttctttacaatttagtatatttttacagtggatgctactggttgttcctgtccatatttagtgcttccttcaggagttcttgtaaggcaggcctggtggtgacagaatatctcagcatttgcttgtctgtaaaggattttatttctccttcacttatgaagcttagtttggctggatatgaaattctgggttgaaaattcttttctttaaggatgttgaatattgggcctcactctcttctggctagtagagtttctgcagagagatccgctgttagtctgatgggcttccctttgtgggtaacccaacctttctctctggctgcgcttaacattttttccttcatttcaaccttggtgaatctgacgattatgtgtcttagggttgctcttctcgaggagtgttgttgtgctgttctctgtatttcctgaatttgaatgttggcctgtcttgctagattggagaagttctcctggataatatcctgaagagtgttttctagcttggttccattctccttgtcactttcaggtacaccaatcaaacgtagatttggtcttttcacatagtcccatatttcttggaggctttgttcattcctttttattcctttttctctaatcttgtctttgctctttatttcattaagttgatcttcaatcactgatatcctttcttccacttgaccaattcggctgttgaaacttgtgtatgcttcacaaagttctcgtgctgtatttttcagctccatcgggtcatttatgttcttctctacactggttattctagttaacaatttgtctaacctttttttcaaagttcttggcttccttgcattggattagaacatacttctttagcttggaggagtttgttattacccaccttctgaaacctacttctgtcagttcgtcaaactcattctccatccagttttgttcccttgctggcgaggagttgtgatctttggaggagaagagaccttctgatttttggaattttcagcctttttgtgctggtttatccccatctttggatttatctacctttggtctttgatgttggtgacctttggatggcatctttgagtggacgtgctattcctttctgttagttttccttctgacaggctcctctgctgctggtctgctggagtttgctggaggtccactcccgacgctgtttgccttggtatcagcagcggaggctgcagaacagcaaagattgctgcctgatcattcctctggaagcttcttcccagaggggcacctgccaaatgccagctagagctctcctgtatgaggtgtctgttggcccctactgggagttttctcccagtgaggatacacggcggtcagggacccacttgaggaggcagtctgaccttcagcagagctcgaacgctgtgctgggaggtccactgctctcttcagagctgccaggcagggatgtttaagtctgctgaagcttcggccacagctgcccctttccccaggtgctctgtcccagggagctggggatttatctataagtccctgactggggctgctgcctttttttcagagatgccctgcccagagaagagaaatctggcagtctggccacagcggccgtgctgagctgcagtgggctctgcccagttcgaacttccccgtgacttgtgactttgtttacactgtgattgtaaaaccacctactcaagccttagcaatggcggacgcccctccccccaccaagctccattgtcacaggttgacctcagactgcttctgtgctggcagcgagaacttcaagccagtgaatcttagtttgctgggctccatgggggtgggacccactgagccaggccacttgggtccctggcttcagcacccctttccaggggagtgaatggttctgtcttgctggtgttccaggtgccaatggggtatggaaaaaaaagaactcatgaagttagttcggtgactgcccaaacggccgcccagttttgtgcttgaaacccagggccctggtggggtaggcaccggagggaatctcctggtttgcagcttgcagagaccatgggacaagcgcagtatctgtgccagagttcctcaggttcagtccctgacagcttcctttgggtagaagagaaaattccctgaccccttgtgcttcacagatgaggtgatgccccaccctgcttcggctcgccctccgtgggctgtacccactgtctaaccagtcccagttggaaatgtagaagtcacccgccttctgcatccatctcgctgggagccgcagactggagctgttcctgttcggccatcttgccagcaattggtttttattgcggttggggagcaaggctggagtgggtttgcatgattggaacttctcactagctccgagagagaagggctttttgattggcttgcccaggtttggggctaaaggtaaaggggcatcattggggcttgaaaactatcaacagttgaatatcaaaaatggagttagagtctttctaactcatggcatcttctaaaaagtatcaggcccttcaggaagggtgcatctagaatttcccttgcttctttcttgaccccagtgctgactcctgtcattaccctgatcattcctactctcctgtagaatttgtttcacaataaacagatcaaattagctttctttgttttcagactttttgtttaaatttattctttaagcctacctgtattctctctgcccttcctccctttccctccccctcttttcttttccccctttctctcctcttctctccttgtaacaatcccatggggcaatctagacaccactggctcccctcccattctccactccccccccgaccccatttttatgccagtgctgttaaatgtttttctgtttccatagcaactcctataattacctgatggattcttcctgcctgctatacagacaaaaccagttcactgagaccatggtattgcaataaagagttttactaacatgaggccagccacacaggagatagagttattactcaaatcagtctccctgaaggcttggagattagggttttacaaggatagttttgtgggcagggggctagggaatgaggaatgttgattggttgaggatggaatcatagggatgtggaatatggtcctcctgctctgagtcagcctttgggtgggggccacaggaccggttgagtcagccagttgtcagaaatgcaaacatctgaaaggatctctcaaaagaccaaccttaggttctgtagtagtaatgcttcctacaggagtgattgggaaatttagaaaccttatgatctcccagacaatgtccggttatctcaggcccctctgataaccctaacctcatggcttttcattagttttcagaagcagtttcgttttgggaaaggttattatcatccttgctttaatgttaaactataaactaaattcctcccaaagttagctttgcctgttcccagaaatgacaaaggacagcttggaggtcagaagcaagatggcgtcaactatgtcagatttctcttactgttctaattttgcaaaggcagtttcactccagacattcattgcaggctgtaaaagatgctttgggtagaaacttggtttactaaaatctttggcttatataattattacattcagaaaatcttgatttcagatctgaaggttaaagtaggtacttcatggctataaaaaaaatggacgttgaatagactattgctaaaaatagatgtctttattgtcaagataaatttagtttatgaaaggcatttttctctgatgactttttggtattccaagaaaatcaaataggccccctaaagggatacttggtgcctcttagcttttcaattcctacctacccaatctttccataaaagattttacatcaactccccagctcagccttcaatctaaaatgtttttgaaaggaggatagtagtattttgcggtaattgagtggtacaaagtactgcatattgatttgacccgacttcctgcccaaaactatgcttaacagagtgctgtgtcactgtcattcataaggtctgcctcagggcagttgctaagccatttcttcagctgtttcctggcactgcagtgtcatctttctgtggtgtaggaaacttgcccttgaccacaaaattgcagtttactttccaagctagtctctaattcatagctgctgctttctaattcttttgagcctcagactattcgaaaatatggacagttcgtagttctgctgcaacagcacagagaacagctgtatgcctgcttcagcttggtttataaatacctcacactgtcccttttggccctacttctgtctttggacagccagtaatggaaacaaacaggaccagcactggcaggcatttggaaatctttgttttatttttaaattttacctgttcagccaagtagtcatatatcctgcttatgataggcagaattctaagatagaccagaattctaaaaatttctggcctctaatgtacctgtacatacattctcccaattattcaatcaaacaccaatctaggtgttgctatagaggattttgaaactgtaactaaggccccaaatcaattgacctttgagatagattttttttgggtgagcctgacctaatccacgaacctttaaaatctggctttagcaatcagaaacagaaatgtcaggtatttgaggtaagggagatattggatgcaagagagtttcttcgtgctgcttttgaaaatggtagggtcatatggcaaaagactgaaagcaacccgaattttatcaacaaccagaatgaacttaaaagaactttgagcttcagatgaggacacatcttgctgacacctgcatttccttgtgagacctcgagcagataaaccaggcattcttacagaattgtaagataatgaacgggcattgctttaagcctcaaagtttgtggtaatttgttacatagtatagaaaagcaacacattgtgagtttacaaatggtcatgtactttccatggtctagattctgctcatgtcaccaaaggaacggaggatggtgaggaggaaggcaagctgttcacagacctatgaggtctgtgagcaagtctgtccaaggagtgcccgctccctttgcttcctgtggtgtggactgcccagagctagaggcagcctgccctgtttgagcacgcaacgactaaaatagcctgctgatgtccttcctgacagcttccctctgttcttgttactccaagctactttgaacaacataagtagatgactcatctcctctgagcaagggttcattcatttctatgggatgtggcccatgcctttcctctttgatccctggaagaaagggcagggccagcctcagaagcattgcagatcaagcattctgatccactcctgcttccaggctcctagcacttccacacttgtctcttttccccacagccctctcctgcaggaggccacctccaatcctgtcttcttgaaggataccccaaattacctgtccattatgtatcctgtcttctttatcttagctgagattgattgtactaaagttacacaaggaaaaacattgagaaggaattcacagggatgtgcatgaatggttgccagttagcctgaagtctatttgaattgtaaaagcattttttttcttaagaaagcatacagttggtgaactttcaggatgcaaggaggatgtttttatttctgtgcgctgttgttttctacgtaaatgtctatatgaagcttgaggaagaagacttttatcttctatattgtatcgattgagcttcctgcagtatcatggctgtagtttgaggccccttgtggtttgtacccatttccctaattgtttcatggtgtcgtaaccccacctgggattgatgagcctgtcatttaaaggatctgagtctccacggaggcaagaggaattcaacaatttgagtgcttcttggtttgaggagttctactgtctaactccaaatatgttcttacagaccttttctggatacctatctatcactgcctcaggacccaaaccctgttcccactttttgttgttgttgttgttctgaactgttaggccacagaatgattgtggacctcataatgtgcaatctacagaacgtcagccacagaatgatttttggccaggattttgcttccctgggtaaagcagagaaactctcctgtgggatcctacctctccagtgcagtctgtgggcacggctttcctagttagtaaaaaaaataaagtaactagcatgatgatagactttaactctatcaataattgcattaaatatacataatctaaacacatcaattaagagaccaagattgtcacattgaataaaaaagcgagacacaactagcagaaaacctacatatatgtgtgtgtgtgtatatatataaagacatagacaatattttatatatagatagatagatagatagacatagacaagttaaaaataaaaggatggaaaagatattaccatgtaaacactaaccaaaagaaccgtgaaagggctgtgttaatttggacaaagtaaacttcagaacaagcactattactgggaataaagggggatattacataaatatagaggggttaatttagatacacaaaaataacaactcgaaatatgcatgcatctaacaatggagcttccgaatacttgaagcaaatatacccttagggcatgggattttaagaatggagtaaggagctcaatggaccacctcaacagacagtactttaactaatgagaattattttttaaaaagttattaaagttgcaggaaattattcattcaaaaaaatgttgtaaatcttcataagaacagtggcagtctctggcatttgggctacaacctattctattatgctccccaccacatacccctcaagccccagctccttgttatagaagctccctctaaccccagtttatactctgggactgcagtttcaccctgagaagggagggctgctagcatttctcatcatctccaactttatgttgcagaagttctatttcaggcacatttcagaaaggactgggtctctcttcacccaccccactctaggacagatgctgtatcccagatgcagcaggcctgaaacctggggaacccaatcttgctcacctcactagtaggataagttccacactaggaagagcaagctgagaagaccagggtctaccaccccttccccagtgaccactacttgtacagcagggcatcactaggggaaaagcatatcagacaacacagactttaaaaccaaaaagttattacaaataaagatggacattttatgattacaaaagggtcaatccagggagatataacaattataaacatatatatatataactaataacagagactcacccaaaatatatgaagcaaaactgccagaactgaagggagaaatacacaatgcgacagtaataatgacagtcttcagtatccccattttcaataatggctataccatctaggcagaagataaagatatagaagacttggaaaaagtataaaccaacttgacttgtagacatctgtagaacaccatgctcaacaacagaatacttattcagctcaggcatatgtagaatgttctccaagatagaccatatgctaatccataatacaaacactagtaattttaaatggatttaaacaatacaggctgaacattcctaatctgaaaatccaaaatgctccaaaatctgaatttttttgtgtgccaacatgatgctcaaaggaaatgcttattgaagaattgcagattctcagattagggttgcttaactgataagtgtaatgcagatatttcaaaatctgaaaaaatctgaaattcaaaacactcatggttccaagcatttcaggtaagagggatactcgtcctgtacaaagtatgttctctgtcttaattttctactgaaataaattggaaatcaaaaaagtcttgggataataaacatactccttaataatcagtgaatcgaataaatcaaaagggaaattagaaaatacttcgagatgaacaaaaacaaaacatatcaaaacttacgggatgcagcaaaaacattgctgggaaggaaacatatacacaccaaaatatctcaaatcagaaacttaaccttctccctaaaaaaactagcaaaagagccaactaaagcaaacagaaataataaaaactagaggaaataaataaaatacagaatagaaaaacataacaaaatcaacaaaaccaaaagttggttctttgaaaagatcgaattgtcaaacctttagctatactgaccagggaataaacagaaaagactcaaattactaaaatcaggaatgtaggaggtgacattactgtcaactttatagaaagaagattacagggcaattttatgaacaactgtatgctaattcattaacttagttgaaatggacagatttccggaaagacccaaaatacacaaactgactcacggagaaatagaaaatctgaatagacttataacaagtgaaatgtttgcattagtcatttaaaaacttgccagaaagtggctgggcacggcggctcacgcctgtaatccctgcactttgggaggcgaggcaggcggatcacgaggtcaggagatcgagaccatcctggctaacggtgaaaccccacgtctactaaagatacaacaaaaattagccaggcgtgttagtgggcacctgtagtcccagctactcgggaggctgaggcaggagaatggcgtgaacccaggaggcggagcttgcagtgagccgagatcgtgccacttcattccagcctgggtgacagagcgagactccatctcaaaacaaaacaaaacaaaaacttgccagaaagcaagccctgctccacatagctttacttaaggattctatgaaacaatcaaagaagaattaataccaattattcccaaactcttccaaacaatagaaagggaaacaattcccagcttagtctgttagatctgtattaccctaataccaaaaccagacaaagacactacaagaaaatatagacaaatacttctgctgaatatagacgcaaaaatcctccacaaaatgctaatagattataaaaagaatctagtgtacaccatgaccaagtgacatttatctcaagaatgcagggttggtttaacattgaaaaaatcaatacagggaaaaccaataatcaagtcaataaacacagaaaaaacatttgagataataacatcctttcatgataataatgcctaacaaactaggatagacgggattttcttcaacctaataaagagcatctatgataacctgaaggctgacatcgtacttaatggtgaaagaatgaaaaaattccccctacatcaagaacaacacaaggagatctattcttgtcacttctcttcaacattctgttccaagtttgaccatggcaatagaccacattacaatctatcacaacattgtgtgtgttatccaattaatttactccaaacatatcatgttacttgggtgtgtgaacttatgagctactgtctggtaatgcgtattgagaagggcagaaggccaagccctggtctttgtctcttcttgtgaatttaaaaggagagataatccccaaaatggagagccccagttccatacatacacataaaaactattgattgccccatatttgtcaccactcttaactgacaatgcttaggcagaagcatcgtgggacaaaggtgtcttcctaaatcatagttcagtagccctaggactgtggaggaccagagagagatgttagaggagagcatttcaagggcagctgctcatcaactccttaccctggcaagcttttctattctaggttgaaggatctggctctatctcaaggcagacagggaagaaagtggagaataataaagttcggaagccttctcatagcctagcctctcgttgtcagctcaggctgcccattgacactcactttcctttgcctgccactttaaggcagccttcagttctcccaagggcttctcactgttttttggttatttcttggagtcagtacctccctctaacttctaaattttttcagcattattgttgtggggaaggaagatggcaggaagagccagcatgtactaaatcactatctttaaggaacctaaattagcccctgattaatttgttgcttttttttaaaattattttaaatttttgtgggtacatagtagatatatatatttatggattacctaagatattttgatacaggtatgcaatgcataaaaatcacatcaaggtaaatgggatagtcatcacctcagtcatttatcttttgtgttaccaacaatccatttatattattgtagttatttaaaaggtacagttaattttttttttaactgtagtcaccgtgttgtgctaggaaatgctaggtcttatccatactttcagtttctttatacgtattaatcatccccatttctacccatccccgctgctatccttcccagcctctggtaaccatcctcctactctctatctccatgagttcaattgttttgatttttagctcccacaaatagtgagaacatggaaagtttgtctttctgggtctggcttattttacttaacataatgttctctagctccatccaggttgttgcaaatgacaggatctcattatttttcatggttgaatagtactccatcgtgtatatgtaccacattttttttatccattcatctggtaataaacacttaggtggcttccaaatctcggctattgtgaatagtgctgtaataaacatgggagtacagataacgctacaatatactgatttcctttattttgggtgtatactcatgactgggattgctggattgtatggtagctctacttctagttttttgaggaacctccaaactgttgttcctagtgtttgtactaatacattcccaccaacattcccttttctccatatccttgccagtatttgttgttgccttttggataaagccattttaattggaatcagatatctcattgtggttttgatttgcacttccctgatagtcatattgagcattttttatatacctctttgtcatttgtatgtcttcttttgagaaatacctattcagatactttgcccatgttttaaccaggttattagattttttcctttagagtcatttgagttcctcatatattctagttattattaatcccttgtcaaataggtagtttgcaaatatttcctcccattctgtgagctgtctcttaactttgttgattgtttcctttgctgtgcagaagctttttaagttgatatgatcccatttgtccatttttgctttggttactggtgcttgcggagtattactcaagaaatctgtgcccactccaacgtcctggagagatgctaactaatgtccctttctttcagtttgaaagaactcccattagcatttcttgtaagatatatctgatgttagtgaaatccctcagcttttgtttgtctgggaacgtctttattcctctttcatatttgaaggatattttcgctggaaaggatatttttgccagatatactattctagggtaaaagtgtgggggttttttttgttgttgttgccttcagcactttaagtatgtcatgccagtctctcctggcctgtaagatttctactgaaaagtttgctgccaggtattggagctccattgtacctaattctgtttcttttctcttgttaattttaggatcctttctttatccttgattttttaaagtttgattattaaatgccttgaggtagtctttgagttaaatctgcttggtgttctatgaccatcttgtagttcaatattaatatctttctccagatttgggaagtgttctgttattatcactttaaataaactttctacccctatttccttctctacctcctctttaaggccattaactcttagatttccccttttgaggctattttctaggtcccgtaggtatgcctcctttttaattcttttttgttttctctcctctgactgtattttcaaatagcctgtcttcaagctcactaattctttcttctgcttgatcaattctgctattaagaaactctgatgcagtcttcagtatgtcagttgcatttttcaactctagaatttctgcttgattgtttttaattatttcagcgtctgtattaaatttgtctgatagaattcttaattccttctctatgttatcttgaatttctttgaatttcctcaaaacagccattttgaattgtccgtctggaaggtcacatatctctgtttctctcggattggtccctggtgccttatttaattcatttaaggaagtcatgttttcctggctggtcttaatgcttgcagatgttcatcagtgtctgggcattgaagagttaggtatttattttaatcttcacagtctgggcttgtttgtaccccttcttcttgggtaggctttccagatattcagaaggacttgagtgtagtgatctaagccatatctgcattagggggcaccccaagcccagcaacactgtggttcttgcagacttgtagaagtaccatcttggtggtcttggataagatcaggaagcattctctggattacctggcaaagattcctgttctctttccttactgtctcccaaacaaacagtctctctctctctgtgctgagccacctggatctgggagtggaatgacaaagcatccctgtggccaccaccactggaactgcactgggtcagacctgaagccaacacagcactgagtctcgcccaaggcccactgtaaccactccctggcttccaggtgtgtttcttcaaggccctaggactctaaaatcagcagatagtgaagccagccaggtttgtgtccttctcttcaggacagtgagttcccccaggtcccaggtgggtctgtaggtgtgtccagaccagtccagaccagggactggagtcaaacaccttagaaatctacctagtgttctgttgtcctgcagctgagctggccttcaacccatttgatgcagtcctacccactcttccctcccctttccacaggcagaagatccctaccccatggccaccaccaccacaagcccacggagaataccgccaggctaccaccagtattcacttaaagcccaagggctcttcagtcagcttgtggtaaatgctgccaggtctgggactcacccttcagggaattgggctccctccccaatccacagcagccctatcctgctgtggctgagctggtatccaagatgcaagacaaagtccttgtttctcttccccctcctctcctctgtcaagcagaagaaagggatctctttcagagctgtgagctgtgctgcctggggttggaggaggagtggtgcaagcactcccttgggcaccccagctcatgtctcagtaggttgcatgccccccaagtctactggctccaagcccagcacggcactaggactctcttaggaattgcggtgcttgtggcctagactgcctttcaaatttatttagggccccagaacactttagcctgaggtggcaaggctaatgggaactcaagttaggactgctagagttcatctaaatgctgtctccttgggcaggcgaccgctgagttcagccagattttgctttctgctgtgacagggcagcactgagttcatggcaaagtctcacagtcgctgcactgtccctctcccaagtgcacagactctctctctgtgccacttggctgctgccgggtggagtggggtaggtgggaaagggtggcatcagcgattcaagattttcttccctaccctcttcattgcctctttcagtgatatgaagttaaaaccaaaccaagtactgtgagtgctcacctgatttttggttcttatgaaggtgatttttttggcatagagagttgttaaatttagtatttctgtggggagaagggacaatgaaggtggagccttctatttggccatcatgccctgcccttccacctgcattccattttcttaaactattgaaaattatcagctgttcactgtttatcaactttcccaagtcttgaattagaggtgagcaactaaattgaagaaaaggtagagacagaacttcttgaagaacaaaagcatggtggacagttgaacgaaatataaaatgaagttctggctctgcgttttcaactgcttgggatttgaggtttatatgcatactttaaatgtgaattacaaaatgtaaaatttcgaaaaccatggaccaaaatgattgcatgaggagaggaccttgtgaaagaagggtgtatatttgaattagaaatgagggtttggattggtataggaggatagggaaaaaaaacacagggcaggcagattagcagagccgtgggggacttgcccatggaactagcctggctcaggtggaaggtctggattgaaaacagggttacttgtttaggttgggtcatgtgagattaggaaggaacctagtaactagtgggtgtgtataggtagttagaaaaagcaaggaagctatagaagttaggaggcctgtaccaataagattagctacagaagtagtaagtggactatagaataaagtttcacttctaaggcaaaccatggcatggatgccaagggagtcattaaaatggatttgtggatttcagaccattgagtgtgtttaggtttgacaagaggcagttcagtactggcggttaaagcgcagactagacccagaagacttagattcacatccaggttccaagtgtgcctttgacaagttaattaacttttctgtgccccagtattctcatctatgaaatgagtatagtaaaagcccctaactcacaagatttcctcacacaactttgctactcagtttctgctcctaaaatgaagagcacgtatctgtggaatttgagaagaggacacaattggtaggaggccgggtggtggtacagaaagaaagaaaaggaactgaccattttgtgccccgtccgccgcctcactgggttctgagcctcagggatgaaacttgcttcactgtatcccagcacctggcactgtacgtgacataattggcactcaggaaatatttattgaaagactaaatgcatttttatgtgtaattttaaatataaattcagaaagcattttaatatatttagctatgtatttgtctaacaattttgattaattttttaacaactagaaataatcagaattatctgtgaaatatttgtgataattttctttttgttttacagaccagttggaatgccaaaaatggaaaaagtctacttacataatcctagttctgaagaaacgattactttagtatcaatatctgctacaacatcacattttcatgcatcattttttcaaaatagggtaagtttctctgctatacatgatctttcctgagtttgaagttgaaatgtctagatttttattgattaataacttgctgtgattagaattgggtttgaatatttcaaatctgttcctagatttgtttcacttcctaagaatgattacttctacccttaaccatattgtttttctcaacatgcaacagcttaacaaatcagcagtgaaccttaaatactctgaaaaaggtagcattcttacattcagtacattttattttccttcctaataataggtaattccttcgcattgtgttagttgtttcttgctacataataaattaccacaaacttgagacttgtggcaacagccacttagcacacagttctgtaaactgtaagcacactgggttgtttgttcagtgtatcaggctgaattaagatgtcttccgggctgagtccttgtccagaggctctgaggggaaatcacttccaaactcattaaagttgttgagagaattaggttccttgtggttgtagaactgaaacccttgtttcgctgctggctcttggtcagtgacccctctcagctcctcagggcctccaggttccttctcacgggccatccatcttcaagccagcaacagcgcatctttcccctggcactttgtacctctctggtgtcctcttctgcctccagtgagaaaactctgctttaaagggctcctgtcagtgggtcaggactctctggatagtctcccttttgattaactgaaaggcaactggttgggagccttaattacatcttagtcacagcctcagagattagggtataaagtcttgggctccaatttaaggttctccttaccacaaatatcctctaaaattttatttgtaattttcataggaagtatgtaaactcattattaaaaactttctctgaccaaataaataaaaatggtatcttaagtacattttaaatttgagagaatacctaaaactttaatatataggtttccaaaataattaacaaaataacaaagatcagagggaagtaaatgaataggaccgaatttcatcttcccagaattttcactgactcctttgaagggatgtgattgagtaacaaagaagaaacctttttagccatgtaagatattggttgctacatttttatatcatttatttgatgtttacatttctcctctctaaaatcctgtttcatcatatgttgtttactttagagtaaaattaaaaagcataactttttcatttaaaggtattttataaacaagggactgataaatcagcatattacttctggtaataaaaagtttaattttggggggatctttgtggaaatatcccttttctaaattatttcttaaaatagctttcccttgagttattctttgttatctaaaagatatttccacactttttataaatgtgctattaataatagcctccaacaatataattctaatgctgtgagagacctgtgtatacacaggccgagctccagagaggcctgttccagtcatgcagtgagtgacaggtgccaaggtgaaggtgtcggtgttctattatcatccccagtgatttatatcatattacacttcagtgagtggcctgtacctaatagcttctatagagagatgtatttatgtgtaatgaaaccatccagctttcaggcattgtcagtatgcagagacaggttaggttaaagggcaaaattgtgaagtaaaaatggaatcagttaaaaaatagttcacaattgcactatacattttatttctaacttgttaactttttgctaagtcaagcaatattttgttgtttctgaacacttcaagcttcacctgtgttaaaggccagggtttttatttttttcattgctaccgtaatacagagactagaacaagagttgcaaacagattcttaaactgggctaggtaaacaatataaatgagggaagcaagccaagtgggatgtgggggtgtcctagagaacatgtgacccattcgaagagatcagcccccaccgggctccagcccagtggttaccatgttgggagtctaagcccatgtgcagttctgctgattcccaagaagagtcagaaataagaagtttcatgtatctgccagtctttacacattgaaaatcagttcaattttagaaagacagtatgggccaaacaacataggctaaaggctactaacttgacgtttctgaactagactctcccagggactatttctatatatgaatgttaggcaaagagaatagtttctctggaaattttttaaaagataaactaaatgtgtaggtaatcaaggaacaagttaaccaatctgttttgtgctgtcagatgatggaattaaacaataaaaataattacacctatcaaaatccacatttaaatagtcaagatttagctcaaaggagatagccaaaatctttactctctcctcttatccttttttcttcttcttgctttgcatctttttttccctacaataagacactgacttaagctcgagacgtagaggggagagatagaatgaactcttgggggaagaaataacctatttcctctccacttcagctttatgccaacaataagagccttggggaaagatgaatagagtttcttatgtcgaggagagcaaaatctttctgtatgtttactctaattgcctttgtcatgctcggaattcctggtcaggtcttatttctttgacaataaaacattgtctataactcagagtttttagttattaactgttatctgtacgttaaccaaaaagtaggaaatacagaaaagactattttttaattattgttcaaactaagttttacataattatattttaacacgcacatgcaagtaatcttgttaaggttttgattttaagaccacctgaaaatcaaaaagaatagaaatactaagagaggtacggggtatggttgtatgacaatttatttctctgtatataagtttttgtaattatctataattatctgttaattgaatataattatctaattataattcaaaattatgtaatagactgcatttaggccattcatctttcatggccatattatatataggccataaaatatgcaatatatgttttgcatcagaaaatacagaattttataataatattctatacaagtccaattgtggaaatggggtgccttacacacagtaggaaacaaaaatgttttctttattgactagaagcttttgattaattaaattttcagacaaactgaagattaggacaaactttgtttcagtctgtgactaaaattaaaatgttatagttcacttatttcagtatacttaatgatcaatctcttctcatgggttgaagggtgttaataaatattaatgattattttaattagatatagaaggacattattctattgattccatgcatgtttttgggaatttaacaaaatgcgatgtagcaatagtatggaattttatgcagataataaagagaatgaaataggtctctgtctattgatctggaataatatacatgacatgctaatatgtaagaaaagcatattgtagagtagaatataatgcctttttttttttttttgagacagggtctctctctgtcacccaggctggagtgcagtggcatgatctcagctcactgcaacctctgcctcctggttcaagcaattcttgtgcctcagcttccccagtagctgggactacaagcacctgctaccacacccagctaatttttgtattttttggtagagatggagttttgccatgttggccaggctggtctcaaactcctagcctcaagcaatctgcctgcctcagcctcccaaagtgccgggatgacaggcgtgagccaccgtgccttgcctataatgccatttttattaaaagcaaaaaatctgtgtatatttatttgggtatattaataagagccggaataaagcacagatttgccaggttgactggataacctaataatggtgagaatggaggaagtttgagtgtattagctttttattcagtcatctttgcactgtatcactaagtaaaataagcacttgttacttttgcagtttaaaacatacaagaaaatgtaaattaaaaatagttttgccaccccacctatgtggaaagaaggaattaatttaacaaatatttatgaagtgtctacttaaagtgccaggcacttttgtttttaccagtgaaaacagagatgcttatcatacatactctggggagtttgggtgaagtcagcagcagagggaaggcaagcatgataaataagtaaattttataagatcttagaagatgttacaaggtcagaagaaaagtataagatcagagacttaggtgtgcacagggaaggcggtaccattttaaatagggtggtcagggtaggctttattcagaaggtgacatttgaacaaagactcgaagggcgtgaggtaggactgtttggaggaaagtgaaatatatggaagaagagcattctagccggaaggaccaagcagtataaagtctccattgttgaaagcaggcctgttgtgcaaagacagccagaccagagtgagcatgggtgagaggagaagtaagggggcagactatgaagggtcttacaaactatggtttgacttgactctttttcctgaatgatgtggaaagccatcaaagggttttgaacagaggaatgaaattgtagctttaggttttaataggatcattgttcatcaaaaataggacaagggacaccagtcacattggctgttgtcatactccagggtaagaagatgattagatgattactctgaccagagtggtacgtggaagaggtgaagaaaggagttggacttgggatacagggataccttggagatattatgggttccgttccagaccactgcagtaagccagtcacagaatttttttgtttccccatatatataaaagttatgtttatactatactgtggcctattaagtgcagtagcattgtgtctaaaaaatgtacataccttaatttcaaaaatactttattgctaaaaactgctgatgatcatgtcagccttctgcaagtcgtcatctttttgctggtggagggccttccctcaatgttgacagccactgactgatcagggtagtggttgctgaaggttgggatggccgtgacagttgcttaaaataagacagcagtaaagtttgccacattcattgattcttcttttcacaaaagatttctctgtagcgtgcaatgctgtttaatagcactttacccacagcagaaattctttcaaaattggagtcaatcctttcaaaccctgcctctaagtttatgtagtattctaagttctttgctgtcattgtcagcatattcacagcatcttcactaggagtagatttcatctcacgaaaccactttttttgctcatccctaagaaacaactcctcttccgttcaagttttatcatgggattgcacaaattcattcacatctgcagatgccacttctaattcttttctcttgctgtttctaccacatctacagtgacttctccactgaagtcttgaacccttccttcaaagtcatccataagggttgggattaacttcttccagcctcctattgttgacattttaaccttctcccatgaatcacaaatgttcttttttttttttttttttccaagacggggtctcactctgtcgcccaggctggagtgcactggcacaatcttggctcactgcaacctccgcctcccaggttcaagcaattctcctgcctcagccttctgaatagctgggattacaggcccgtcccaccactgccagctacattttttttttttttttttttttagtagagatggggtttcaccatgttggcgaggctggtctcgaactcctgacttcaggtgatccacccgcctcagcctcccaaagtgctgggattacagacttgagccactgtgcccagctgcaaatgttcttaatggcatttagaatggtgactcatttccaggaggttttcaatggactttgcccagatccatcagaggaatcaccctttgtggcagctatagccttaagcagtgtatttcttcaataagaagacttgcaacttgaaattactccttgatccttggctgaagaatggatgttgtgttagcagtcatgaaaacaacgtgcatcttcttgtacattttcatcagagctcctgggtgaccagttgccttgtcactgagcagtaatatttggaaagaaatcttttttctgagcattaggtctcaacagtggattttaaatattcagtaaaccatgttataaatagatgtgctgttatctaggccttgtccatttatagagcacaggtagaatagatttagcacagttcttaaggtctctagaattttcagaatggcagatgagcactggcttcaacttaaagccaccagctgtgttagtccctaataagagagagtcagcctgtcctttgaagctttgaagccaggcactgacttctctttagatggtatcttccaacagaaggctgcttgatctacatggaaaatttgttgtttagtgtggccacgttcatcaatgatcttagctagatcttctggataacttgctgcaacttgtacatcagcatttaatgcttcaccttgcacttttatgtgatggagctggcttcttttcttaaacctcatgaatcgatcccttttagctttcagctattctgcagcttcctcccctctctcagccttcacagaattaaagagagtcagggccttgctctggattagactttggcttaagagaatggtatggcaaggccaggcgtggtggctcacgcctgtagtcccagcactttgggaggctgaggcaggtggatcacctaaggtcaggagttcgaaaccaacctggccaacgtggtgaaaccccatctctactaaaaatacaaaaattgggtgtggtggtgtgcacctataatctcagttactcaggaggctgaggcacaagaatcgcttgaacctggaaggcagagattgcagtgagccaagaccacgccattgcactccagcctgggcatcaagcgaaactccatctcaaaaaaaaaaaaaaaaagagaatgccgtggctgcttagctcttccatccagaccactaaagctttatccctatcagcaataaggctgttttccttctttaccacatgtgtgttcactggaatagcatttttaacttccttcaacaacttttcctttgcattcacagcttggctgtttggcactaaaggcctagctttgagcctctcttggctttgagcatgtcttcctcactaaccttatttccagattttgggttaaagtgagagatgtgcaacccttccttttactccaacacttacaggccattgtagggctactaattggcctaattgtaatattattgtatcttaggaatagggaagcttgaggagaggaagggagttgggagaacagcagttggtggagcaatgagaacacacataacatttttcgatttaagcttgccatcttatgtgggcataatttgtggtgccctaaaacaatttcagtagcaacatcaaagatcacagatcaccatgcagatataataataatgaaaaatttggaaatattgcaagattgccaaaatgtgacacagagatagaaagtgagtacatggtgttggaaaaatgacactgatagacttgcttgatgcgtggttgctacaaacctttaatttgtcaaacaaaaaactgcagtacctgcgaagtgcagtaaagcaaagcacaataaaatgagatatgctgtatgttttgaagatacacccaacaggatttcctgatgtgggatttgagagaaagagaagagtcaaaattgactctagaattttgtcctgagcaactagaaggacagagttgagtcagctgaattgaagaaggcagagggtagaacgggtttcagaggtacaatcagtagttcaatttggacatgttagatttcaggtatctcctagatatccaagaggaggtggcaaataggcagatagtattcgagtttggtatatgagaactcgactagaaatagaaatttaggagtcactagtgtatatctgaagccatggatctggatgagatcaccaaggaaggaaaaagcccagggactgagctatggtacagtgctgacttgggaaaattacggtttcttagtggtattactagaaactcagatctcctatccatcatctacatactagatgtccagttccgatagtggcagaaaactgcactaaaaattaaacattccatggtgatttttctaactctttggagtttagatgggccttaaaagggtattgtttgaatatagacatttttaaatcaaattaagttctcataaaaaccttaaaggaaaccagttttcctctggatacattttcagtaataaacataggccttatgaatctcttcattgacactagaactgttcttgggtaggaataccataattctaaaactttcacctttttttagagaacattttagattttttttaggtggatacacagcatttattgtactaattttgctactgttttttttctttcaacttttattttaagttcagggatacatgtgcaggatgtgcaggttcgttacataggtaaatgtttttttcacatcttttatatcagaaattgagacccatgttacagtcaagggcaccttacagtcatggtcagcctggattaagggtgtgtttttccagagaggatggcactggtggtctcaacactaccaaggaaacattaaattgtctgcttgaggtttttttagaccactggtatgtattcagaccacacacctctatgagtactgatatatagcgcaaattctaagaataagttagtttttctcccttcctgcggtgcccagaatgactcacataagttttcttcactgcccctttctgtgggtcaggtttgtacttgtcatcctcactccttgttttatctgaagatctgttaggtctgcatttttgaacattctcttttttttctttttctcattcttggtatggtataaaacatctgtattacaagcactggcatcttagatgggaaaatgatattgtcatgttttgttttgttttgtttttttcatactgccggagagtcctctctatgtctctcagtgtcagttctgtgaatccttatattgtcagagggagttaggaaggtgataaaagggtgaccagtcatatgattctgtagaattaaattcacaacaataaaaagtgtgggtggactgcctgaactcagtgatattatctacttcatttcaagattttgttgttttaaagttaatttggctttaatcttgcccaccaagagttaaacctgaacattcaattatttgttcttgccccaggggaacatgaacactgagacccttatgaaaaaaggtccaggctaaaatatgcttgagtgaatccgcaaccctcgtggattcacccaaaacagtaaaaaaaaaaaaaaaaaaaaaaagagagagagagatatacacacacagacacacacatatatatacatagacacactgatgtatttaatatatattttatatgtatttgtttttaaattatagtatacttgcagtgaaattcacccttttagtgtatagttctgagttttgacaaacccataaggtcatataatcaacaatttggtcaactcaaaccactgagtgtagcctattccagaagactgtattaatggaaccatgtagcatatagcatttttagtctggcttctttcttttagcataatgcatttcatattggttggtgtagtaggctgtatcagttctttgtaccactttattattatggaatagtatttcattggctggcggtgtcactgtgtggtttattcattcactagttgaagacttttggggtgtttccagtttggagttattataaataaactcactgtaaatatttacctacagattttaacagttttttataacaactgttccagtttgtattcccatgagaaacatgagagttttggttgctccacatccttattagcactctgtattgtgaggtttgggttttttgtgatgcgagtcactcagctaggtgtacagtgttaggccatttttatcttaatttgcattctccagtgaaaattgattttgagcatctttttatttgccatccatatgttttctttggtgaagtgtctgttcagttctttgcctgttttttaagttgagttgtttgttttctcattgagttcgtgagagttccttatgtgttcaggatacaagtctttcttgagatatgtgatttgcaagtcttttcttccagtttgtgtcataccttttcattctttttatataatatttgaaagagcagaagtttataattttcatggtgtccagtttatcaaattgttcttttatgggtcatgctttgggagttgtagctaggaaatctttgcctaatccaaagtcacaaagattttctcctttttttttcctagaagtacagctggccctgtgtatccatgagcttctcatccatggattcagtcaactgcaggtcaaaactatttgagaaaaaaaaaatagtgcttctgtactgaacaagacttttcttgtctgtacatgttcaaacaaataatacagtataaactacttacatagcatttacattgtattaagtattacaagtaatgtagagattatttaaagtatccccaggagatacgtgcatagccaggaggataggcataggttatatgcaaatgctacattgttttttagcagagacttcagcaaccacagatgttggtatctgcatgaagtcctggagccaatcccacagatactgagggacaaccataatagttttagattttatatttagatctacagtccatttttagctactgtttgtttatggtataagatatggattgaggattgttttgttttgtgtgtggatattcattggttcctggactgttggttgaaaacaactattctttttcattgaaatcccactgtacttttgttgaaagtcagttgaccttgtatgtgtgagtctggttttggactcttcactatgttctaatacgtatctaatagactctgaaatacctgtcctttcaccagcccatactgttttgataactgtggctttatattaattcttagaattagatactatgaatcctccaattttgattttctctttcagaattgctttggctttccttatttcctttctttatcatctaaattttagaatcagcgtgtcagtttctttaaaaaaaaatactgctgagttttttttataatgttcttttgaattaactttaaagatgtacagaaaagtaatactctccatatattcctcactctaacattcttctgatgttaacatcttatataatcatagtacaattttcaaaccaggaaactagcattagtacgataccattaactaaagaacttatatgaatttcatcagtttttctatcagtgtactgctttttctgttttaggatcctatttcctattgcatttagttgttacttctccttagactgaattttggttccacttgcattagatatataaatccatttcaggagaactaacatctaatattgagtcttctaacccatgaacacaatattttcattaatttgtcttcttcagttactttcagtagtgttttatagttttcagcttacagaacttgtatgttattagatttatacctcagtatttctttgtgtgtgtgttatcctaaatagtacgtttttaaaaattagaattccacttgttcattgctagtatatggagatacaattgatcattatatgttgaccttgattcccatgactttgttaaactcttttaggaggatttttatagatatttttagggatttttctgtgtagaaagccatgttatctgaataaaaacagatttttcttctgtactaatgtgtagtgccttttatctctttttcgcacttctttgcactttatttttgagaccgaatctcactctgtcaccaggctggagtgcagtggcgcaatctctgctcactgcaacctctgtctcccgggttcaagcgactctcctgcctcggcccccccccccccccccagtagctgggactacaggcacgcgccatcacacccaactaatttttgtgtttttagtagaggtggggtttcaccatgttggccaggatggtctcaatctgttgaccttgtgatccgcccacctcggcctcccaaattgctgggattacaggcgtgagccaccgcgccggccctctttgcacgtccaatacagtgttagatagctgtcataagagagggcatccttgccttgttttaaattttggaggaaaagcattcaatcattcaccattaaatgctgtggtagctcctagggcaggagtgtccaatctttgcttccctggggcacattggaagaagaagaattgtcttgggccacacataaaatacactaatgatagctttaaaataaaaaggcaccaaaaaacttaatgttttaagaaagtttacaaatttgtgttgggcccaattcaagctatcctgggctgcatgcagcccatgggctgcaggatggacaagcttctttagggtttttgtaggtgttctttataatattgagggagttctcttctattgacttagtttactgagattttaaatcatgacttgatattcaattttgtcaaattatatgctgctgttgagatgatcttgtgctttttctttagtctgttaagtaaattacattgatttgatttttgaatgttgaactagaattgcatttctaggttaaaaactacttgctcatgatgtgttgcccgttttatatcttgcctcgattcagtttgccgtactttgtggaaagttgtgtttctatgtttacgaaggatattggcttatacttttcaagtctttatgtggtcctgattcagggtaatgctgaattaggaatgttctctcctgtatgtcggaaagtttatgtaacgtaggtattatttctttcttaaatggttggtagagaattcttttccacgagtgaaatcatttaagctcgggcttttctttgtgggaagattttaaaccacaaattaaattttaactgtgtgcacgactatttcagtttgagtgagctttggcagattgtgtcagatctagccgactgtcaaagaatgtgtccatttctcctagctgttaaatttgtgggcatggagttgcttgtaatactcctttatcattctttttgtgtgtaaagtgtatgcaatgatgtccacattttagttccttatatttttgacttctccctttttatcacagtcactctctgtagagttttatccattttatggactttttgaggcaccagcttcggttttattgatttttttttttttttgctactttctgttttctatttcattaatttttactctttattttccttccttttgcttactctgggtttaatttattctttttctagtgtctcaaaacagaaatgtagattattgatgtgaaacatttctgttcaaaataagcatgtaatgctataaattttcttccaagtattgctttacctgcagcctacagattttaatattgtgctttcatttccaatcaattcaaaatattttataatttctcttgttactactcatttcacccgtggcttattttagaagtatgttgttgaatttcagactttttgagggtttgccgggtatctttctgttgctaatttctggctcaggtgtgaatagcaccagtgtctacagcttccagggcttttgtgctcccgtgcaagttcacacagtcaacctctagcaatgtgtaaacatgttagctgcatttctagctgacactcctgtatgatagcctcatcttcttcccttctctgccatgggtgagccagtattcccattctatctgtccttggaggtgcttgtcttttctacgatttcaggctagttgataatctcactctgtgatgggttcaagaaaagttgtgaattattgtaattattcttttcgttgcactacattaccgtaactataatgctacaaaagaataattacaataattcacaacttgtaagttactcttttgttggtggtaatgtaggagacatactctcgctttcttcagactaaggtgaagccagagtcttactaccatgtattttgagctatcatttaggtagcattttagagttctagccatagaggcagaatgagagaggttgatggctttacatattaaaatgcactttaaggctttgtttcagggcagaaccgcaatttcagtctcttgaacatgggagtagccctattgttttgtggtaataacattttattttactaactatagtgacattcttaatctgcagaaagtaacaggagtgagttcctgcacatacattcacccctgccttctttcctatttaagttgctgggacattttgttccttgtgtggatggaaggcagatttcataaggttgaggcctgggcttattctttggactaaaacaagtcactgcttagtagtacagcagtatatctatatgaaaactcagcctcaacgcaactcctatctgattgtctcatcgtggaacagcctgtaattaggtacttcatgccagcctagtgattgttaaatgaacagaatccaggaaaccatctgttgtacaaggctgtggctggtaattgacaaagatatgtgactgtagacattcaatatggaagacatctttttaattattttccattgctaacttaaagcttaaacttttaaaggaaaaactagtttatggaagtgattctaagaaacttgtttaaggaacttgagctgtataattttttttcttgttacaaatttaactttattttctgtttcagaaaattcttccaggaggaaatacatcatttgatgtagtttttcttgcaagagtagtaggaaatgtagaaaatactttatttattaatacatctaatcatggggtatttacttaccaggtaagaaccagaattaaaacttattttatacaatataatcattacctctgccttatcatatgacagccttttaagaactcaggaactcaaaggataatagaaaatgtaggagtttagacttagagcatttttatacttacagtgaatatctctattcaatatctctattcaaatcagactgaacaggtgattttaaagcaacagctaaagtgttaatttaagattgacaaaagaatagtgaaaaaatattttcatgctgacttataaaattttgtttaatttttacttttacacacttatgaagcatacttgataatagtgtcaagattaaaacattcatgtctactttcctttagtaggtattttttgataaacttatttttacatagaattttggtttaggtcattaaagaaagttaatgtatataggagtcatatagtaaatctttttgtatatcagccattattctgtttgtgaatcaagatttttatatgtcaggactaaggctgggtatggtagctcacacctgtaatcccagcactttgggaggccaaggtgggaggatcacttgaagccaggagttcgagaccagcctgggcaacaaagcaagacctcatctctacaaaaaacatttttataaattaactgggcacagtggtgagcacttgtagtctcagctactcgggaggctgaagtgggaggatcgcttgagcccaagagttcaaggccacagtgaactatgattacaccactgtactccaccttgggtgacagatcaagaccacatctctaaatgaagaaaaacaaagattcttaacaataattgctcatatttgtccagcagtgtactatacatgcccttctacctatgttataggtacagttattcttgaagttttaaaaggttaaatcatttgcccaagtcatgctattagtaagttgttgagggggactcaaactcatgtctttgtaagtataaagaccataatctttaccactgtgctgtgctgccagtggaacttgagtgttagctctgacacattactttacagttcctgtgcttttttttttttttttaaacatttcctccccagtacccattaactctgacatatcatataaaataagggtcagtcagagtcagtgttccctttcagtaaggactgtgtcttctgcttatgtatggtgagtaaatctttagcggttgcttagtaggcattcagtacgctgttgatggttggttcagtaattttgaagtgctagacagatcttacccatttagcatgtacgtgttgagtaaatgaaaagactatcataaaaatgaaggtcattgccccacgatggcatcccacaacagacctaggtgatggcagccaatctggactattgagggtcatgatcaggttgttctcaaggtgaccccaatggccagctgtcttctttctttacctcttcacatctagtctttcaccaaatatatctccagtctgtttacttccctcctcctcactaccactgctgtcttccaggccactctcactggattacacattagctgtctgaatgccctccactctcccccaacactgtctgttactcactctctggcagagggatttttttttttaaatctttttattggtatccagtctgtctccaatactacgatgtaagtttcatgagacccagcacattatctgtttttttactgttgaattgttcactattgtatatgtgcctagcacctcatagacacttaataaatagcaatatattaataatatcatttgaattactggtttaccctgcttagtcaacctagggccatcccatgtgggaatgacctggggctgggcttggtatttgagaggttgtctgggccgtagatccatcttctgatggttggggtcaggaaatcttttgactccctattttcttcttttgtctattgcatggcttcttgaaggactgttattcaatttctaatatattaaagaaatcattctaaattcacatacatagtcaatcaaatatgtagccaaatcatgtacagaaacaacatttgtgggggttttttttaaataaagggattgttaattttttatacataaattagatttgccagtctccctagatcagtcagttataactaaaaatattaattataaaagcaactaaaattgcatttttttcctccactgaaacaggtatttggtgttggagttccaaatccatatcgattgaggccgttccttggggccagagtccctgtgaatagcagtttctcacctataataaacatccacaatcctcacagtgagcctttacaggtgagtttatgatggtaattttgaataagcttcattttggtgggaattaatgcttagcatgaaatctcagtttgttacagtttccaagactatttaaaataatagggttttatagtgtattgagaggggtattacttttagtacagcttgctgcagtctgaattttggaatacagcagtctggattttgaattttttgaatcatttttaaaacgactgtgtcttctctggtgttatagtttaggcagctctgcgtttaaagaagagtttttagctacacaaggctgctttttttcttgcctgtaaacactttctggcccaatatccatgttttttaaaacagttcaagtttatttctggaaataataaatttttggtgatggcaacctagaaattaaaattcagggaaagggtaatatagaattatgcttaaaagcaagcttgtttttttatttaaaaaattcaacttatcttacctaatcttctagcagtaattgttttcaagtgtgagattcctcctcactagctccttgtctctttcacagtggaagtggctagtgtcattccttcagagattttctgaaatctctaccttacatcctagggacttagctgtgtgacatgtgcagcctctgtggcttctagttgtgttgtctgtgttaaaagtagatgtgaatgctttctagaatagtccagggtgccagagttctttcggaccaacactgcaggacttaaaagcagcttgaaaatgacaggtggaggaaaaatactatattttgtggtaagtatagggctttggcaactaaaatggctgttgtcccagaccaccctggtataactgttcataaacaatggaagaggaaatgaggatgaaccagggaaatgttcagagcctgaatagtgaaatgcttagaaatgataagtgaaagcagcacgaaagaaatctctccccaacacttggcaacaactgggtgaagatagccccagttttaatttttgtagctggatgtctgcatcacagaagaacctgttcttatgtcctgcttttcaggtgggaagtattccctcttatcctcaccatccttctgttgtttacgtccttttgatactttaggtaatggtgtagtttccctgttctggctgttattacaaatctatgtagaaacttcagaaattcttgctgctttctttcctgtttttacaaaagacagggtctcactctgtcactcaaactggagtgcagtggcacggtcatggttcactgcagccttgaactcctggcctcaagcaatcctcctgccttagcttcccaaagtgccgagatgacaggcatgtgccactgtgcctggcctcttactccgttagacccgactgcatgagttgccccactgtgccgtagaagggctgttaacagggtgccccaagggtgctgcctcattgtggtggccagaccacaaggatggagcttgcaggactcagcagatgttggtcagtctacaattgccagagttgccttacagtctgtaccttttctcttcagcctttggagttaccaagcccagcacagtgatcacttcgaattcaattcatctagtctttttccagttaaaacattttaattcaagatttacacaagagagcaaatggaacaccaaagttactctcttagaaccaaatatagattgtttacctgggaagacactcttacccttgtagtccagtgttactgtgtgtcactagtcttgtcaatattacagtaagaaaagattgtaaagcgagaaaatgtatatcgtttgttgattatacaacataaacacatgagtatgttctcctcaggaaaaaaatgttaacaattcaaacatgaatgaagcaaaaacgtccctttgaacttcctacttcccagtccagctgtccagcagaactttctgtgatgatggaatagttcctttcctgctttgtccaaaacagtagccgctagctacgtgtgactgttgagctctttaattcagctagggtggccaaaatgttatttcaactaatttaaatgtaaataaccacatgtagctgatagctattgcatagacagcacagttgcagtccaagcccttcctcgtggacaccacttttgccaccttgtatgtatcattctagacctttctcttgtgcatgcgtgtatgtgggcacagaaacatttattgtgggaatttgtttacacataatatattctgtacataatgtttggcttcctttttttcctaaactatactaaattagaacaaatagcactggactaaaaataaagaatgtgtcaggttcctagttttagtgtaattatttgtttgactttgtaatttagactttttctgtctctatttctttattcattttctctgttatcagtaggcgactttttaatcttctgggggtttttttggttggttggttggttggttggttggttggttggttttccagacaccaggctggagtgcagtggtgccatcttggcttactgcagtcttgacctcccaggctcaaccaatccttttacctcagtctcctgagtagttgggactacaggtgcacgccaccacacctggctaatgttttttatttttttgtagagacagactctcactatgttgcctaggctggcctacaactcctgggctcaagtgatccccgctaccttggcctcccaaagtgccgggattacaggcatgagccactgagtctggtctaatcttctgttttcaagcattgttatgcttgtttgcttgatacttggaaggattgatgaaataatgtgtgatgttttctggttttccagaaaaagttctatagtcatcctatcatttaaggtgctattattattaacacaataagcactatagatgagcactgtaacaaatcagcaggcaagtaataatatacaaagaaaatctatagcttatcagtctttggtaaatgcattacttttacagcagcaactccccggcccctgccaaaaaaacaaacaaacaaaaaaaacctttaagggtccaggcgcagtggctcatgcctgtaatcccagcactttgggaggccgaggtaggtggatgacgaggtcaggagttcaagaccagcctgaccaacatggtgaaaccccatctctgcgaaaaatacaaaaattagctgggcgtggaggcatgtgcctgtaatcccagctactcaggaggctgaggcaggagaatcacttgaacccaggaggcagaggttgcagtgagccgagatcacaccattgcactccagcctgagcgacagggcgagactccgtctcaaaaaaaaaaaaaaaaaaagtttaagcttaagaattgccatttttcttgctttatccttttttattcactcctggaggacttcttgtgatgaaacaagtgaacgtttccacccattctcatacttcaccccaaatttaattgaattaaatatattttttctttttaagaattagggttagcttacctttaaaggaaggtctcctgccttgtgacccattttgtgtatatatatttacccaaaagaaaggaaagcagatgaccacaccaagacttgtactcagtatccacagcagctttctctttaatggccagacattggaaacaactcaaatgtcccattaatgtgtggattgaaaaactgcggtatagtcatcaaatagaagtgaactattaatgcataaacaaagtggtagacctcaaaataattgcattgagcaaaagaagccagacacaagagtatatgttgtattattccatttagataaaactctagaaaatatgagctagtctgaggtgatagagagcagatcagtggttgcctagaaataggaagggacagagaaggatggatggattgcacaaggcatgaggaagcttttggggataatggatatatttaatatcttaattacagtgatggttttatgcccaaacacataggtcaggattcatcaggttgtatactttaaatatgtattatttattttacataaataactcaataaagctgtttaaaaaaagtaagcttaggcataagccacagaaatatttttgctaccagtagaaaccacatattttcatgttccattagagttattttgtatatatctcaaatatttttactcttccccatctcacaattatggtagttatttgatccactgctggctcttgttataaatgtatggataaagaagcactttgtgttactgtaagaaatacaaaatttatgtttccaaaacttggtaatttttgtaagtgattccctttggaaaaaagaaaaataagtatcctgttactttctaaaatctggtctctggaacaactatggtacttacactgtttctaagttaaattttcaaagttaccttattttaattaaaaatacaactattgcttacacatacagagcactgaatttagtgatattatacatatcctacgtttatatctttaaatgttttgtgataaacagttaggatgtcagaattatttctgtgtaatagcaagtcacctgctttgagaatatgactttgaacgtagccatcatgtgctcttttgccccaggttgtagaaatgtactctagtggaggagaccttcacctagaactcccaacgggtcaacaaggaggtaccagaaaactgtgggtgagttgtaacctagttttctcttgtgtgtgctcccatgaaaccgattattcttaaattagaaaatatttaactccttaataggcttaacaaatatggatgacttctctttaatcgttgtcttaatgttaatttatgtcaagtatatatgaaaattggaggaggaaagaatataagtagtaatttttggaaagggcagtgagtaaaattggtgggagttctaccccactacatggaaagaaagtaacttcagctattcttcctccgaattatatgggtaaagttgtctctgagtctgataatttatgatgtgctttacacataaaaaaatgtaaatgattaaaaaaatgtaggaagcattcattatgtttttgttttgtttttgaaggtaagtaattgaatgttcagattcaccattggtaaaggagatggcatttgcagagagaacctagtcaagtgcctgcgataacttagaaaaattttaattcttgaaggtgatctgtgttcaccttcaatattgttgaatatttaacaatattaaccaaattaaagaatatgtaagagaaccttatttataaagattcttgccatttgtgagttttaaaaatgtttaccatgctttaattcaagagggagaaggcaattgtggtcaattcagttccatatccagctcactcagatcactgctcatctgtaatggaggaacacaaattttacaaccaggagtaaggtttgaggatcagagtttctttattaactgctgttacacacacacagcctcttgattctgtcttctgaccagtcttgaccacagaagagatgtggagattatgtttttagaatgttaatatgaacatctagaaacaaatttatcagccagttatttggttaattcccagaatatagaaacacaaccagcaaaaagaaatatgcaatggacagttcatttatatcctttcacaaaaatgtttcaccttgaaattgtggtgtttgagggaaaaatcatctataaaacaatccttcagaggattaaattcagactattatatctgtatatattattctagacagaactaagaacttcctgtgaaacataattggtatctaataaataaacctaagagaattcagatttttaaatagtcaagagtgataatgataacagagaatagcatgtttttatagtcctagtggctgcaaaaaaagatatggtagttcttattcctacaaacctagactgagaaaaaagccaatgggctgtgacctcacctccagcctatttcggtgtataggtgaaaaccccagagaccaagtcaactccctagagctggggagtggatggtccatccctccaatcttaggagggtcccaatcacctgttttctactttgggactaaaaaagagagtagggataagtgaaggccactaagctgtagaacacaagaatctcctaaaatatgctgaaaggtttgtgcagagaagaaattcaggcagtcccagggagccatattgttctgaaaccaggaaagagattactcctcaaaattttttttccagtaagtcttccttttagtatataaatgttctctcattacgggactgaaaatgtatgctgtcttacatgaatgcagttggtaaactgtggatttacttgagaagctttgcattgttaagttttccatgaaagagcagtgtaagccctgctggttatcatttatgaaggttcttgtggacttctagaaaagtatttacctctgatggtgacatttctgttggttaaatttcaagactgagttatatacccaaacaccactaactagcatattaaaaaataactgattttgtagattagttttaccttttaatggtgattttgtaactgacaatttgttttcagatcatttgacttcttttgctttgcctaccttacatatcgtatttcatcaattctaaacagcacatttttcacattttaaagttctccagaaatggagtgtgtgttacatattggtttaattagcaatgcattttttttattaataggtatatagaatactcatctttcagtcagtgtcatccagttcaataaaaaatggtggttttgctacattacaaaagctgtgctacattatggtctgttaacttgtcaggaaattcctccttatgaaaccaagggagtgatgagagccagtttttcatctagagaagcagataatcacacagccttcataagaataaagactaatgcttcagacagcacagagtttatcattcttcctgttgaggttgaagttacaacaggttagtggaaaactgatgaaatcgaaagttgttttgttttcagtatagcttactctggcaaagtgaaaaataattgttgacttttcttttttccaagctcctggaatttattcctcaactgaaatgttagattttggtacactaagaacacaaggtaaaaaaatcttttaaaagagtctttatggagttttttttttttttaacccctgtattcagtgctgaatggctctactatgtaattcagctttaaacattatttctcagttggttgcatgatcttgtacaaatctccttttcagactcagcgcctttacaggtttataccccattccgctgaggggtgggtggcattgcttaacaggttggaaaacaaggccatgggataatttaagtcatctaaatggaagattgaggcagaaaatagttttctagtttcttaatccagttgctcatcagttcagttacgctgaatcttgatttttacttctggattttgtttagatatgagttattaaattacattttgacaaaatgttgaaagtttgttgcagctgttcagaaaactcaaattctgaaattaaaaacaactaagtaaagatttttgctaaggaaaaactaagagcacttgtaatttgggatgtatatggactatatataataatatgtagttaagattgaagaccatatgtttaaaaattagatttgctgttagtatatttttacattgtaaattattaatttgcttcattatgttttgctggaaagctaaaagattagtaatgtctgacttcacaaaaaaataatatttggggggctgggcatgatggctcatgcctataatcccagcattttgggaggtggaggcaggcagggcacttgaggccaggagttcaagactagcctggccaacatgacgagaccccatctctactaaaaaaataatacaaaagtctgctgggcatggtggtacatgcctgtaatcccagctagtcaggaggctgaggtaggaggatcacttgaacccaggaggctgaggttgcagtgagccaagaatgccccactgtactccagcctgggtgacagagcaagattctgtctcatttaaaaaaaaaaaaaaaagtatatattttggggttttcaaaaatctggtttaagagggaacagttcttataatacacaatgtccttatgagtaaagcaattaccacctaatgtttctttttattaatcttattgtcattgtatttcacaaattgatagcttcaatttgatatcttataaggtaaagattctaacttggctaaaaagcacctttttaagaaatatttcttttcctcaattttaacagatctaccaaaagttttaaaccttcatttattaaattcaggaacaaaagatgtaccaataacagtaagtttttacttcttttttcccctaatttatatattctttgtttttaaatgtatgacaaagttaaaaataattaaacccttattctaaaataattatatttggtgatgacctggtgacactttggttctaagtgtgatgtgagaaacctgttctgccccagccacccggattttaaggatgagagagaaatgggcaatcttttcaaagtaagtttgaaccaaagttcatgagtttcttatacaggcacagtcatataaaaggcctgttctgataaatcctaaaatctgtgggccatgtgtatagaaaaacaggttataaggatttcatcagatttggttgttggagttaaggtatgggcaggaaagaggaagaagagtcagatgaattgggaagaaaataagcaaaaaaaatgttgtaggtagtggtaaagtgctgttaacacttgtcacaggctccctaactagcagttattgagttaccgtaggcagcacattataaactaaggccctctctccctcacacatacatacagagtaagtaacttttaggccatatggaattgaggtgccgttagatagttttaggaaaaaaagggatatctaagttttgccttggcccacaacgtctctccctgatgaggtccccaagatatatacatgtgtaatcattatataggaaaataggacatttttattataatttgtgctgatgccagaaacttaacttcagtgaactgacaaaatgaaatatagatcatgtgggcttgagatttaagggacctttgtccatcgatggccatacccagattttatcaccagctggtggagtagaccaaagagagaagaatatacaaaccccagcgaggaagcaagagatggtcttcccaggtaaccacattctgatgcgcagtgaccttcctcactagtgggaccgggatgcaggcattgtcttcatatctgacctagcatttctcctagatgggaaagtgcctttacttagcccaagcaaaccagcctaactttttacgtacaataaatggactgaaacaagtatctttttcaataaacatattataggaaaatgaaattggcaattaaccctaagaatgtgaatgaagaactagtactcaggtcacttatgacatggaattaaataggcccatgtttgtcctttttcttattcactaaggagttttaggatatattgtaagtgaacatttttgctcttactgggtcaggcactatgctagtactgctatgtaataaatgtattacttaatacctatatggtgcagtggtcctagttttctagataggaaagctgagttagagctgctttttttttttttttttttttttggaagtgacttacacaactataaaaaatgcaaaaataggccaggcatggtggcctcacgcctgtaatcccagcactttgggaggctgaggctggtggatcacttgaagtcaggaattcaagaccagactggccaacatggcgaaaccctgtctctaccaaaaatacaaaaattagctgggcatggtggcatgtgcctgtagtaccagctactcaagctgaagcaggagaattgcctgaacctcagaggtggaggctgcagtgagccaagatcacgccgctgtgctccagcctgggcaacagaccgagactgtctcaaaaaaaaaaaaaaaaaaaaaaaaagaggtatgtgaaacatgaaagtatattatacagtgtcacttagcaatcacatctttatgaatatatcattttaattgcatagtctatttctgttaaaaacctatatatctgttaatataatacatctgtacctacatctgtacctacctatgtgtgtatcttttataatatccaaagcccaaactctgccagtgttttggtagttttctcttattcccgccttcattcacccattcaataaatatttaatgaacatcaactgtatgctagctgctatgctgactgagaatacagcagtgaatcagaccactggggttccctaccccatcaagctcactgtttatcagggctctctggaactctgggagatatttagattttattctaagtgtaatgggaaattattacaggattttaaacgagagtgacatcatctgatttatgtgttgtaaaaggtcactgtagctactttgtggagagtgaacttacagacatggaagggcagaaagcaaaggagaccacttgggatctgatttagcaatcagcctgagaaatgatggtggcttagatttcccaccttatcagctatggggcaagcccacctaccgtggaaactgagttttcagagctcttcttaaggttttccctgtgtgtttcagcattttctgcataattcaccaggcttagagactatagatatttagaaaggttcctgtctccttttgtttcacaaacatagaattttcaggatttgctaagcagtgctagaagctggagatcttttttttaaattccccttcagggaattcattctctttctaaatataggattactaaagcaagcaattccaaatagaagttcctcaactgctaacagacaggatgcgcaggtccaaactctcctaatatgtctataatgcaactttgagaaaatggctttcctcagcatttacaaaacattagtgctgtataaatgatggagtaagtttgcctgagatgccttcagaggaatgtttgcatgaggtttcccttggtaattaacaaatcggaatcataatatcagcttaacatatgctttagtgaactcatacacaaattattagaaatacaatgttaaatgctgaaagtgcttttttccttatttgctcaagtgcttttataagcagttttagaatgttccggaccgttgaatttcacttgagggttactgagcattagttgggtctgaatgttgtgagaaaagcctagaactatatttagaacatatgcaagcttgcgaactgcctttcctgggaaacttgcaatagttttatacttcttgattatctttgagttagcaatagtcactaacaggttgttgtataaatatgcttactacaaggtgttgattgtgtatgagttgtcatttaaagccaccagaatgggccagctacttaagtgttttgtcttgggtttgtttgttggctttttgtttccctggaaaatgggttttaacaatttgggtttggttttttttttttttttttttttttaactgataatgagtgaagaattcagaccatttgtataaaacatgagttttcagttgaatatttctttgttattactgcagcgtattttaaggtagcaatactaatgtaaagtttttatctggtaaggaaaatcttaaagtggtgtgtttcacatgaaaaaaatttcatcaactattttaaattcttactaatagtgactatattttaacaaacatccttgctttgctatttctggcttggtgttgtacaggctgataacactcaaaaaatattgtgcttgttgttgatgaactcccacttctagcctttaagcatattgaaaaatggtcaagccttcattgtgtgtccagagttggttccttctggtgggttcttggtctctctgacttgaagaatgaagccatagaccttcgttgtgagtgttacagctcttaaaggtggtgcggacccaaagagtgaacagcagcaagatttattaagagcgaaagaacaaagcttccacagcgtggaaggggaccctagttgcctctgctggcttgggtggctagcttttattccgttatttggctccccgccatgtcctgctgattcgtccattttacagagcgctgattggtccattttacagagtgctgattgttgcatttacaatcctttagctagacacagtgctgactggtgcatttttacagagtgctgattagtgcatttacaatcctttagctagacacagagcgctgattggtgcgtttttaccgagtgctgattggtgcatttacaatcctttagctagatacagagcgctgatgggtgcatttttacagagtgctgattgttgcatttacaatcctttagctaggcacagagcactgattggtgtgtttacagtcctctagctagacagaaaagttctccaagtctccactcaacccaggaaatccagctggcttcccctctcaatcccccctctaaataggacaccccaactgctgttgggaattgggcaatgatcattctagctacttcctactggataagggcaaagaagggaccctgcagtggtagtgtcctccagaggggaactgtctaggccagtcaaagggccagtgggtcgatccaggggtccttggtagaagttgttagttgagcttatttggggttccatttgtaagaccatctgtagcttgatggcctcgatcgtagaggaaacaaatttgacaaggagattaaaaatacagggcccaaaggcgagtaatagcaagatggctgtcacaggacctagaaagggaagatgccatgttccccaactccagaggttggtataagagttggaaaggcattgaaagagtttgaaaggcgttgtctgatttcagaagccttttcctgtaaacgctgtagtatccctgactggttagtgtaaaaaaacactcttctcctaagaaggtgcaaagtcctcctttctcagcagtgaggaggtctaggcctcagcagttttggagagtcactgctgccaaagagtctatttgggattgtagagtaaggatagatttcattatttcttgcaaactgtctgagaaatcctttgagagtttgtggtagtaggataatgatgtagataaacctgctattctggttcctgtagcagtggccatctctaaccctataagtaggggtgttagttgtatggccctgtgctgagacacttgagctttgaggggcacagaccctatgtctgatttccataagattagaagttaggataatatatgttacactttttttttttcataattgagatttcattggttgaggatcgtacagacatttcaatttgtacacaaatcttaacatacataacgaaattctaaaaagccatgtattgtaattattttttaaagttattccagtgactttccagcttaaaatttggaagcaaattttccttaagaggctatcaagtaccagtatcttcacatgttggtcagctgttacatacagcccaccagttcacaactcaatagcacgtacactacatattcaaatttgtaatctttcacagcacagtaacaaagttattaggaaaacaggactaccacaaccaaagatgttacagagtgcacacaattctggcagagagagccatgatcaaagagtggttttctttaggaaacaattctactaaaaaacaacatggtaatagaagtaatttaaaatgttcaagacattaaatgcaggactgactccatattgccatttaatatgctttgtattataggatataaaaactaaccccccatctatggaatgttaagctgacacccgagacaatcagagcctcccataattcaatatcccacactattttctggttgtaccaaaaaataaacaaccagcaaatgatttcacctcttaaaaaaaagcatttacacttaaaaaatgggatgaggtgggattccctccttcttaaaaatgtttctagagctactaaaaaacttgcatttacaaaatagttgataaaaatattcctctggattgtacaagaagggagacagggaccactgataagacatggtatatggttattaatcagacttggcttctttctctcctgcttcatcagaggctggactctcctcagttttcgtttccccattttctgcaggtaaatcttctttagtttcttggttagccacttcggcctgttttccctttgctccccttttcccttttgtttgcacgtttttgtctgaagatttatccttcgctgctgcctttttcggctttgcttccacttttgcaggaggtttagctgacaaccgcgccgatctcctcttgggctcttccttggcagcggcttcagcggagctgaccttcctcttgggcatcctggcggcggggaaggcgcgtgccaggtgcctgcgggccgcggcgcgccaagagccttcacgaaactgggctgccttgccgctgccactcctccccaacactgttaacttttagcaaacttttgttgaaaaccttgtaagtttgggattttaaaatttttttttttttttttttttttgcttatcacttactgaatacccattgtgtctttttcccttaattgcttgggaggaaccatctatcgtcctgtcctgaagggagttcctcctaggtctggtcggacctttgtatagtaattagttaagatttagatcccctgttaggaaacctgctgggttaaggatttttgataggaaggctactggttgtcagtgacctcagtgctttcaggctatgtccttgtttactctgacagcaaggtggtattggagtgttatagggttacagagaagaccttcaattatcaattataggttttaaatttaccctggcttttaaaggactagggtacacttttttctttactacttccatttctttttctttctctttgacttcttttttgtctctctttttttctctttctgacttcctctttgtctcttcccctctctcactgtttctctttctctctgacttcctctttgtctctgtctcttcctctctctctctgactttctgtctctttctctctttcctttctgctggtctttccctgcctctgccagctgcttatgctgctgttctcccttctccttccccttttgatggcttcggcggtgtgagactgccacctctttggatttttgtactgcgtgcaataactccataatttccttgtggtatttaatgggggttcccctagaggttaggaactccctttctttccatattgcagcatgggcatgtaggaatagataagcatacttgctatctgtatacacacatttattctttttccctttctcagttttaaggctcaggtaagtgccactagttctgctaactgggtgctgctccctaggagaagaggcttactttcaagtacggttgcatcattaactatggcataacctgcccttcatatcccattttccacaaatgaactttcatcagtatataggttaagttcaggattagctaaggggacttctaagagatcatctcaggtggcataaatctggactataatttgtcggcagtcatgctcgattggttccccatcctctgggagaaaaatggcagggctgagggccacacatgtacatatttgaagcaccggttgctcaaggagtagcatctgctatctaagtaggcggttgtctgatagctataaacttcctttggcacctactatgccatttacatcatgagtagtccagacagtgagatcctttccttgtattattttgatagcctctgacactaagatggccactgccacaaccactcataaacagtgaggccagccttttgctactacatcagttttcttacttaggtatgccgctggttgtggggttgtcccacgagtctgagtaaggactccaagagctatccctgctctctctctgacgtataaagagaagtgttgtcctgtgagaaggcttaaagctggagcttgtagtagggcctgctttaaggttttgaaggctgtttctgcctctggttcctattctactagatgagtatctgccctctgggtctccttgattagagcatagagtggtctggccatcttgctgtatccggggatccatagtcaacaaaagctggtgatgccaaggaacccccgtaactgttttgtcttagggtgaggataagccagtataggctgtattcattccttgctgagggcactggtccctctagctaagattaggcctagatatttgacctgctgtaggcaaagctgggccttcgacctagatgccttgtacccttgattagctagaaagttcaagagatctagagtagcctgctggcatgaggcttccgaactgatagccaaaagtaagtcatccacatactgaaggaccagagtgcctggacttgagaagtggcctagatcatgggccagtgcctgaccaaacagatgagggctatccctaaacccttggcataagaccgtccacataagttgggacatgtggtctgtgggatcctcaaagacaaagagaaactgggagtcagagtgcaggggaatacagaagaagacattcttgaggtccagaacagtgaaccattctgctttctctggtatttgagagagcagggtataggggttgggtacaactggatatagaggaattactgcctcactgatgagtctaagatcttgcactagactaagatctccactgaccattcggtttttgtactcctagaattggggtgttgcagggactgctgcatttccttactaagctttgagcttttaaatgtttaacaatatcctgtaatcctttatgagcttcaggccttaagggatattgcctttgataaggaaaagtagtggagtcttttagcctgatttgaactgggtgggcattttttgcccttccaaattgtccttccaatgcagagacttcagggttgattccctcctcaagtaggggacaacaaatgggtaacttgttccccatattcatgtaggtaatagctccagctttggctaatatatctctccctaataagggtgtgggactttcaggcataacgagaaaggcatgtgaaaagagcaaagtctcccaattacaactcaggaggtgggagaaatacctggttacaggctgtcccaggattcctcggatggtaatggaccttgaggaccgtcgtccaggacaggagattaacactgagaaggctgcaccagtgtccaggtggaagtcaatttcctggccttcaatggttaaacgtacccagagctcagtgagggtgatgacatgagctggcacttgccccgggcaccctcagtcctgctgttggattatctggttgggggcttctggcctagagaacctttgccctctggggcagtgtgccttccagtgattgcctcagcatagtggacatgggtgagggggtggcttatttttcattggacaatcttttttaaagtgtccttgtaaaccacactgataacaagccctaccaggtgattggcctgctcaattttctttcctctctgaaccaccaaggtttgtttgagggccttgactaaggctgtggcctttctctgatctcgcttttccttttgggcctgttcctcttggtccctattatagaacaccgaggttgccaggattaataatgcctccagattttgttcagggcccagggcttgcttttggaccttcctcctgttatctgtggctgattgggtaataaactcatcttttaggatcagttgacccccaagggagttgggtgacaggagagtatatttccttaagacctcccgtagctgctcgaggaaggcagaaggattttcttcctttccctgagttatggtggacatcattgaataactcatgggctttttcctaattcttcttagtccttccagaacacaggtcagcagatgtttacaactccagtccccatgatcttgagtctagatcccagtgggcatccatactggggatggcttgctgaccggtagggaatttgtccctttcttcagctgtcattctatcatttacttggctaagacaccaggtatctccaaattcttgggctgcagctaaagccgcatttttttcattaaaggccagggtttgatctaacaatagcatgacatctctccaagtgagatcaaaggtttgccctagaccatgtaggacatctgtatacctatcaggatcatttgaaagcttccccaggtctgccttgatctgctttaaatcagagagggagaaggggacaggtacccaggttgggccaaattcctctccccctacagcttgaaggggacataaccgatagcccggggagttttgtggtaccttggagatttctttgcttgtttccttctgggtgggggaaattagaggaggcttatcattaataggaaggtgaactatagggaggctaggatatgggggtaagctgaggaggtcctcctgtgggatgtaaattgcaagctttgcatagttgtggattctccgtcaatgaaaagaaagcttagagataaggtatttcactctacttgccttccctcttacagaaaaggtcaagctgcaggatagtattataatttatacttccctcaggtggccattttccccatcagagagagaatattgggaccaggccgtagtgcagaaaaaaatgagccacatctttttcagggtttatgggtcaaattggtcccaatggcttaggatgcatttcaagggtgagcctgttgatgcctgagtgtttcccatctgaaagacaaaactgcctgtggttttggtttgtttgtttccccccagcccaggcacccacaacagtccctggaccctgctgatcggaatagttgcactcaccaacgcagcagcagaaacactagttttcctcctagaccacaaggaggaccaaggaaggttggatttagtggcccttaccaacacattctcgaaaacctgcacccttgcctgtcctcctataccacaaagaggaccaagaaaaatcagatttagtggcccttaccgacgcattctcgaaaacctgttagagttctaagcattctcctgttagtgttgggactttaccccatcctataaagatgttatgccccaaaaatgaagtggagggccgtaccctgagcaagggaagggatctccagggttggaagagtgacgccttttatcctcacttctcatcatgtgaataggaaggatatcgtttctgaggctccccgtatcctagcttcaggaatagcttttgttaggcctgctagtctgaggagggatcctaaaattccaggtagtccccctgccctcgaaggggctttgggcaaaaattatgtctttgattggtgagtccaggtgcctaaaggagggaatagagtcctggagtttatactggaaatcattcttataggagaaactagaaaggcatcagagacagagagtggtttttagaagcggaactatccttggagaagagaggcaagaggaagtttgtctgacaggcattaggacccagggggcaagggtcaggatagataggatagataggcaagtctcgcttgggcaacataactttgagaattccgctcatggccacagtcaaccaactttttgtcgggatcccggagctgaatggctttcctctctgttgaccctcagctcagcccagaagtacaggaaaagtggaagatggttccaggcaaaccaatgctcccaactctgaagagttgggggttgttagccctttcccagaaagcctgacacctgtgtctttagtccggtggctgtgccagtcgcttttaactggctgacaggtgtccggtatttagcccccgaattctaaggaaaaataggacagaatagcaagtgaaaggggtccagtggtgctcactgcttggcgatagtcccttcctggtcaccaaaatgtatcccatgtgggtcgccaaaatgtgtccggaatttcttccttccagtgagttcgtggtcttgctgacttcaggagtgaagccgcagaccttcgtggtgagtgttacagctcataaaggtagtgcagacccaaaaagtgagcagcagcaagatttattgtgaagagtgaaagaacaaagcttccacagcctagaaagggacccaaacgggttgcctctactggctcgggtggccagcttttattcccttatttggccctgcccgcgtcctgctgattggtccattttacagtgttgattggtgcgtttttacagaatgccgattgatgcatttacagtcctttagctagacacagagcactgattggtgcgtttttacagagtgctgattggtgcatttacagtcctttagagacagagtgctgattggtgcatttacaatcctttagctagacacagagcactgattggtgtgtttacaatcctctagctagacaaaaaagttctccaagtccccactcaacccaggaagtccagctgacttcacctctgaattgttgctggatcatattcagtagagcaaatgaggaacttcaggagccatatctgtggaagtcctctgcaaactacagagcttcatgtgatcacctgtaacaaagcttggcctcaagataaagtggctcatttgtgggggaaaaaaaagcaaaattaactgactcacaaaatgttgtagatgatgggatctcagaaaacaacccattcccctggctgggctgcttttttttttttttagaaggagtctcactctgttgcccaggctggagtgcagtgtcccaatcttggctcactacaacctccgcctcccggattcaagtagttatctgcctcagcttcccgagtagctgggattatagacacccaccaccacgcctggctaatttttgtatttttagtagagacgagctttcaccatcttgtccaggctggtcttgaactcctgacctcatgatccacgtgccttggcctcccaacgtgctaggactacaggcatgagtcaccatgcccagccaggattttttttacaggtgggaaaaatgagccccagagtagatgggcagctgactcaagctcacatctctagttaaacatccttttattgcataaagtgatgccactggattgtcacatatacttctgtactgatttcctctctttggaaaaagtattagcatggtaatatagtatagtataaccaaatggaacttttcccagtttgtcttacagttcaaactctactttgttttattattaaaaatacacacactcacctttcagtgaatgaagaaatttgtattttaaatgtcgctaataacagcaaacttattgataagtaaaaatattacatgaacaaatcattcccagccccagctagagatccaaaagcaattgagaaggagttcttgaagaagaaaaacggaggaagttaaaaagagttaaaatgccaagagagcctgaggtccacagaaccatccttagggccttcatttcagaccctgtgaacgaacacttgctgacagcccaggactaacccaccaatggaaagggagctgctctagcagtgtctttgatcattatcatataatcagatccgtaccctgtgatcccacacacaaggcacgaggatcattctctctctccatgctcttctcaggtgcttatcgcaccttcaagagactgccctttgatgttctgttgaggcagatttcacctttataaacgggcggaaaagagcaggcagggatccagggggaagaacatagtgacttgctggatctgactgtgctcctgttaaggggcttgcctgataagtctcacagaaaaggacaatgttcttttctccgggaaatagcaggctttgacaagtttttaaagcccttcataattcaacaaatacaacccacgagggttcagaccaaggttcagattcaaagtaatcataaaggaagattattttttaatcaagagttgtatacagtaccacgattttgtgatacatgtttgtgcaacaggatgtcagatgaaggccctgcaccaacccagggattcttgtttcattcctacctgttgatgcctagctattaaaacatcaatattggaaatttcattagtaaaacagagaaggaggttggaatcttttacgtcccttccaattgaaagggctttgtgtcagtgaggaaataaaaaataactgtaccttaaaatgtatttttaaaaagcatgctctccaagtacaaggttttcctgtttgttgttatttaagcattctggcttcaagctgaacatccctgtgggctgcctcagtgctcaatcccatagccagcagtatagccctctctctggatagcagcatgcctcactcgcagagccatgtctagagagaaagagaaaatgccattagaaatgaagtgtgcagaactaccttggcactgacacaccagcttccaagttcatgtttattcttcaccgtcatatggttcagatatttcctcagtattgtgaatttctttaagagggatccataagtctttttcatgtcgcctccactggtgtgtgaattaggcattcatttggaaaataagtaccttttttaaatgctttatgtactcacaccaaatgtaatagattcttacacttacaaatctgtcatgcttattctctggtcattttcttttataaagatattctgatgaaattaatttgaagttttccagtgtggcctactccatttaaagggacaacataagttaaacttttcaaatttagagtccactttacttttccagtatactttccagtataagtataaggcaactgaaccattagtctgaaataatgccatgtatgtatttttgttctctttgcagagtgttcgacctacaccacaaaatgatgctataacggtacactttaaaccaattacattaaaagcatcagaaagtaaatacaccaaggttgcaagcattagttttgatggcaagtattcaccattttctctctgatagagtgatgttattttgataaactagaaagcatctgtattaacgtcttaatataaaaatccaaactgttttaccatcagaatttatattactgcttaggttgatccccccccgcccccccccgctgtaaaccatcatgaactcttacttgattgattcatgagagaaaataccacaactttataaagctaaatcagtattagcaatagaaaagcactagcaaatacattaggattggaatcatttccataatctgggctagcctttttacacatattatgtattataattcatcttaattatgaagttacaatatatttgaagttctgaaacatgtttgaatttgagagcaaaaataaaaagtattctttgtaacattttcatatattggcttttataggcaaagcagatcccctacttaagctaaaataatagactttatgacagaattgtccagttagctattatttctaatgtgtatagtatacattttgatacttgaggtgttaagccagactataccatttttatagcatgtttttatttagttttgcctactttaattggaacattcattgaatttgctgtcacaacatttttaaaataatgacttaatggctgcttaaccatacagataattaaatgagaattgaacctctgaacagggcttttttcataggcacccatgcaactgagtagctgctattaagcttaaactttggctttatgataaagccatctgtgctcagagtccacatagtaaagctcagctcctcatcggatgagaatatttgatcaatgaatgtaggaggacactggcacacttcacacagtgtttatgagagtatctatgcctgctgctcactgtggagagttctagggagggtctggagcagctacggaggtggggctggcctcagggttcatcctgtgagctcagtgaggactctcaaggaataaaaatcacataggcagcatacttcatgatacagttgtcaagaaatagtattatagaagacattaatgccacagtaatttctacatttgtggtaaagtgttctctatgctgctgagagaccacattcatgcctaccagtgtcagtatcacgaggtacattgtcttcccttacagaggaggaggcggctaatttttgtatttttagtagagacagggtttcaccatgttggccaggctggtctcaaactcctgacctcaggtgatctggctgcctcagcctggcaaagtgctgggattaccgacgtgaggcactgcacccagccaggataagagcatttaggacccacccttcacagatgtgccggaaaattctccacatggtctgcaagggtgaagagctgctctgcaagggtgaagagctactcttctctagctcctgtattgaccacccacttaatctttcccttcttgagataaatgcgatgtcattagtgttggttcttctgagatcgtaggctctaagataattgtttcttaaagaaatatgtaaaattaaataacaacagcaaagggaaagcatctttaagagcaaatgctacatttcttaaaagtaggtttttaatatcatgtgaaaatccccccaccattcacctctcccactgccatgctggatccccacacaaaatacctctgagattgctgtgaaaatcagtcaggaagtgtgtgttatttaacttttaatattgttagaatgcaccttatatatgtattaactctgcagtgttcatttatcaagcatctttctcatcaaaagttattcttcatgattttcaacagaattttcttgagctttttgaccactttatttgctatgtatgatacaatgtcatgaaatgcttaaatgtggcccttgtaatcagtcttacgtcagaacaaatagtgaaaaattgaaagcatccagagatggctaactagcaagcagagaaataagaggctgaatgggaatttttaaaatggaaagtctgtgtctgccatagtcaaacactagatgtcataccatttccttgttcttttttgtcatgaggttggatgacacacatttgcggaactcacatatgaattcttcacataaatggaagtgttcctaaagtactctaagaggataaacataaacagcttctttatttgctttgaaaagaaccatctaatgggtacctagattggacccaactgaatcaatttctgtaattccttatttatttatttattttttaatttttgtttttttgggtcagagtctcgctttgttgcccaggctggagtgcaatggcgcaatctcggctcactgcagcctccacctcccaggctcaagcgattctcctgcctcagcctgccaactagctgagattacaggcacgtgccaccacacctggctagtttttgtgtttttagtagagacagggtttcaccatgttggccaggtttgtctcgaactcctgacctcaggtgatctggctgcctcagcctggcaaagtgctgggattaccgatgtgaggcactgcacccagccaggattattcaaaactgctatgaaatctgaagtttttacttcatctaagatgaggacaatataatatgatgacaggaggggatttatctcctcttataccatgagttttagggttggctggtttttgagaagagctctgaattcttgacttttcttataccatgctactttattggtgatagagcaagactttggccatacaagaaatgttatttctttctcagttcaagtgtaaatcagcagggctaagtggggggtaattttgcctccaaggggatatctggcaatgcagagaggcattttggtagtcacagctgcagggatgctactgccgtctagcaagtagaggtccgggatgctgctaaacatcctacagtacacacaacagcctccgcaacgaagaattaatctggcctaaaatgttaacagtgccaaggatgagaaattctgctgtaagtaaagccaaagcctgtggctacagcaaagcagcttaggtacagtgttttacctcctgaaccatgctcaccagctaattccttatctgcttatcttattacaggaaatataaaacattttcccccttttgtatgaaaaatgtgatgtttcatttaaaatgttataaaaagtgttctgttggccaatttggaagctcaactttttttttttttaagattttgtcaatttacataaattcactaattctctttggtagtaaaaggtaacagagattattttttatgcttcctttcagcatcgaaggcaaaaaagccatctcagttttctgggaaaataacagttaaagcaaaggaaaagagttattctaaacttgaaataccatatcaagcagaagttttagatgggtgagtttctttttaaaataaattctattactttttactaatcagtaaattatattttcctgctaaatgacctgcagaaatactagccacgttcacataaacttgatggaattattttttgaaagaacagccccaactataaaagagaaaacctcctatattttgtttatattttacttttttagaagaaaagggtaagtgggatgataggatttgggcttaaatgaagacttaatgattcaaaaatctgattttttaaatattatttaaatcatttgaaccatttcctttctgacatttgtttgtaatatgtaagtgattgtggcctattattaaagtattttgacactcgaaacagaattctttatattcctttataaattcataaacacttctagaattacaactttttataaatgggaagtgacatgttcattttctattgtactttaaccaatagtagtttaatactcaacttggcaaagattcattttagcaaagctccttgtaattcagtgataagcatgatttttttcaaagtaaagctttttttgttgatatgtctttgattctaattgtatgattcatataattcattagagaatggttgtttgtattaatttcagtattttgcaagctaaattttgttttaaatcatatagtcaatcactaaaatattatagttctaaatctttaatacaatccctaatgctaaatgtaaattattacttacaacagaagaacttggattttaaattaacacatggaaataaaaatgatttattttgttcttgttgttttttttaatagttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagtatgtccaggagccctcatacttttaattttcctggtctaccaactaggtgatgctgacactttgttttttttctcttctgtcatttctcaggttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagatgtaagtatattatccatctttaacatttaaactccctgcccacctttaatgttttcagatcttattaggcagtcgtgttacatacggtttgccattatttgtgctctgcaaattgatctaattctcctagtcagtttttacctttccaggtaactagtttttaccttttctggcagctctctcttgtgatacagttgacttctctagttacagtctctacttagatcttttccacattctgctttctcttggatatgcttttaaactattgtaataatggggaatatagaaaagaactaaatagaaaaatgataggtagaaaaagaataatacaaggaaggtgaagagggatatacgtagggaagagatgatcaaaaccaagaaatatcgggacaaagaagagaatcagatagtaaagaagaaaataaggtagtaaagacgcaaagttggaagattatatatgacacagaaggaaacaatgaaggtactcctggtacagaaaataagcagggggaaaaattccaaacaaagctatcttgagagtgatcaatgaaagaagcttagataagagagaaaactgttaggaaagataaaaagaaagctaggacatctagaaatgtagccctttaaatagttggcatcgattagaattttagagctggagggaccttcagtaatgtctcgctcctgcttcagttattttgtttcagtgatcattggtgatgcttgctgagaccacatgctttttgcccgatcccctagggttccactaaacctctcttagtagtttagcttcctgcctctttcatgtgccctcagaggaagaatagcaactcagcagaagccatggctgttttcatttctgattactcaaaagactttcgtcatacaaagccctcaactatgtcgtataaatgtgtggttttatgcatatatacaaaagcataggaaagcatagaactgtaattttttttttttttagatggagtctcgctgtgtttcccaagctggagtgcagtggtgcaatcttggcttgcgggttcaagcgattctcctgcctgagctcagccttccgagtagctgggattataggtgcacaccaccatgcccagctaattttggggggaactttaatacatctttaatatagttactttctcttcataatattgttagatcaatgtgacttttttttaatctggttcttttatatctttccagtactttgtattgccccccaaaatagaggaacgtttcatagattttggagtactgagtgctacagaagcaagtaatattttatttgcaattataaacagcaatccaattgaggtaaaaacctgtttttattctaaatcacatttaaggattttatgcttgtgttgtgataatcattttcatatctttttttaaagttggctataaaaagttggcatatcataggagacggtttatcaatagaacttgtagctgtggaaagaggcaatagaactacaataatttcaagcctgccagagtttgaaaaatcctctttatcagatcaatcatcggtaagtaaactttctattgtctccttaaagtaagatggatgtctaaactgcaagtggaagatcattgctatgctacatgtatcactattatttttatgcagttcataatagtgttggttacttgctattaaaaggaccttataggtaatgtaattcaaccccctatttttatgatgagggcactgaaacccaaaggggtttaattctgccttgtcataaaaagttctataacacacaaatttttaattatctttttgtaacacaagtgtcattacaggagagattcccatgggtactaaactaaccttgtgttcattgagtttactgggaaaaagagatggccctgaacattggtagaaaatattttcaattatgcaataatacgtctgtccagatactgcctcagtatcagtgaggcaaacattgtttgatcactgtgagtctgcccacatatttttacctgtctaataaacatgttacagttggttgtcagagagcgctaaacaagagaaaacaaatttattagtttcagcactcaccagtactgaaaggggaacttggagtttatacctactgggaaaagaattagaatcacaatctgtgagaaggagcatcagataatctcatctgcaggttagaatagaatttcttggggcagttttacaaaaggaaaagcaagtgtccttatacacagagagtgttgacaaacacgtttccgtggaatgccataggtctggtgttttgttatatctgacctcagctgccctgaagatatgaatattaacattacagagtgacatccacagcttgaagcagagccagctgtgtatacaattgtggctccagtgtgcctgaaaggttggtggaaggctgtgtccctctgctccagcccctttggccatacaggtccatgggtaaagagtgaggagctttattagcaagaggaccacacccctccctctttcaggaaccagctttttcagtggcccatggaacaagtgtagtagagaaatatcaagggatggacactattttgagatatttgtacacagtgatatggtaattcagtgtcatactggtatatgttaggatttgttagtcattttatcgctacacccttcatgtccattttaataggaaacttcaactaacaaggctaatgaatgataccatttctactatctacaggtaacattagcttcaggctattttgcagtcttcagagtcaaacttactgcaaaaaaattagaggggattcatgatggagccatccagatcacaacagactatgaggtaaggactttatggggattcatggcagtggggtttttctgaataagtcagtcctttcttgtctttatgaaaccaaagaattaagtttactcagagttacagtttaccagtttcataccttaaaaactgagctttcgagaatagtttatagaatattgatgttcataggctcatagttttttgataaaacccaaccctcctaacctaaaaagcaacttcagaagaatgcctttagcacgtttagaattgctttgttagaaacctgcttaaacagatggttatatcattgcacagaccccagctgagtgtcctgagttagatacctctgattgttcctacaatcataaatagcagtcagggtctaacatttctgaaaaggaagataaaatcaggagatcatgtcctaatctgagtgctcacatttatattttcatgagtcattcaaagtcaagggactaaaggttactaagcttttaattaaaatattctgtgtggagcttattttgcattcagtaagattttgaatggatgtatttctgccagacctaaatgtttttaattgtatatctaaaagctcttaggaaagtcaagcactgctaaattcaacaacttaccacctttgccctcatagatgttttcagtggacacaactcccacgtggaaaaaaaatgtaattataaaataaacagaattggccatttaataataaatgatttgttgagagtatgtcaggtgaggaattcatggttatcactcatgacagaaataagtacatttcagaattcagataaatttttgttaatatgggtgaaaataagaattaagaaaaataccctagagaagtagctttgagagttactaacagtatgggatgggattctaactctagaatgttcagtgcatttttaaaaattaggttgatgtctatttctgtatcaaaaaaaaagctatataactctagatatgctggattttacatacattgttttaggagtacagtttgactttcttttttaaaataatctatttttatagattatttgtattttgaaatacaaaaatatttgtatttttaaaaaatctgtcttcattgcttccccgttgtttagtcttttttacgtgttttcaatgaatcactgagaaatctgtggaaatgtgttatatttcattacattttatggagtacattggacagattaaacagtatctatgggtgattttaatattggtatggagctggttattgtcaatattagtcccaaaattaggttaaccccaaaatataatgcaatagttatcaagatcaggctaagtcttaactacttatctatcatcatcttcttgacttcacagatcctgacaatccctgtgaaggctgtgattgcagtaggctcactgacctgcttccctaagcacgtggttcttccaccttcctttccagtaagaccattaatacacacatttttctattgctcgttttttgcctttgcctttagctctgtgttcctagaatcttagagtaaagtcagttattctttattagtcatttattttaaagacattataccaggttctttagaagatgtaaagagatacagtccttttcctcaaaaagttttctatctagaaagggaaatggacccacaattcagagctataaagcggaatgtagaagttgccctaagaggagtgaaaataaagtgctgtgagggaaatacacgtctcactgatgcaggggctatgggagccagcttagaatttcttccaacagagatggagaaggggtggcagagacgtgaatctagggccagggcgcaagctcaacagggatgcagaggcagtaaagtctgaagttggttcaggcaatagtgagttgtccagtttggcaagaattgagaaaagttttaagagagaaaatggaatggtctgtgggggtgataacatggaaaaaacttaaatgcacttaagttcatgggaatatgaagtttttgagtgaagacttgacatcatcagagctgagctttaaagactggctctctgcagaaagaaatagaggacacagatgaaagtaacaatagagtgcctggaggccaacccgcagactggccagagtccatgtgaaaagtgccaaggggagtttgagcgcatggctgtggctgaggcagtaaagtcccttcatacctccaagcctttgttgtttctttgcctcgaatgcccttcctcctgtccttccttcaaagaactcctgcgtgtctttcaagattcaattccattgtcatctcctctctgaagatttcttgactcctctagacaatactggttgtttcatgtgtgatcctagaatactttgaaattacccctcttgctgcaagcctcgtattgtgctataaatatttccttataagttggcctccccagtgagagtctgagatcctctaggaaacggatgagagatcgtttcttcccaatagcaggcacttagtacataatgtatggatgaaggaacaaatgatggagagggaacataggcaagagacattgcaggtgaatcatttgaactgtgcttatatcctaaagaggtcatacaaactgaaacaagtatggggaggagggtgggtagaggaggcaggaatatggcttagagtttgagcctggagaacaaagacaaaacaaatgagaaaaccaggagaagatgctgccttttgcaagaagatggtgcagtccattcaggaataccagggcagatgtaaaagtgtctcacatcctagtggtaggagacagtagtgggctaagagaaacaagacattgcaaaatcttaatgctgtatgcaagttgagcatccctaacccaaaaatctgaaatccaaaatgttcccaaatctgaaacattttgagaccacaagtggaaaattctacacctgacctcttgtaacaggttccagtcaaaactttgcttcatgcacaaaattattttaaatgttgtataaaattaccttcaggctatgcatataaatgtatatgaaacataaatgaatttcatgtttagacttgggttctgtccccaagatatctcattatatatatgtaaatattccaaaaaaaaaatctaaaacacttctggccccaagcattttaaataagggatactcaacccttacagtaaaacctgaattcaatatttaactccttaaaaatacaaactttgaattactagtttcatcacatttaagtttgggtcttaattaaatcctcatcttcctgtcattccactttgtactgactatactaaactcttgacttcgttatttatccaaaagagccatgtttcttccttccattaccttctcaatcaatgatgtccttaatctctgcgtaaactctggcagggaaaagttcagttcagaagacagcagatgacacagtgaaaagccccatgagtggaataaatgagaaagcatgtgtataaaaacaagatgttggtctggatccatttgtgttgctataaaggaatccctgaggctgggtgatttatttttaaaaaagaggtgtatttggttcacagttctggagactgtgcaggaagcatggccccagtgtctgcattggtgagggccttaggctgcttccactcatattggaaggcaaagaggagctggcatgtgcaaagatcacatggcaagagagaagagagggaggtgccaggctcttttttaacaaccagtggttgtgtgaactaatggcatgagaactcattactacgaggtcagaacgcaccaagccattcatgagggatccacccctgtggcccagacaccttccatagggccccacctccaacactggggatcacatttcagcatgagatttagaggggttggttttgaactgcttcagattaagctttcagatatctctaggaggcttacaggaccagatacttgcttggaattctaaattacctctatattaccaaatcctgtcaatctctttatcagatggagaatactagagcttactggaaacaatacctcagaataaacatttcatgtaactcatagcttaatatttgaatagaattgtgagagcagcatttatatctgtgagctcttttgatcccccacacccccaagagacaaggcacgagggaagtagttatttcaagtacgccaagtgcggtgactgcccgagggctcctgtcggcattgcagctgcatgcccgccctctgctggctgtcgggtgttttagcctcactgggctgtaaatgaggagcgctggcctcagtgtcacagtcattgcgccctttttcctgtgcacgctcttcacttctgtattttttattccaaatatttaaaaagtgggtttaatcatttcagagacctcttcaaatgagtaggaatctacaaaaagtaaaattttgtattcagccaaaagaaagattgtaatattcttctggaggattacgtaaattatttaattttttaatttaaaatttggtaccctgtcacagacagaagcttgtgactggtaagagcaattgctggttatttaacagttttatttgtgtgctggggtttttgtttgtttgtttgtttgagatggagtctcactctgtcacccaggctggagtgccgtggtacgatctcggctcactgcagcctccgcttcccgagttcaagtgattctcctgcctcagcctccccagtagctgggactacaggtgtgtgccaccatgcctgctaatttttcgtgtgtatttttagcaggaacagggtttcaccatgttggcctggctggtctcgaactcctggcctcaagtgatccacccaccttagcctcccaaagtgctgggattacaggcatgagccactgtgcccagcttgtgtactgttttaataagatacttgacaacccataatttcaaaagatgtgtaatttctctttgatacaaatgacatatatttttcctaatgaagagactttcttttaaaaaaaattgtgattttgtcccctttggctttagattttagaattcagtgatttcagggcattcttgcctgggtgtaaacaaaccttgcttaccaaactgaaagtaaccattccctttatctaaagctatctctgtttgtacctttgttggcatcctcagtatcttaacatgaaagtgtgaatgttaacgtcaatcagttgtcacaagattgcaaagatttgtcctcctgatttttctgtaacatgccacagcaagaaaaaaaagttttttggtgaggttttttggctgttgattacaatttaaagattatcaattgatgaacattctaagatgtcttttgggctttggtttcctagaagtatgcttgtctactctgaaacttgtgatcttaagaaaatttaaccatatacaaatgagtttgttctttgctttcttccttcaggggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaaggtttgaagatattatatttgagaattcccattggttaacattttgttttatgacctcctgtggatttgggattcatggttctcctgtgcctctttatagattgcaaacatttattttgatcctggactacagtgtggggatcattgctatgttggcttgccttttctatccaaatgtaagtgaccttgctgttctctctcatgtcttcacttcccccaaaatactcttttagtaagaggccgccacttttaaagtacattgctgtcttttgttactatagaaattatttgaaggaaaattgacaagtgagtatagatgcaggttaagtatgtttccttgttttagctgaacccaaagtgcagcctggtgtagccatgcaggaagatatgtgggatgctgactgggatttgcatcaaagcctgttcaagggatggacaggaataaaggaaaattcaggtcataggtgagtggtttatgtttatttattttagccatctttacaagatgactattgaaacataatgctttctaaattatattcttatgttagattattttgctttatagctaagaaagaatgcctaattttcagaaagttattagtgaggcatcttaaattgccattttaactgtatgttgcttggaaatatacatactgtcatttttctcttttctgtggtgctttagatatttcttacactccaagaaaatatttgaagttgttcttatgtaggatgacgacagtattcaccttagactcatccatttgcataggaaagaaagttttttacctaccactgatgtctgttaaaggcaagggaaacattttctaggtttacccccacctaggcacttggtacaagaccagagtgtctgttttcttattgtgaaaagaatacctccttccttttttttttttttttttttttgagacggagtctcactctgtcaccaagctggagtgcagtggcgtgattctcctgcatcagcctcccaagtagctgggaccacaggtacatgccaccatgcttggctaatttttgtatttttggtagagatagggtttcaccatgttggccaggatggtctccatctcttgacctcgtgatccacccacctcagcctcccaaagtgctgagattacaggcgtgacccactgtgcccagcccacccccttcctttctaagtgctgagctattcgggagcacacagggctccattcagacaggccccacagtgtttctttggcaggtaggaaatgtgcatctaatgacaaatcaatactgcacccagattcaaaaacaaaaaatgtattgatttggtagtatagaaatctgatcttttcatgtacttcagaaaagaatttgactagaataatgatagtatggcagctgatggaaactgctcttctcaagctgctaatttgaaatatatttgttagtatcaggatattcccatttaagagtactgtaaattctcaaaccattaataattggagggtttgtttatctgaactctctgctatgaaaagttttcttaaggcaaaagaaagtcgaatgtttactttaaaaagatggttaaaatgaatacaaaagagacttcctctaatggacttgctaagagaacactaattaaaactctcctttgtaccctgtatttccacagtggacattataaaggacaagcaagccccaaatgttaatgtccagttatgaacaaataacttacagtgttgtcctatgctcagctgctaaggggcctcttcacctcctacccacaaaaagcctgccctcctctctgtgtccccagcaccccattgctaagaccttggctccctgtctatcttgagtgcacagtagatgtgatattctccctgatcctgcctttgtgttactttgttatgtgtgtgttacagaggatttctgctactagtcatataaacttgtactcttaccagtattagagtatcataacactacaacaatagagttaggggttaaaatatgcttcagcgtttagtcccaggaatcttagctccatttataatattgtgtctttgggaatgtgttctgagttctaagcaactggcttatacacacttataagtagggagatattcagatgaggtcttgaatattgctgaaaactttacatgtgtctgcacaaaaccctcgtaggttttacctctgttgtcaactgatgtcttcattgaatctgaggactctgttttgtctttatatcaagggggaaaaaagccatatgccaagcaatgtactgccttctcattagtcctactgaaaatgtttttagcaccctgcttgtagatgtctagatctttcctctaggcacataagatcctttaggatctgcgtaacatcatgtattatctttatatgcctgccttttctaaataggttatctactataggccagcttttcttactgaatttatacttggaaaggtttttcgaaacttacgcgggattacattaatgccattggtattattcctaagatttatcatcctttctatattcagtacagaaacagaggatctgtgacagatattttggcaactctttgcaccaatatagagacatcatatagcattacaagcatagtaaaatattagaatgaataaatgtgttttttcagggccagcaaaaaatttctcaagtacataagcctaattgaatttcttatgttcagaagactcaaatatttcattttgatacagtgacttacaaattgtttttctagattgagtgctatatttgaagtaaatacagaccttcaaaaaaatataatatcaaaaatcactgctgagctctcctggccttccatacttagctcaccccggcacttgaaatttccacttactaatacaaactgctcctcagtaagtattcaaagtgacattggtttttggaaatacatactaggattataaagtatttactcttagctttaactatagaaatctttcatttaatgtttcattattttgtttaaggaagaagagattactttagaaaatcctgcagatgttcctgtctatgttcagtttattcctctggctttatattccaacccttcagtgtttgtagataagttagtatcaaggtaagtattgcttgggatcatcacagtgtttctatgtagtattgaattagtattttattcacttaaaaagccttatttgcagctcatacagattaatagatttgacgagaagttctggatctataaggttgagagaaggttttagggaggtttaggttgatactgtgcaaagcatccagaaaaactttcaatataaggcaagaaaaagtaatatggaactcccttctaaaaatgtgtaaagagaaagtagatgaaacctttcaaatattctagttttgaaaagtgaacaaaatattaattacaagttgtggcctttaattttcttaaggctataaatctggtcatattgatctcaaaacctgacagacaataatttgaaaataaagcacacacctgataatcactccataactcccttaactgtgatgttgcttatgaataaatatgtgtacattttttgttttaggtttaacttgagtaaggtggcaaagatagatttgagaacactagaatttcaagtcttcagaaacagtgtaagtattcaaacttcatactattccaaagaaattattttataatatgatcaatataaatatgaaagaaaattattggctactcttaaatttggctgaagggtaagttactgaagaagtcagagcagtccagtaattatttcagaggcaaaataaatcaggaagagtaggtgggatttagatcaaggtgaggcacattgagtaaaaggttcgtatttatgggcattaaacattaagcccatgaaggtttgtaataataattacagaaattctgagaatatatagatgaggtaaatattaatacatcattgatttttattaagcatcaaaatattgagctcagtcatttacattttcattctggatactttgtaattaaattgtaagccatccatgaatgctaaacccatgactggctgtgtttgtatttagcatggtaatatgcatgattttcactcaatggataatcttttatttataaacatatacataaactggtttgttctaggaaccaaactattttctattatttaggccaggctgagcaaccactaaccacacgttattaaataagacctaatgtaagggtgtgtgttgggaacttaacacttggagctaaggctccctgcaaactggtccaagccttttggccaccatgcccttgtttctgcccaaggccaaattcaaatctggttctctgattccagaagccttgcccttaccattgtatcatgtggtcactgctgatcaggaattgctatgagccttttcaaaccagatcccttgtagttcttgaaatactgtattctttcccatagctccatgttttaatctgtaaggcatatattagcccaatccttattagaatagtttttataactctgtctttaaggcgagcttacataagaaagtaatattcaaagtagtatttttttctgtcaaataatggctgggacactagactaaagtttagacagtcttgtattccagcctcatgcgcggctctgggaatcttttcgtgctttgcttttcccatctgtaagatgccaaagtaacaaatgttattggaagttatctagaaggctcagtaaccagaacttcctttcattctgcttttctttttctttttttttttcttctgagacagtctggctctgtcacccaggctggagtgcaatggtgtaatctcagctcattgcaacctctgctgcccgggtttgtgcaattctcctgcctcagcctcccgagtagcgggattacaggcacgtgccaccacacctggctaattttttttttttttgtatttttagtagagccggggtttcaccatgttggccaggctagtttcaaactcctgacctcaggtgatccacccaccttggcctcctaaagtactgggattacaggcgtgagccacagtgcccggcccactctgcttttataatagggagaaatttcacataagtattaagtgagctaatatttaactttcttattttattaactacaagccatatttacaagatgtagaacactgaactaagcactgtgagagataggaaaataagtaagagtactctagacgtcagaaatgtattctaaataagaaattcaggaggaggtcctagagtgagcttagagtaaattctatctcaggcatctctacagtgctatagaatgtggttctcaaaatacttggtctcaggactcccttgcagtcttaaaattattaaggaccccagagaggtttctggtttacatccatcagtgttttgccatattagaaactgaaactgaggccgggcatggaagatctttaaaatagtgatttaatttgtttaaaataataataaacctattccattcaacataggtaacatcaaaaatgaaaactacctatattttaaaaaatcatttagcaaggagaatggattttttttaatttttacaactctctttaatggctggctccctgacttaatagacaggtagattctcatatctgcctctacattcagtctctcttgatatattgttttgatcgaagtatgtaatgaaaatctaacctgctacagacatgtaattacaaaaagaaggagtattttagttgcctttttatttataacactgtacatcagtcttttggaaaatactggttcacggagacatgcagaccttacaaatgttgccacaattcactatgcactatccaaaaatgaatcatcctcgctaatctaaccaccaggctcatcaggaaactcttgaagtattgggaagctgtcatgctcacaatggtgaatacaaattatccaaaatcctaaattttgctcaaaagcttgaattttattagaaacaaatacttcagtaggctcacttatttctgtgaaaatacctgccagatgcccaagtctgaataaccatggactgtctgtcattctttcagacataaacggtgttccatgagaaaagcagctagttcagcttccatctcaaacagcttttcaaaacaacatggtagctgtagaaatactttttacatacttcccattgtatcccacagaatattaaagacatgctccagggttgaagtttttatggcataatcgaggactttttttttttttaaatacaaatgaatgacactgaaaaacacaatggctgctaggaaagtttgataccactgctttgatgcatgctaaggggtcagcagttttaccctccatggcttttgctgaccatcagtgcagatgccaacatagtgaaaaagacaaataacgtctatcggtattattatgaaaatagttttgacatcgtggtggatactctgacaggatccctgagatccccaggggtccaagggtcactcttggagaaccaccactataaaattattaaggtcctgaatggtatacgggaggcatcacaacatcttaaagttttccccaaaccatgagagtttaaattagctagtgcttgctgggaatatatgtatagtacatcattgtgtccatcagttaatcagagtagttgatttaaaagggaaattactcaccaaccatcttgaagcagttggaatattcttctgtcttagtggactttgacagaaaggaaaaaaatagcagttaacacttgaacaacacaggcttcgactgtgctgacgcacgcatacatttttttcaatcaagtgcagatggaaaatacagttttcaggatgcaaaactgcatatatggagagccctactttttgtaggcacattccacagtggccaactgctacttgaaaaatcgcagatttggttatgccaggaatcctggaaccaatctctggcatgtacagagacaaccgtatttacctcagaagcaagaattaaaagtaatgtgcttcataaagtctgttgactctgagttaatgtttgtggaatcatgctgaagcaagtagctagatctctatgtgtgaaacacacaccgatctatgccagggggagtagaaaacaatacaaaatgcaccctccttccatgatagcagaagccatgaagaactggtggatgtttatagccaagcgttgacaacccttccctcaaaaaagtttacacttaatgttgcttaaaaaccagaacggtatatccttatatgtgacctgtgactgtttttgtaataaaaaagcaaatgtttttcaaccttaactataactggctgtcaaaaagtcatattttgaatattaaactaagctatgctttaaactttaaatcattgggtgtttatgaaacagtaagcgtgtgtaaccttcaaaataagattcaaggagaaatgtataggaattggaaatctttttacatttaaacattcggtgcagcctgaagacccttcagctggtccccttcagaggggaggagtggcgtggcagtggcaggaggcctgaggtgttggccctggtcccctttagaggggagcagtggcgggaagcatcaggaggcctggggtgctggcattggttccacaagtgtttgctttgtgctaatgtgtctagctgatcatcttaggtttgtgtccttttctgtgtgtggaatatttcaaatttttaggttaaaaacaaaaaagatatgtatccaaaaacaaatgccttgtgcaaacattgaggactttatttggtgacctggggaagaaagcccctttttggacttaatgtagaatatgaatctcatcgttggttactctgtgctgctttccagctaacccatatctaaacatgacagataaaattgtttatgcatttaatcagtttgagaaactatactgggctctagatggggtgtaagcgaagaaacattcttccagagaatatattcatgactcctctctgtttacccaatgattcaaggctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcaggtaggttctgtgatataggtgtgggttcatttttactacttacttagaagtcctcacttgttttaagatgaatttgcatgtctaacttatgaaatagtttgaattcactttgtccaaaacatgcacacactccatgcctgatgaaacatacctttgttatcaaatgcatagttcaaaaacatgaatggtgtcttaatgtgtgtctcttaaaaataaaaacttgctcttctctgtgtatttttgaattcttaaagtataaattctcaccattaaatttaatttctatgtggtgctctgtaaaataacagtagaaattgcaaatcaaaagattgtgcagatttaatgagagaaaaatctgtaattctcattcttgcatagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtaagtcttcctaacagtttcaaggacactaatttcagcatttgctttcaacagtaaataatttcaaaaacaacattatttctgtatgtgcacctgtgtatattagttatgaatgcttaagagcttaaggaaattccatgttgtgtttagagttgtttgatttggatcttaaaagatttaaagtgtttgcactcattgcataccttagctgatttactctcagtatgaaatgtgaagtatagtaaacttttgccatctaaaatgatttatcaaagtagattacctcatgatgaaatctgaggaacagctgatctctctgacatgcagggatggtttataacctgtgacatatagtaattcatgaataatgtatttatcatttggactgggagcacatgatggcaagatttagtcttattcctgattttttatcctttaggtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtaagtattttattttaaggtgtaatgaatcactaactttcctcaaactctgtgcaaagatatgttttcatatttaccaaaggtctttatccacaaatgcattcatttgtttttttttcacttaatctttggctaaggtatttcttcatatcttagttttcaaagttgtaaattttttttcacttaatctttggttaaggcatttcttcatatctcagttttcaaaagttataaaactttatctccgaagtggatcagataatcttagaaatcaatttcaaaattattttcagggttacgttaaagcaaaagatgttgatgtaaattcacagtccctcagcaacagagatttgtttcatacatgtacagttttttcacgttttgcagtatacggatatgtaatattttggtcagaagacagttttaatacctatctcagtaatagctgcagcatattttaacaattaattgataacttgttctgttataaagtttatgcaataaaatgcaacttctgtcccttaattgaatatttaatttagtgatctttaatgaatatttacttaataagtagctacattattgcatataaggcataatgtttgacacctaaagatgcaatgaggaataagacacctttcctcaaggtacatacaattagcaaaaaataaaaatagaataattgcaacagtaatccatactgcaggagatgatggaaaaatcactaggccccagccagttggtttgtttttttaaaaaagacattattgggattgtagcctgggaaaagagcatggatttagataaagaagaaagaaggagagaaggacatgaagctcaggaccattttctgaattaataattatgagaatttgattattgttattttttagtgtaatttctctaattattcacagaatacagttgttcctattactgaccatgggacaatacttttttcatcttaaaatacggaagttgagtaaaagtatcaaacgcaaattctgtgttatatttcaaaggcttataggaccagtattatatgcagactgcttgtgagatatttttaaaacttagccttactaccatcattctgttttaggtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgaggtattgtgtcttgtttcaaggttcatattcattcaacatttaacactgttgatcgagtgcccactgtgtgccagccactgttctgagtgctaggatatgccagcaaacaagacagaactctgcctttatcaatctcacagactggtgggaacagttaaaacagagcccttcttgggtggcatatataataaacagtgttctttacctctgaaatttgttatacaaattaagtacattttaacatctttttaaaatgctcagataaagttacttgacttgggcatatatataatatacttaacacaatagtacctaggccacttgaaactgattagaaatattttttaaattctcagtgtcttcatctgttctcaatatattactttgtgtttcaagagtcagataaattcacctctaaactaatttacatatttatatcacacatcctttagaggaaacgggttggagagttgaaactaaaattcttcttagtaaaagaaaaatcaaattccaggcatttcttctaatacacataattattgcctccatataaaacctccatgtgagatggcattctataaaaattcatgagcaggccgggcacggtggctcacacctgtattcccagcactttgggaggccgaggcgggcagatcacctgaggtcaggaattcaagaccagccttgccaacatggtgaaaccccgtctctactaaaaatacaaaaaattagccggatgtggtgatgcatccctataatcccagctactggggaggctgaggttgcagtgagctgagatcgccccattgcactccagcctgggcaataagagcgaaactttgtctcaggaaaaaaaagaaagaaagagaaaaactgatgtgcaaacttttatccataaaactgtgggttttttgtttttttttttttttttttttgagacagagtctcgctctgttgcccaggctggagtgcagtggcacgatctcggctcactgcaagctccgcctcccgggttcatgccattctcctgcctcagcctcccgactagctgggactacaggcgcccgccaccacggccggctaattttttgtatttttagtagagacggggtttcaccatgttagccaggatggtgtcgatctcctgacctcgtgatccacccgcctcggcctcccaaagtgctgggattataggcatgagctaccgtgcccagccaaaactgtgggttttgtctgttaaaagttgtcacagacaacttggttttctattacatcatattgtactttaccaagaaactctgcctttaacatcgaattttgttgcttgtctactaacaaatgaatcctgattttccaattttttttacccctgcagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaagtatgttcacatgctggcaataaattccctagtgtacatagatttggctgataaaattacaataaaaaataagtttcttttcatctttgctcaggagaaaaaaaatcttaattctgattacttaataacaccctgtatggaactctgagtgacttagagctcatgctggatactgtgtttttattatattggtaagggttaaaatacttttagttagatcactgatggtaaattataaatgttcagatagaacagatgttagagagttgtagaaatttccctatttcttgctattttttccctagtgtagtttatatttatggtggctgtactgatgaagttgaagtttttttttaatattagattttgtaggttgctatttactgatctgcagttggtccctttttcagcttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaaggtaatcatctcccactgccggagatccgtgatgtgtgagggaaaagccagtgcgtgcttaaggagctattaagattatagttgtggtaaacaactaattcagtaggttcctctggctcagatttatctccagtgttggacttcaacttttccataaaaatgcaattagaggtatctgtcataaaagatatatttgtatttcttagattgtttaccaaaatcagaaattctgtggacatctgcttttcttttcagctgcctgagattgtgttattgtgatagatttagcttttgttttattgttaaaataattttgagcacaggagtaaaatggagatcatctgccttttaactccaaattaggatttctttactttagagcaggggttggcagactacagttagcgggccaaatcaccacctggttttataaataaagttttattggaatagaaccatgctcatttgttggtatatcctcagctttcatgcttctatggcacagttaagtaattgtgaccaaaacaatatggcccacagagctgaaaatatttgctatctggccctttgcaaaaaaagccaaccctgctttagagttctgcttactgtattaattacctatttctgagtaacagatgacctcaaaacccaggggcttaaaagaacgtatactcttatctcacagtttctgtggtcagggacatgagtacagcttagcggggtcccatggccctcacaggacacaggactgcagtcaaggtgttggccaaggctgatgtcatcttaaggttcaactgaaggtggacctgcttccacgttcacacaggcagttgatggtgggattcagttcttcacggactgttggacggagggcccaagctcctccttgctggctgtggccagaggtctgtcatggttcctctccacagagcgggtcacagcttggcagttggctcccccagaatgagcaaacaagagggcaaggaggaagcaggacggaagtcactgtttcttactatctaatctgggaagtggcatcccatcaatgttgtagtattctgctcattcgaagtgtggtccagcccacactccaggagagagaaccgcgcaagggcataaataccaagaggtgggcaccactgggagcttggaagtctgcaccacacacaaataggtagaccagtttgtaagctccagaatcaaaaggtaaaaaccagtaaatagcctctagttgtattgcaatttcatcccttcacagcctgagcttttttgcatcttcctttctgtcttgtggcagccatgctaatatacattattccaagcctgtatcagtcccttccagaatggtttaccaaggagttttgggcttcaatttatacggaaaacagggatcttggcagccctaagaggccagaagaaacttgacatcccagagtcaaggagttttagataattttttagtcccaggaatacaaaaactagctctattgagttctcttggaattacacgcattcggatttgtaaaacagtaagatgtcttgaatatgattggttaacctcttctacagaaatcctttttggctaacccattattaactgagcttacatattttagggtaatttttagaataatcttaagtgaatacttaaaagttcttttttaattagatcaagttacatagcgttttccccacatttagggcgtgaataaaataaatctgtattatcctttcttatcacaaagaaagagttgggcagtcaaattgactacctcattcctgtgtcaacacagtcttccaacaccagcgtgatgggccaattctattttcagggtcactcattgagaacctaaattttaaaatgaaatgctttttaattttcacagtggtcctagagtcaacctactaagagatactcagtgagggagcatggatgccacattattggtgactcttgagcctgtgaggagacagtggttagaagctttgcaggcgcggctactctactcactatccttcccactgatgctgtttgggaaaaaggaaggagcctgtatctatattttttttcttcttcaatgtttttattgaagtatagcatgcatatagacagacagtctttaaaatgaactttaaaaggtgggcattgatcttggggttgcaaactagtagtatgttgtgaaactataggcttccagctgggcaaaacctttataatctttcaaaagcctacccccacacccctgcaaatagcagatttacattaaatagtaacattctctttttagaggcaacacgttcttttttttctccccctggtatctcatactaaaattatttcttataatgagcttatgtagtttctggtttttggaagctgctcaggatgacctcttcaagtgaatgtgtttatctccctggatcttgccttctgcggttggatggcttgcaagccacacagccatgctatgccatctctccagtcactgcttccagtggaagatgatgcccagaaatgccgcctgttcatggttggcctgagcagggactcttgttgctgaataatcattagattctgtacttctttggtttctcccccctctaacacttaaaccccatggactggacagcagccactgcaggattgagggctaaaacccaagaaagccgtgagcctggcacagttgggtctcagtgtctgttaaccagagaaatgatggcgtctgtggccattctcgtttctggctttggctttatcaagggtagggagaggcagagaggtgtggcgtcctgaggccacgttctgccattaggcaggtgcagattatatcttgactccgctcccttactaactgtgtgacttgggagaaaatgactcccctgagcctccacttgttatttttaaagtgaagagaacagttactccccacatcataggatatcactactgccatggttattattggggcaggaagtggcacatgccatctgtagcctgctgagttgaaggtggctgtggagcatcccagcagaagcatctgttaggaacttggtctcaagggtaagaattgggacaagcagagaatcctgagggcaaggccaaacgagaaggcagccagcagatagcatgacagacagcataacagaaagcagtggaaggtgtggttagcacatgccagcaggcagggccaggcaaagcagaggctgaagagtgctcgcggagcctggacttgaggacattatttgtgaccttggaaagaacagtttgtgtgaagcgccatcacctctgactgagaccaagtcactgtggcttagagtaactttcacatcagactgttagtagtggccactaactagtgagtgttttgggagcttttactctttaacctgtattttccctatttaatttttaacaagaaaaaagtatgcatgtattgtatggtaggtttttaaaaaatatagagagttacaaccaagaaggcaatattttttatgaaaaatgaataatacatggaaacatggtgcttgaaaatatctctgggccaaggtcagaaagcctatagagctgagacagtggtgctgatccacacttgccaaggtttcagacgtgaccacaatttctcgtgcaccctggtgactggcactgcttgctacggttttccagtaaggcagcgctgggcagaatgggagcaagacccagtctgtgtgattctaactcctgcactgtgctgcctcctcgaagaaaaagagggagggggaagaaaatgaggagataattggtgaaaccatgtgcccaggtggtggagtgggccgagacccagtttggtagatgataaaaggatggacagtccgcaggtgtgcagatgtgcgtgagttggtagagatggagaggcaggatacgggttttcacttgaacttgaggagtcaacttgaggcagcatgtgggtttagggaagtttttacttgaactaagtcatcctctgagactgctgggggaagtggtagggtagaaacacaaaatagacaaagtttggaatagtcagattccacgttgctgagaatgttgtaggcccagggagtcagcaggggcaggaaacttggatctgtacgctggccccttcagcaacattggaggcccagccgagggccactgaggcactgcctcaggtttgtgtcactttctcacttgtaccctgcagcccagtggtgaagaatgaaaactgggtagttggtggagtaggacagtgctggagttctgtggggcagggacagcaaaaagacagcgagtgaggacgtcacaggagtgctggcaggagagcggtggggtgctgtgctggcagtgtcgaattagcaacttggggaaggacctttagccagaaggaacctcacagatagagaacatggatgagtcaagggatgggaaatccaacagattgaatttcgaggatggtgggagcaaggaatgttaggagactaaggtttaaaaaggaggtgtgagtgtaaggtttcagaggaaaagcagttctgggcaataccaggttcgtaggtgcagccttggaaatgggatgtcagagtgagctagaggtgaggtccacagtccttatgcaacactctgggtgcctcgtgtgtttgagaattcagaattttggaaaggtatgtagtcatgcaccacacgatgcagaagactgtaaaagtaggtgaacatcagcagccaccaaaaatatatagtcatattaagttttgtttctaaatgagtttggggaaaaaaacctttgagagttttttggatttcagatttacagataagagattgtccacctgtataaggcctggggcccagacaatgggaggtccaggaaaagaagaagtccgtaagtgtgatgccagcacccctgaagcctggggaaattctttctggaggtcacagttggtgattctctggaggttgtccagagatgtccctctcaggtgctgtcactgatatgacagggcctaacgtgggaccacatatgttcagagaacccatttgctagtgattgaaacttccctgaaatagttcttttgggtggcaattaaatgaaatgatttaaagtgggagagaggcaactaactagctcagactaacgattcattcagagcacctagctcagacaaattcattacacagcatgtagtgaagataaagacgaagtaaatgtctaggacatgctttttacatagataattcatactttgcctacatttaaaacagattagaggcagtttaaattatcatagcacatataaaacaatgaataaaagtcagaaatggtttttggtgtttcatctgttttttagttacggtactatcagcagaaacctcgaataaagttagttgttaccattaagtgttaagttgaactgcaaattttctggcagttatggttgaggaaaaatgtcatatagttctgaaggaaaagggggcataggagttcatctggaaaaaacagtttgctggcattaaattcctgcctgaatctgaggacatcgaatagtagaacggatatcgtggctctgttacagagactatggcaatgttcttcacatagatcctttctgtcggccccccgtcaaacccagcatcttcacattgaatgagagctcctcacctacaccgtgcctctcagatgaacactcagtcacccccacatgcacagcatttatggtgaccatgggtaagtatagctagtgggtggttctctacactaaacatttagcagcctaagtgttcttccacacactgaggttagccccaaggtaccccacagtcagagacaaatgtttttgtcaataaagagtttttggtttttggtttttgggagttttgttaagacagagtctcactggctggagtgcagtggtgtgatctcagcccagtgcagcctcccagacttaagggattcttccacctcagcctcccaagtagctggaacttgtaggtatgcaccaccatgcctaatttttttatttttatttttggagagacagggtatccctatgttgttcatgctgggctcaagcaatccctctgcctcagcgtcccaaagtgctgggatttcaagtgtgagccacatcgtatctggccacttgcttgttttttagctttttattttgagatgcttgtagattcacgtgcaaataataaattcagagatctcttataccttttacccagtttctcccaatggtaacacattgcaaaaccactgtacactattactatacccaggatagtgatgctgatacagccaagacacagaacatttccaagcccacaggaatcctcatgggcccttttctagccacactcacttccctccttcttcagcctaccccttagtctggcaactatgattccatttatgtaacattcttgaaatgacaaaattgtagaaatggaggagattaatagttgccagactaaggagaacttttccccaaaaggaatgtaccattttggtttttctgagtcagtttaattctctggagattcaccagtgcgttcctttttattgctgaatagtagtccaacttatggatgtactgtaggttttttagtcatttgctcattgaagaacatttggattatgtctaatttggggctgttatgtataaagatgctacaaatatttgtgtacaagtttttgtatgaacacagaacttcatttctctaggatatgtgcccaggagtgaatttgttgggtcttatgatagttgcatatttcattttttaagaaactgcaaaaacgttttctctaatgactgtgctgtattacattcccaccagcaacgtaggagtgatccaggttctccacatcctcagcagcatcttcatttttttctgttgaatccattctgataagtgtgtagtgatacctctttgtggtttttatttgcagttattttctaatggataatgatattgaatatattttcatgtgcttatttgacatctgtatgttttccttggtaaaataccttcttcatgtcttttgcccattgttttaattggattgtttgggtttttctactattgattttgagagtcatttacacattctaaatactagtactttgtcagatatgtggtttgcaaataatttttacttgcctgtagtgtgtctttttatccttttatagtccatgattcattttgagttcatcttgtatgaagtgtgaaacttagtttggagttcactttgacttaaagtggggggaagatgttaatttttaagtcactttcctaatagttacagggctgttcacatcatctgtttcatattcagtgagttgtggtagtagtgttttttaatcaagtggtccatcatttcatctaagttaccacatttatgtgaatagagttgtttatagtattcccttaccatcatgttgatgtctgtagggtctataggaatattctgtttcgtttctgatattggtaatttgtgtcttttttagttatttttgttcattttttggggtttttggtcagtcttgctaggtttgtcagttttactgatctaatcaaagaacagctttgtgtttcattgatttttctccgttgcttatctgtttcaatcacagcgccttctgttcttatctttgttattatctttgtcctgcttactttagatttatttttctgctctttttttagttatgtaaagtggaagctttaattgttaatacaggactttcccccccgttttatgtatgcttttagtgctataaatttcctcctcacccctgctttattgatgtcccacaaattttgatatatggaactttcagtttcattcccttccattttttttcttttgagactttctgtgacccatgaataatttagaagtgtgttgcttagtttccagtcttccaagattggagacttttcctatctttctgttattgctttctactttgaatccactttagttgggagaatgatttcacttcttttgatttcatttcttttaaatgtgttaaatgatttcacttcttttaaatgtgttgaggtttgttttatggcccagtatatggtctgtcttggcttatgacccatgggcacttgaaaagaatgtatattctcctgttttgtgtggactagtttataaatgtccattagagtctgttggttgataatggtgttaagttctttcctgatttttctgtctagttgttatactgttgagagaaggttgttgacatctccaaatgtaattgtggatttctcttttagatgtttctgctttacatagttttcagtgcttttgtttgatgcatttacatttaacattgctgtaacttcttggtggattgactgttttatcattatatcatgtccttctttgtttctagtaattttctttcctctcaagttcatctagtattaatatagccacctgctttcctttaattaatgtttccatgattttttttccatccttttacttcaacctgcctatatcattgtatttgaagtacgtttcttatagacagcatataatttgggtcatgatttttaatccagtctgccaatctctgtctttttaattacataagtagactgtctgcttttaatgtgcttattgatatgttaggacttaaatctaccattttatttttattttgttttctctattttctttttcctgcctttttgtgggttacttgtatattttttagaattctgttttgtctgtagcattttttagtgtatctcttttttagtggttgctctaggtatacattatatgtacataacttctcatggtcctggggtcatcattttaccattgcaagtgaactatagaaaccttatctccctttatgtttctttgctttcccccagttgtcttaaatatttcctctacatacatttagaaccaaatcagataatgtttgaatttttgcatcagtcatcaaacataatttagaagacttaagatatgaaggaaatcttgttttatttatatttttttcctaatcctccaaggttccttcttttatcatttcctttctgttttggtaacttccttcagccatttttttagggtaggtctgttggatatgaattctctgagttttgtttcatctgagaatgtctgaatattcctgaaggatattttcatttgagtataggattctggaatgacacttgttttctttgagtacttgaaaaatgcttccttttagcctccgtggtttctaatgagaaatctgtcattctaattgtattttccttatagataatgtgtcattttctctggctgatttcaaggtttttttgtctttagttttcacaagtttgattataatgcatcttgatgtggattcgtttctgtttaccctttttgaggtttgctcttttttttttttttaagtctatataggtttagtctcaccaaatttaggaagtttttacccattgtttctttaggtacttcttcagcccttcctttttctcctttccttctgagactttgataacacaaatgtcagatcttttgttataattacacgggtccctgaagctctgttctttttttttagtccattttctctcataattcctaattgtctgtatttgtttactgattatttcctgtctcctctgttctgctattgagcccatgcagtgagctttttatttcagttactatatttttcagttctgacatttccattttgttcttctttagcttctatttctttgctgtggctgttttttcagttgtttcaagcatgttcataattgctcattgaacaagcatttttatgatggctttgtcaggtaatttcaacatctctctcatcttggtgttggcatctgtttattgttttgtttgtgttttcatttgatttgagaaatttctgattcttggtatgaagagtggctgtagattgaaacctggaccatttgggtattaatgttctgagactggatcttacctaaaccttctgttttaactggctttctctgactgctctggcagaggcagaggaaggggttgtgccacctttttattgccaggtggagttagaagtgctggtttcctgctgtcctctgttgactcgcaagggcagggaggctcctcattactgctgggtagggctgggagttctggttcccatgttgtctttgctgacaccactgggcagtggtagaagtcctgactgtccactcggcctcctctgtcaccacctcagtggcaaagggaggggagagttggctccttagtgcctggccaggaagggcgttcattactgactgtctggaatgaaaggctcagctccctgcttagccctccctgatagcaccatcgccagcatgctgggatgtctggttacagccttgcaagggtggaagtcttggctcccactttggcctttgttggcatgggtggatatggcaccccagttcttaccgtggtgttggcctggagcctttgtcttgctgggctgcccctttcctgcacctttggcaagagatagctggcttttgtcgaggctttatttgtgcacattggtgtttctgagtggatgtgtgtggcaaaaagaaaacccaggaatcttactatcatgcctttcctcagaccccagtctccctccagtctgtcaccttctctgcctttcagagtcatcttctttgtttttgtatactgcctagagtttttagttttgcttggcaggaagaataaggaaaagatctactccatcttcccaaaagtgtaagtctccaggtgttttgtttgtttgtttaaatgagatttatatttcccaattagggaaaatcttgggctccactaagtgtagagactgaaatgggatcagaaagtcatttgtagaaattttcactgtaaagccacagattggtactaatctcacaaaaaccaaactcattggtcataaccactaatcctagaagagcattacagtctacttattgataggataaattacttataaaggattgagatgggataagcatttggacttgggttagtgagtctcagagcaggtcacagcattggtatatttcactgttgagaaggctaaacactgacttgtgcagcctggcagatgctgctgagcacttgccacgtgctgggcgctgtgcaaggcactggggctggagagatcagtaaggccttatccctgcccttaggtgcttaggctgtatgacgaatagagccaagggggtccatgccgggagcctggaaaggggcaatctcagggagaatgtcgcagaagagcttcatgtccagagacagacccgaatgattgcatgacctcagtaggtgaggagtctgtgtggagatcgtgggagcaggcaagcagggtgaccagcctcagggatgcttcatccgggcagtggtgtgaacccgacgaacctggctgctctaccaagattccttctctgccaccaggttcaccttgggcatatttctcacttggtcacttcaagggaaacacacttccgagtttttctaaaccgcttctccattcagcttgtaccatctttatttagatgggttaatttttattactgattatgcaccagttaagttgtggttcccgtacagctgggagacatcctgccttccccactgttcattgagttcattaattcatctttgagaggacagtctccctctgaattctgtttttttaattggcaaataataattatatatgttatacaatgattgcccctgataggtcaagggtggagcatatggaagagttagggataggctggagcagacactggtaaggtaggtgaatccaaatttgaactttatcctgtagaaaatgagtgacaggataacatttctaagctttaaaaatgtttcaaagggaagtcagggctactgacagtgtagaaaacggagtggggtgggagagtggggcaggaagagatgctcatcagggagacaaggccattacgggtggccaggcaacacttgaggaagccctgggctcagggagtggcagtggaggtgcatgagaaaggcatttgaggttttagaagtagaatccattcctaccgattgattgatggtaaaattgcattgtttagatcatttcttccaggtgactcagaattcccccaattctgttctgaatgacagcacctatccaccagagattcccaggggacagagaaataggaaatgaggccctgcatttttgccagcaattccccaacacaggtctctgataaacctggatagaatttatacctaaaagccagggtattcttttgtttttgtttttgtttttttttgtttgtttgttttttgtttgttttgtttttgtttttttggagaaaaggtctcactctgtaacccaggatggagtgcagtggtgcaatcataactcactataacctcaaactcctgggctcaagagatcctcctgcctcagccttctgagtagctagaactacaggtgtgtgccaccacacccagctagttttattttaaaattttttgtagagatgaagtctcactattttacccaggctggtctggaacacctggcctcaagtgatcctcctgctttggcttcccaaacctttggggattacaggccactgctgcgcccagccctgggattcctaaattgaccatacattattactgtcacctggaggtcttgttaaatagattgctgtgcctacccgcagagttctggttctgtaggtctggaatggggccatagaatttgcatttctaacaaggtcccaggtgatgcggactctggggcaacaggggacactttgagaactactgacctaacaaaagatttggaagagtctctcctttctctgaaggccagtttttctactggaacccagccctaaggaagagacaagacccttaggaacacgcttgccctgagagtcagcttactgcttcagcccacccaggggcaagcgggaggcagaggccactccctgtggggacagagactgcctgcagctagacgtcggccatccagtcttatcagtcaggttagggaaggcatccagtattatcagtcaggttagggaaggcacattgtctcccctcccactaacatttgaacttttgggtatccaaacagcagaagaaatcatacatggccctgaagtagctcctagcctgggtggttggattgatgttgataccatggaccagtggctctcagcctgggtgcacagtagaatccctaggttctatccagaactgttgagtcagaatctctctgaggggtggggcctagaccctgaggggtcgggcccagactgcagtattttctttttaacattccatgtgttattctgaagtgtgtctggttaagaaccataatcacaaacttgagaatccacacgatgtttttgggatagttaactcagttttggacatttgggacttggattgttgatgttaatgaaattgagccctagggagaatgtaaaggaaaaagagaaaaagctccaagggcagatctctagggaataccagcaaagatagagtcagcaaagaagttgtcagaagaaggggttcatggtggggcctggcaggagctacattctacagtgtccagtggaacgggaaggtcatgtagaatgaggaatgataggcatcatgggcttcaacaggttagagattcttgtcagcctttccaaaatcacttttgttaaggtgctagggacagaagtcgaaggactgcatattgagttaataaggtgatgattttaagataaaaagggtaaattactcttccatgcaataatttttttttttttttgagatgaagtcttgctctgtcacccaggctggagtgcagtggcacgatctcagcccactgcaacctccacctcctgagttcaagcgattctcctgcctcagcctcccaagtaactgggattacaggcacatgccaccatgcccagctaatttttatatttttagtagagatgaggtttcatcatattggccaggctggtctcaaactcctgacctcaagtgatccgccctcctcggcctcccaaagtgctgggattacaggcctgagccgaattaatcttttgttactgaagttttcaacttaactattgttatgttaggtattttttgtctactcatagcttcactttttgagtttagtttttgaaaattcatttccagccatttcatatttattatggaagtttcaggttattgtaaatatagattatttatacagatttactgcccctcacccaatgaacctaagcatgataaaattgtataattgcaggtgagaagtttattatatggggaactgatcttgactgtatgggaaattttgaagtattctcagcctgggctgttgaactctcagaatgtaagaaatcccagagctcatggagcaaagcaggacactccccttcctgtctaccatgatggggagaagctctggctcttcgatgtaggtcaggggcctgttttttgttggtttggtttggtttggtttggcttggtttggcttggtttggttttttgaggcagggtcttgctctgttgtccaagctggggcacagtggcacgattataattaaacaaactagtcagtcctatgcttgaaacgagatgccccttcaatttttgagacttactatccaagttatggtttcagatctaacacttcttgtaatcagtgtgcaataaatgatgaaatgacattcctggaaatcactaagcgatttacttactctttttctagctcaggctcagcagactttttctgtaaagggccaggtagtaaatgtttgaggctttatgggccacagactatctctgttgcctcttcttatttgtgtctttttttcgaccacttcaaaaatgtaaaaatcattcttagctcacaagccataaaaaacagactgcaggccagatttggcccatgggccatagtttgccaacccgttttaaacactgaggttcgagtctcccattaatggtggcattctctgggataacgcctaaaacattggagttttaattaagttgtattaagtcaccattatcgaaaagatgtattagaaattatgacccgtacagactgggttaaaatgtggcttgtgtgtcttctgcagcttgcacctgcctgcccgcccaggtgattttgcaggcacaatctgaggtgctagaacctggggctttctctgcctctgtctagtcctgctggattgtaagctccatgagggcaggagcttgcttgttgtttgctactatgttcccagcacacagaacactgctgggaaatatgttcggggctggttctcatttgtcttgatagcatccagatttttccaagtagttggctttccgtatgtccattttactctctgtccatatatatacacaacattacatagtactcatgcaccagttaccattcccagggattatgtaattcctcagtacagccctgtgtggtcttgtgtctccatcttacagatgagaggccatgatcaggcagctagtttgtagaaagctgccagggtttgcacccagccattatggctacactgctgggactcttagcgcccctaaagggaagcacttgagtggctcgttgtttatgtcaccatcaggcttccatctcccagcagatgtcagaggatctctggttttcacttctgtaacttttcaaagctctatcaccctttggagaatataagaacattctgagacagacatacagatttgtcaaaactgccgagtttgtccaaactcactgaactgtacccttaaaatgggtgtgttctattatatataagttgtatctcagtaaagttgatttttaaaattgttctcatcacaaagtcaaatggatttggaaagctttaattagagaagaaaaaaagaaaccttttttaatcagaagagtccagcctcttccaacaaaagttgtaattgctttgttttccaagctagctatttaaaaatcaggagttctggccaggcatggtggctcacgcctgtaatcccagcactttgggaggcccgaggcaggcagatcacgaggtcaggagattgagaccatcctggctaacacgacgaaaccccgtctctactaaaaaatacaaaaaattagctgggcatggtggcgggcgcctgtagtcccagctactcaggaggctgaggcaggagaatggtgtgaacccgggaggcggagcttgcagtgagccaagatctcgccactgcactccagcctgggtgacagagcaagactccatctcaaaaaaaaaagaaacaaaaacaagagttcttttactttaatttttatcctcagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggtacgggctgatctcacacaacaaaacacgagggagaaagagaggtctcctgcagctcacaagaccttccatctcatagattctggttttagtacaaaagtaatgtttaaatctaggatgagcacctactgaggaatggttcctgtgctgggcgtgcctccagagtcattcccctgcagacaacagtcacagctgtggggatgaatggctccatgtcctccagggaagaacagctggaagcatgttactaaagtaagatggttagaaactggaaacactgcttgaaagctagggactatctggaatagtaactattctacctcatgaaacttctttcagattttaaggatcaaaagaatgagaaggaactctaccattttaattaggttgtgtttttcctgtcatgttgctcctagcacctgctggaagcggggttttggtggccgcttactcccaagcagtagagtggtgaccgccctggagggagtgtggccccaggaaagaccccaggctttagtggcccccagggacgaggagcccagcccaggacacatcagcacgccaagaagctgcctcgcccgttggaggcctcggctcccagggctgttatcacagcaggaagagcagtgcaaagtgtcgggtccagtgggccttagtgacggggtcagattactgctgtgagtagtatggggtgtgcaagaaagggtaataattccactctggcgcttttatttttagataaatggatttcaaatctaaactgatcctaatatagcctttaatgttgtagaacagactttcttttttagttttagtctattgaccaaggaatcacttcttacagatttccagcagtgtcattcacatgcattaaaatgtttaaaatgaaatttatatgtaacttactttcaagttagccacctttccctttgcattccctcaccgttaccatggtcctccatctacccctagcccaactcctaaatagttctggagctctgtagtttatagcactttaacaaattacttcagagaaacagaaagccctgtgctaaactttgagtaaaatcccagcagtttaaaccctgtgcatcagcgttcggaaggcattttctgcacgactttctcccacttcccttcccacctgccagcctcttcctgctcacaccactgtggccccctctccagcggcccccagtggccagtgttctgtgctcacccactgatgtcattcttagctccctgttcattccctcctgtgttcccagcttcttccgtgctatttgtgcagctcagaactcacatccttcatgaggcctccttgtctggttactaccctgtcccctccaacgagttattcctcctgctcagcaatctgcatagaggccgtgtgcttttatttctctgcaactgatctcagtttgtcagttaatgtgtattttcttcccagctaaatcacaactttgataggtcattttctcttgcatgtcttctccaattctgttctacccattcagtcaacacataggaattgagcacccacgtgccaggccacgtgctaggtgcgtaggcaacaacagtggacaaaaggccacatccttgtcctcgaaaagctcatggtttacaagatacctgatgggtcaagtattcaagaaagacttcatgaataactcaaagtagtttcaaacgatatgtgagccagggagatgttttagccctagctctggttatttactcttgacagttaaatagattcacctggtgtgacctattaaaatccaggctgtcttcataatcataaattttaaagctcttgggtagatgctaattcaccacatgcctatagctcccctccacagccatcactgtcccctttgctgagtacgtccttccccatctgtccctgccagtgcttccgtaaacacagtatttcacagattgtctggggcaaagaaccaggttgcttttagtacacagcccactccacatgcagctccccaggcgagttcagcaatacctgagtgcagcctgggcaacatggtgaaaccccatttctacaaaaaaatacaagaattagctgggtgtggtggcatgtgcctgtagtcctagctactcaggaggctgaggtgagaggatcacttgagcccaggggtgacagagtgagtaccttgtctcaaaaaaaaaaaaaccacacataatacatgagtagatgtgtaccctgttggggagacaggtccactgatctcacactcagatgctgcaatgaagtcagattgccacagaaatccgtggggcaggttctgtactttcctggtcctggctgggccagctgggtagcacagctttaagatgcgtcttggatgtggccgcccactccagattccacattttagcgggcaggacagcccttctgtgctgctgcagtggccagtaacattcccccagcagaggtccatgctggcgtctgtcgtgtgtctccctcctgctagacttcaccatccttaggaggagaaactgggccctcttggtaatcctatggcctggcaccaagcgggtgacccgtaaatgtgtgtggatgaactggacaaacagcccctcccattgatggagcagctgttagcttagcattaaaccagccggaaccctgccgcaatcgcaggcaggcgagcatggcccctttggctgccgcactgctctcttgtcctgagagttgtgctcaggatggggtgcatggctggagtgcttgactttatactgcagtctctactgaacttttcttttaaggaaatacagtgttttactccccagtgcttgaaaagaagctaccaatttgctactgccactgccaccaccatctccagtcaggatatgagtataaattaaaatgacgttctttataactccaactcaccaaaacgtagtcgagacaaattttactttattttttgagatggcgtctcgctctgtcgcccaggctgagtttagtggcatgatctcagctcactgcaacccctgcctccccagttcaagcgattctcatgcctcagcctcccaagtagctgggattacaggcatgcgccaccacgcccagctagttttttgtatttttagtagagacagggttttaccatgttgcccagactagtcttgaacttctgagctcaggcaatccacctgcctcggcttcccagagtgctgggattacaggcatgcgccaccgcacacagctgagacaaattaaagaaggccaaaaaattgacagaaccgcagtgaagacagatttgaagaaacgagtttgtttttacgtatatgatgtgtatatttttacatctttgattttgtgtctgtatcttaaaatggaactaatttcagtcattttattaatccttctcagcaattaagtgtccattttttacaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccaggtgagagaaataagtgtacagagaaataaggtctataaagaagttgctggcgaaaaccaggtgctgttttgatttggccatttggctggctggttggcttttaggggagttgatagcaaaatccaggtgctacgtcacattcctcttgggatttttctgtcacctgatatgtactgttgttgactcggaatagccatatgcttctcaagtcagatatgcagagggcagagctcacgatctgttataaaaatttaggaggaaaatttctgttggtgattcagtcccaggctgagatccattttacttctgcacaaagatgaccttgacgattgaaccacaggtacaagcataactttcctccaaaagatctctgagtctgtcgaattgttaacccagttgggatctagagttccatgccataaaacttggaaaagtttattcttaccttaaaaatggttcagagcaggtgtcaccagtcagacggttctaccattaaataactccagttcctccccatggaatgggattcagtggcccccggggagggcttgtgcaggctgtttccccagggagatgagtgagttgaactgttgggttattaactgaagttacttcacattttcattaaaccttggctcagcatctacctgataattttagtgttggtgcatcagtaatacctttcctggttcattgtatagaactgtcatcagcacgggagctgctgtctacccgcttgtgggttgtgatcagtagaaagtgacagaggaagtcgaataaattaggtgtaaatttaaaaggaagacatggcttgtctgtcatcataagtgtgggccatagatttgtggaaggtctattcttactctgatcctgggaatcatacttgagttttgcaaaaacaccactaacctagactctgtccctagattatatggcttcaggcagggccagtcctgttctatagaacccaaaagctagtaagaaattagtgataactgcagtaaaatttaaccttgtccctgaatttatgaaataatacagtatatggtggtgcttagtaatgaagtatttgtacctaaaatttactcttttgtggcaattgttagttcaagtgaccaggtcccacaatttgttgagagcagtctggcccaggtagaaggaacgtcaagcagagtggtatcaggtggttgatcatttgaaggggagagagaaaaggagaccacctcttctgaagaggaggttcacatacttggatctctcctgagagaaatccacctgagacaccaatatcctggcacccaggacaggaataacactgggctactagctagagattcttcttcttggcctttttcaggcttaggtgagtgatcagatattttaaagtaaatgaggctaataagtccaaataatgaaaatcctcatttttacatttgcagaaatcttgtgaggtagacagacatgcagtaattcctatgatgataaattttaaaaccagtgcatctaagaattatcttagaggtaccattccataggtgactgtcaccaaattggccctgttgattagccctcaggcctgagtttagtattgttaagcagatagaacacactaatcctaacccccatccctgttccactgacttacattgtattctgattttttttacaagttgaccatcagcaaatttgcatttgaaaagttagtcaaagacgtcgcttgagtgtcattacctttgcaagggtttttagttctcttgtaaaccaaaaagcttagagtggtcagtcctgaaccgcctagtcaaggggcagttatagcaataacccgtgctctctcaatatgtagttaaaagataaatcattaccagaacacaaatcaagccgtgtgcttgaaactgtcttttgtaactggagaaatctatatgcaacctttcttctatcctcctttatctgatctctttaaactcactgatctcttgtttttctgaactcgaggatgaaagtattgagtcagaatttattagttcatcaatcatttaatcaaataaagactggtttttttaataaccggagaaggttggctttctgaacagagccattctgtgactccactgcattctgataataaatgtcaaacactgtcactcagaatcacagccagtactagctttagtgattcctgaaattcctgtcaccttttagtgtgttaatatataaccccacatgtctgaaggacaggtacacatcttttaataagatatgtcattaataaggcatatatcattgctgtctttcggaagctttgtgagaggtgataaagccagaggagtggctcagccccatccatccacactcccaagagttgacctcaaaaaaatcacttgctaggaaataggagggtggggctgcagcaacagaaatctgatctaaccgtgttttccagctgtggcaacatagaaatgggcctgcagacctccggaaaactgtagtctatggcagagatgccaaggaatgggaatcagatctcaggcactgaaggtttctgcagaaccaggaagggcccagggcatccctggtttaggaccctgagtattcactgatccttttgtttttctatttgtttatcaacagtatatgtttacataaatgtaataatctaaaataagcaaaagaagtagattaatcatattatctgtaaaaatctgcttaaataacactctcaactcaggcccaagggctgtgaacaccacactgcacacgccagccccagacctgtcagcactcagaaaaccctgctccacagctggtcatgtccctagctgtgtcctcagctctgcctctctcctccccagacagaaatgtgtactgtgtattacaggaataaaaataggccaggcttgagtcaggtgtaacgttgtgaaaagcaaaaataaaaagaatacgaaatctcagaatattaagaaaaagaaaaacattattattaaaaaatggaggaaaatatattataaaaataagccaggtgtggtagctcacatctataatcccagcactttgggaggtcaaggcaggaggattgcttgagcccaggagttcaagatcagcctggaaaatatagcaagaccttatcttacaaaaagtttttcttttaaattagccaggtgtgatggcacacacctgtagtcccaactactagggaggctgaggcaggagttagagactgcatagagcccaggagttagagactcaggagttgagcccaggagttagagactgcagagagccgtgattgcaccactgcactctagcctgagcaacagactgagaccctgtcagtaaataaataaataaagcctggcatctgaaccacctgtttttcctttttaaaaagaatcacttcagtctgggcacggtggctcacacctgtaatcccactgtaatcccagcactttgggaggccaaggacggcagatcaccggaggtcaggacttcgagaccagcctcaccaacatcgtgaaaccccatctctgttaaaaatacaaaaattaaccaagcatggtggcacacacctgtaatcccagctactcaggaggctgaggcaggagaattgcttgagcctgggaggcagaggttacagtgagccaagatcgtgccactgcactccagcctgggtgacagagtgagactctgtctcaaaaaaatgaatcgcttcaattaagttggccgttacccattttattcagaagccttaaaaaaggattcttgatagagatcatctggcttaatttaggaaagtatgaatcagcaaaaataacaggagttgtctggcacctttcttcttaaaaaccaattacttttacagtggcacagaatttagttttgtataaatagctacccacgcacacttaaaaatagatcacacccacaccacctccaccaccagagggctggtgtctactatgggagcctttggggtttttttagaagatgggttttttaaataaccctgtcagtcagaagtagaagagatacaaaagattttataatgtagcattcatcatctggcccataaacagtggatttttcacttcagtttgttatcctacctaaaattctagttatttgggctaacggaaaccctttggctttttggtttgctctcttactaattccagatataatacctacttattattatataatacctacttgtgaaatacaacgaaacaaaagaaaatgtcctttgaccctaccaccttataaaatgtttgtaaatagccttcttaaatgtatttgtttatttatgagctcacactttacattgaggatgttggggaatgagggtgttatggtgccgttagatcgggaaagttggaactcttctcacctttgaaatctcctgtgaatgagcacagcagattgcctctgacccagaacctagctgaaatgtactgtatcctgtgggctgggaggacagaaggcaacatggtgcgtgaagaacttggaggatggggccgggagtcctgagtagtatcacacacttgagggttgggagcagaaagcacactgaaatgtggaaaatgccggcgatgcatccattttacaccatctgtgtagactttgtagatttggaatgaaaagctagccatcagctcagccctgaactgacagctgtcaccaggagctctgtagagatccctgaggattcttggaagatttctccaaaggggccactgggctctctgagctgcatctcagcctttgctggaaaaggtccttcttggaccacattagctgagctccttccggaggtcctcccagtcccagacatggtcttggtgggcattagagatgtggcttcataaagaatgcgtttgtagcccatataggtattctactcacaatgctgtcttccatgggccagctacccagttcatttctctcagagattcattctttccagctgctgtctcccagcaggttttcctacctcacttattgagctttggaaacttaagatatatttatacatgcttattatcttaagcttacctcaatatctttcagaaagcgtcactctaaataaatcaataaaaaatatatttaatttttttgcttaagattaaccctgagttcaagaataaggaagaaaattcatcctagcccactccctgtagtaaccaggaacttagctctgggtcacctcataatttctatgagaaaaatttgttcagttttgaatagtggagtctctaatgttatagatgtgagatctttcaaaatcttcatgttcaggaatcccactggtggtggtctagatgctgggagagactcacaggcagaatgaccgcacttccagccctgagcagcaagttggagctaagggctttctttctatgccttatctgagatagatcctccctcacgttacgtattattaaataatggacctcagttcattgtcagcacttggaatagcaaaggttcagtctgcaagtgctgaatgtctgctgggcagtcttagctacagcgttgggcatgcagccagtcctgagttaggaccaagggtagataacgccccaggaagccacattagcttcctgcatgcagttgtattgtagaagaattacaatcttaatgacttctgtcctccaaaacagaggaataaatttgtattttccatccctgattgtctttcagttcattagaactaccatatactccccctttggaaagtaagcaacgtagaaatctcccaagcaagattcctcttccaactgcaatgacaagtggatccaaatcacgaaatgcccagaaaacaaaaggtattgtcatcttgttctctatgatcatgtcttacggatcttttcatagtgcactgtattaacaattgttgtgcattatcagtaagcagtcagtagttattagtcatgcaaggctaaggctgtgttcttgtcctcattagaaggttcattgaaatagacctgaaagaaaggaatgattctccattaaccatgttcttttctgatttttgtgcaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctgtaagtatagtagtttagaaaccacagggctccacttacccacaatccaccccactctgggcatggaactcttcaggggcatgttgctttaaaatacccattgacagtgctttgccagctaagagcccattgttaactagcctaatcagtggctaaactgccgtaggttgaaatcagtcctggtaagattatttacatcaggggactcattcaacaattcacatcagggctttttttttttcagggagctggtatactagcacaccactgcccaatgtgcaaaatggaatggtctgtttggagtggttaatcttctaaagaattgtttgccttatacaagtattgacttagctatcctttacctgatgagttcctcatttatagtgtaattgtttttgtaagaattccatcctctcaactttacccacatctttttacatgagcaacctacacaaaggtttcattatttttctcactaccttgaccttgtttctccagtttggcctgcagtaaatcaagacagtaggcacagtcaaccaaaatagaaatcctcaccctacagacacttgacctgaaatagggggcaacagagaccagaaaagggagcagctgacagcagggatttgagatcaagagaggtcctggctttaggactgattggtccgcactcaccactgtgttggagtgtaccagagggcaagtcaggaagaccagagatgcagtcaggtttgagcaacagtcgggtcattgaaggtgaaaggagttggacgaagggcaggctcactgggctgaatgagggcagagagccttggaggctcgggtagggcgtccacgctctcgccggaatgtgtagatacatcctggaaagagatgctctctgagatacatcctgtagccctatttgccatgagactttctggcaccttttagtactactttttgccaggggtgggatacaatcctaaatccttcactcagcaaatcttgaagaagaccgtgggtggtccgtgtgtccaggtgggatgcttctgcttcctagcgccccctgaggtttctgctggccattggctcttggcttaacactccacgatttaggcagttccccattaaacagatgccactttcagcaacagaacacagcccctggagccagtttcacaggggtgttctgaggcccagtgaggtgacatgagccgtgttggtgacgtaatgacacaagcatgcagaaccatgctgccgggagagcaggtgacagccagacacagccacaaactggctggcagcatccccacctggtggcacctgagccacatgttgacatcactccttctgtgtggaggggaaaggatgacaggacccaaccccagacaggagattttggtgccactcctcggggcaggaatgtgggaaatggcaggccagccctctggaggaggaactgtgaagggcccagtgccgcatgcctcagtttcctgcctggctcttccacagaggccagctggtgcatctgagcatggcgcctcagggcagagctccacggtgggcactgggggaagagatgcagagcttgtctcctcagcccacgtctgtgcagtccttttgtgtttttctagccaagcagtcccttacactggttccaagccctgtgacctctctgccctcactgccagcgttactaaaatgttccagcagagctccactcgatagagaatatgggtggaggaaacccagaagagtcggtcccacatgctctccatcacttttaccttcctgctctgccccagctttctcatccccttttatcccttcgcctcccttggtgtttcgtcttgcttagacctgaagttctgcgagcgctgttggcagtgccaagcttagtgcagttccttggggtgaaagcgttggtcccacccaagactgtgcagccagcatgtggcagtagccgctgggggagttgtgcagcctctgtgtaaagatctctccatcccaagtagcaccccttagcatggtgccctataccatctgtaccacatgagttgcagagaaaatgctccttgaataatttcatgatttaaaaaggcaaaaaatacaaagggttattaaaaggaaaagcaaatcagaagccacaaaggaaaattttaataatatttgaatcaaaacgttctctaattgcagctcgtgtactgttcagagtctccccttcactcctacctcaagcactgttcagtaggggcttttgctaacttccctttgcttttcctgtttcatttcatcatcactgtcttgggagcatctgtagttctgggccctgtgaaacacattccacccacaggagctgcccgcacctttccccaggacaggcacctcgggaggatcgagcgcacacaaaacggagcacagcctgctccaagtgtgggcactgcctgaggggacgagtcactgcaggggcggagcgaggccagaggaagtggctagggaagggtcaggacagttgtacaaatagcaagccgacagtgtagacgtggtgtcagatgggaggcctcagaggagcttgatggggacaaagattcgagcagggctcgtatgggagagcggtgtgagacacgtcctgagtgtgggcatcaggtcagcagatccacagaaccagcgaggaggggcccatgtcatcaaggggtgagagtgggcgggtgggagacaggaccgtgagtctggcaccagtaccagcagcactggggaaggtgagagagaaggtagcaggcagccctgaggatggcggagtggagagcacgggcttccaagggaaggctgctttgctcggcagggccatgctggaggcttgacctagccaagacatgggaaaccttgagccctgagccctgggggtaggggagaagcagcttgtgctacagggtgnnnnnnnnnnnnnnnnnnnngcagcaggcagagcgggctgcaatgtggcagtgaggggacgggagaagtggagcggggggtactcagggtacgcggaaatctcacaaggcaggaggggccagccaggtagcgagctggccaggcctgggctggggatcgtgccctgtggtgatgggaattcacaggtccaagctctcccccaccttcttcctcttgcagtagctacagcagcaccaagttgcacacaatagatgtgcaaaatgatacatttttctgataaaaggtatacatatttccgtttactgagtagagaatgttattttatgactgaaattttttgttttaatttcagagatggggtcaggctggagtgcaatggtgtgattatagctcactgcaacctcaaactcctggctcaagcctcccacctcagcctcccaaagtgctgaggttacaggtccgagccactgtgcccagcctgttttagatttttaaaacagctgtatagacattactttaaagggcacaggaatatactaggagcttaatagggatcagagctgcacatcccagtcacgccaatggagaggctttactgaacttggggattcagcccggaacactgcacctcccacagctgtaaacctgcgtgtaggcacaaggattttccaggtccccaggcagcggcctcagctgtccacccctggaggatgtggaagaccctcctcccctacctgaggtgggagaagtgaagacattgactgtccgccacacaacacagcagggaccgggcacgctcttgctcccctcaaatccccgagtgcagagagatgtggctgctttctctttaaaacctgttaaacagaacacatctaagagctttcgtttgttttctttgtagaagggcttgagttatgcatagtcttagagaacattcaaagtgatttggaagagcgctaatcaaaacaccacactaacgagcccgtttgtttttaatttccagctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcaggtaggcctgctgcttcctttccggttctcagcttgaaatgtgcctaaaacccgatgtcacaccctttaaatggaaacacttagcggccacaggccactgtctggtgttacttctgatggctgccagcttgtgtggacccttttacctggggtccacccccgcttcctgctgctgtgcccagctccaacagtaacccggttcccattctaatccattcattcttaccacctgtggaccgagaaatgcaccatttaactcactagagtgatattctcagtgagccaatgaacatttactaagccttacatgaagacctaaaggggattcctgtgagttgggagtatgggtttatgtgacactaattttggcctttggacaatttggcttaggacttagaagggcaggacctggtccaagaccgttgtgctgggtgaggtgctgcagtaggggatgtgtgcacccgggagggcagcctcctgaccacacagacaggatgcaggaagcatgctgttctccgaggcacggagcctcactcgtgtccgcctgccacagtgtaccgcaagcctgacagtcacggatggcactctcaccgtgtgcctcgccgtggcgtgggtttctgtgcatcgcgtcaccggccagcctagggtcaggtcctccccgccgttgcccaagaggcagtaaccactgaggctgggggagccaccccgcttctgggccttgccacaggagcacctcgccgtgtcctggcagggaaggagactccctgaggccccgccctttccggtgtcggtggctgccctctgcatttcctgccgagtggctctctagcattcttcacaaaagtgtgatcgaagcctctgccagtccctaaattgtgatccctgccctggtctctttcatagtgatcttttgttttcttacctttctccagaaagccctctatctctgtctgattaagcagtctgaggccccagagcatgtgacatgaggctgagcgatgctctgtgagctgccccgctgcagagaagcccactcagggctcagtcctgccagccccacacctccccgagacagggcactgctgatgaggaatgagttctctctttgcttctttttcaagtgaccctaaaataaaacagccaaatggaagcaaacacaagttgacaaaggcagcctcgctcccgggcaagaacggcaaccccacttttgctgcagtcacggctggctacgacaagagcccaggtcagtgcctttgcttcagagacctgccacgccaggcgccaggcctggtggaatgacctctgtcctaatgtgccttccattgattgaacgtccattgttacaggtgggaatggctttgctaaagtttcttcaaacaaaacaggtttctccagcagccttggcatttcacacgctcctgttgacagcgatggctcagacaggtacggtagaccaccactaaccgctagaaagacggaaggcttctcaagtcgggttagcaccttttatccataaatgggtttcagggcatttttcccctaatttacaaggaggcatttgtcagaagtggtcaagtgcctctaagaaatcatgtctgctgggtggaagcagaaagccggctgcggtgccttccccagggggtccagatagagaaagggggcacccatgcctgtctcagccaggcagacacacgttacacctgttctcactctcctccatctcctggtctgtggtaagatgtgatctgatcattaaaaatagaagagcgaaagtgacttgggaggggggaaatctggagcaaatactagccaatttatagtaaatcactggccacgcctctttcttgagcaggcttgtttatcatgcagggggtgtggtggcctgcagcagtcaccttggttgacttttccagataagcaacaatagagccccaatttacctactttgcactaataggaaatgagttctagatttgaaatagtttttaaataaatcttccagtaccaaaaagcaaacagaaggaaaaaatgtctgtttctctgcaaaacacttgctttgaacctggctgtgagctagtgatagggcatccggagctctggggctccctccgactcaacccttgtggtaagcagccattgttcagctcttccttttgtctgtttttaatatttgagtacccccagttgaagcagtgtctcctgtttgtgaagctgtgcactatggatccgtttgcactaaccaccatacatttttgtgtgttgcgttttcctcttgtaacatttagctcgggtttgtggagtcccgtcagcaacccaagcagccctgacttcactcccctcaattcgttctccgcctttggaaactcttttaatctaactggtggtgagtgtttaacactagatgtgtaactaataagcctgtggacagaggaagggagaggaggtgtggttttgtgtgctggagaacacagcacagcagcactgtggaagaggccccgcaggaagctccctgggaagggtcccctcccctcttcctccctcatccacaccagcagcccagaggggcagtggaccaggctcgacacggtgtgcgcacaccagttggtgtgagttccatggcgggtattgaagggcttcacagaagggttctggtctgaaatgggacccctgagtgtgccaggggtcctcttcttgctgtccagaactagaggtcaccatggaagcttcccattagctatcatgtgagagtggggaaagtttgcatttggatgtcattggtggcatatcagctcgtgcactatgcgtttgagttctggaggacactcctgcccctacttcctctgggctgtggtgggctggtgaagtgggtgtggtggctccaggagcagtggttggaggtatgccattgagtgaagccccatatgctatagtgatcatggcaaaaccaaatatggacttgatgactgttgctttatttccagaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacagtgagtacttggggctggggctggggcctggacctggcccacccactcgccatctgccattgctgtgacatggatggcactgacatagttataaacaacaaacagcagcatcagaggggtgggttagtacttttattgtctccattgctttgtcttcatattctgtcaaaatgactgatcgatgttcttcagagccattacaatcaggaagttttaggaagaacaactgaacagctatggggttggtctctggagtccctcctaatagctcaagggcattttctgcctcttcccaacctgtaaatggaccacaagggtgaccataggcctatggcaggttcagatggttgagggaagccttcggcatctgtgcaatgcagccactggccacccaggagcaagctagatactgcatttactttgttgctgagaagcacctgtctcttaggttagattttcaagagtgcatttgtttgcttcttggctaaagtcttctgcaaagaccatgctgaaaagagtattcttgccaaggaaaataattagtggttttggcttccacaaaattatgacagaaaaatatgaccccactgtgtttgcctctttgttctcagagaaactaaacatgcaaggttttataacagatatttcaactttacagattccaaaggttgtcttcatgtgtaattattcagccttatgttttaaaaccaccttaaccattctttaaaagagaagtcagcaaactttttttttttttttttgagacagagtcttgctctgtagcccaggctggagtgcagtggcacaatctcggctcactgcaagctccgcctcctgggttcacgccattctcctgcctcagcctcctgagtagctgggactagaggcgcccaccaccacacccggctaattttttgtatttttagtagagacggggtttcaccatgttagccaggatgatctcgatctcctgacctcgtgatccgcccacgtcggcctcccaaagtgggagtcagcaaactttctataaagagtcagatagtaactatttgaggctctgaaggccatgcttcaccactgccattgcagtgcacaggccgatgggcgcagctgtgttccaatacaactttctttacaaaagtaggcagagctggatttggtccacaagctgtcttttttaaaatatcacaactagccggcatgatggctagtgcctgtaatcccagcactttgggaggctgaggtgggaagatcacttgagcccaggagtttgaggctgcagtgaggcatgatcacaccactgcactccagcctgagtgatggagcaagaccctgtctcaaaaaaatcagaaacatctgctcaaatacatatatataacatttgttctaaagtaaacaaagtaagaggaatgcgtgccccagcctcatcttttctgtagccttacccccttacccacttgaccctctgcctgccgggctcagtgctggacgctttctgttttgtcgcagtcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaagccttgttttgtggttttttttacacacaaggtgtatttattaggattttctcacaccaaagtaaaccaccttatccttgccttactctgtggagctgacaggttaagacggggtttgccttctcattgctggaacttcctgcagtctaatggagttctgtgtgttcccatggcaatcatggagggtccttgatcgaaaacaacttgaaagcctgtttggattcatccagtaagcgttttccctctgccactatcctaaaaggcctcataaaaagcagtaattgctaccatttattgaatactgactctgtcaggtacctggctaacactttgggatatgttgggttactccattatacttgaggaacctggctgggcagtgctggctcagaggccccaggtcaggctgaccgcagattcacatggcacccactgtgctgccttccttctggtcacagtcaccattctcaggaacagtctgtgtccaactcaccactgcatgttctaacactggccaacctttaccagccttcagtctgaggaagttgtatggtgagaggaagacagaaaaggagagaagcggggcacagagggaagacagcaggggcacagagggaagacagcagggactcgggcagcctgggggagggctctgggggccacctgtgggagcttaccagcagcaacacagcatgcagtgcccctttggccctttcatttctaaatgatggcttggagacaaggggggatgccttgggctatggcacaggggctgggggtactagaaacagctatttacccactggtattaaaatgctttagcagtttacctgctaatacagctataccccaaagccaggctggatggaaagcaacctgtgtgctactgaggaatggagccacaggtggcagtcacacagggtgccatgtagaaataccagctggggctgctggaaacggagccttggtgcagactggaaatgacttagccaagcctgtaaggtgcagtagtaaagactacacatctaaattttattttttttcttttaactagaagtgtgttgacccttttccaattttaagactttcagctcctccatggtccctgttgagttcacacagacacgaggcgagtctcggtacgccacaacgcatcggttggtttaatcttgcctgttccaacttgcttttctcattgtcttgtttccagtctgtgttaaagccaggctttgctaggtaacataaatgttctgttggaggctagttacatcatgaaatcaaaactatccccatgaaggtgggagtgatttagtcaaaatgttatttggcgtgattgtgaacctgaccttttctctgctttataccaaagctcacagaacaagtctcattgttttgacaacttgtgatttgtccctcggggacaccagatttcctgtgcaaccagagctatggtgtgtaggctgacatcaggccttgtacaatgttagcagcagggtttcctacgtgcacttgcacgatcaggacaaattcaagtcttgggattctctttctacaccaaagcagataatgacgtgtaaagctctacatacaggtgagcttcatataaaccctcacttaaaccaaagaaaaactgggccaggcgctggggctcacacctgtagtcccagcaccttgggaggccgaggtgggcggatcaactgaggtcaggtgttctagactaccctggccaacatggtgaaatcccgtctctactaaaaatacaaaaattagctgggggtggtgctgtgcatctgtaatcccagctactcaggaggctgaggcaggagaattacttgaacctgggaggtggaggttgcagtgagccaagatcataccactgcactccagcctggagacagacagagcaagactccatctcaaaaaaaaagataagaaaaaaactgtattggcagacttttcctcagaaagagtatctcaggaattgattctaaacttgcttcatcagaacaatcgcctgagaccccccccgaccaaactccttttttaagttctaatttcaccccatgagcctcgccagcaggcttgagagaaacactgtgttcttgggagaagatacaaacaagggtctcttctgttacttgtgctttccaaataattactctaagggtaggtatttgagtggcaacatacccaccaaatctgaagatctgacacaactcagtctgtttacagtgaacacttgttggcatgatagtcgctttgtactaggccaaggttgaatttaaaattacaggttgtatataattatatttacatgaaatgatagtggatgtctttatttattttgagactgggtcttgctctgtcgcccaggctgaagtgcagtggcacaatcataggctcactgcagccctgaacttccaggcccaagcagctctcccacctcagtctcccaggtagctgggacaaaagacacggaccaccacatctggctaatttttttttatttttttattttttgttttttatagggatgaggtcttgcttcgttgccccctctggtctcaaactcctgagcgcaagcgatcctcctgcgtcagcctcccaaagtgctgggattacaaacatgagctgctatgcccaggtatcttatatgtttatataaatacgtataaacaaaggtataatcttttttaaatgtttttttacctaaactgtgtatcaaaggagtgaaattagaatttggatttttcatgacaacctgaaataatgtaaaggatcagaatctcatttaaaagactgttttagccatccgggaaacacagactccaaaggaaaggggtcagtgttccggagctaaaaggttaaggtctcttttatacaggcagaaaacacatttagtggaatcacggcattttccatatgagtctggcttatgagctacagcaatttgattagttacagcttgatgttttttctttccaattgaaaagactatatttaacattgtgatttagagagtatagtagttgtgaggtccttgtgtaagagaagaaagagggaaattataatgacgatcaacagttaggaggaaaggggtcttccctgctgcccatgagttttttataacattttacaaaacagtgtaggtaaagaaaaaggatagtctatgatcagagaaacaggttataggtgcctgttgcatgactcaggcctcatcatcacattcctttaaggctctaaataaaatttcaacagctttgattttgaattattttcacacaagtaaagtgatttagttatgctaaatttgaagaaagattcctttttgtcaccaaattattaactctcaatgtaaaaaatacgctttagtaattttgttagagatgcctttgagtagccttgtcctaattttacttgttcctatttcaaaatgctaccacagagttaaattcacccttaaaatatagaccaatcccagaaattaggtcatcacagatgactaaaacatttgctcccacatgggcaggttggaaaaaataaaagaacaaatgtttatattgatagtataaataaatgtgattggggctagtccacaaaatttgaatgctttaggaacaggcttctaaccctgacaaatgcctgtagaagttggataacaaagacattttagatgctttgctatcttagctatagtaatagtaaaaggtcattcaaatacaaagactcagatcctaatggcagtgtttgggctgaccactgtgctaaagaaacaagatcagcctatagaaacactcctgtgatctcaccggtcttgagaaattcagaggctgctattagtgtcagaacaagcccctggtttgaaaaaagaaaatggggaaagttctgatgccttttacatcttaggagggccagctgatgtcatgaaaaaaggtgatagtggaatctaacaaaaattcttcatgatgttacccataattagatagctgtaaaaataaattggcaacaatattaattaagccaggtaattttagaggtattgccaataatggttacaaaacatccccctgtgaatgaaatcctgataaaacatttaaatgtagacgtgagcaggaactggagagcttgaaggcccttcagacccctccaagtagactccatacaaatgccttctgccgtggattataaatacattctggttattgtttgtttatattcactgtggattgaaaatttccctgccagagtgacaaaaagtgcttgattttgttttccaacctggaaaatccccacttacttctaatgacagagatactcctttttccagaccaatgctgtggtttgtttggccctgctgagtctcttgttgaaatatgatccccagtgtggaaggtggggcttggtggaggggatggagccctcgtgaatggcttggtgccattctcatgggactaagtgctcacccttagtgcccacaagaactagttgttgaaaagagcttggcaccttcccccacctccctcttcctccctttctcaccgtgtggtctgcacggggctctccttcacctccaccaggagtgcacccagcccaaggccctcagcagaagccaatgctgctgcctctacagcctgcagaaccctgagccaaataaacctcttcacacattactcagcctcaggtgttcctttacagcaacacaaagggactaagacatactgttattaagaaacactgaagttgtgcctttaatccagagatttcactgtccttgttttctccagtcctctagaaaaacagaactaatggaatttttttaaaaatagcatacctctcagaaacctccaaaattctacatcttaagaaattaccattagcattatacgatcaaccacctctaggtcccatgttgcttcttatgaattcataacatgccactgtatacagtttgaagcttcatcccatcttagattctacatgattacattttatttccagctttatctcaacataaatatgaactatacagtatatccaaaacacacccgcctctacgtgatctacagcttctgtacaaaaggcacacaaagacacgaaatttattgctattataataatatgctccccatacgatctgtgcttcagtgggacactacatcttattagcccatgtcaggcttatattggtctgccacacactcatgtatattcagagtggttagatatgttcagatatttacaacacccacgtctccagtaatccattctttgaaagaatacccagcaatccagcgtaaaattatcatagatgattccaaaaccttccagtagcgatccttgatttgctcttcatgcatactctgcaaactccagttcccaccaaaggaataaaacgactagagagagagttcaaaactagttggtaattttagctgaagccataaacgagaccactctgctctgaaagtccaaccgactaatctaagtccattctttagagttatcaaggacagtcatataagctttattttcctcttagccagcaaagggacaggtcatgccataacaaatactccttttttatacctagaaaaacaccacaggggaacaggacagtttgtgactattagaaaaagccttgacctctaaagccaacccagctggcttctggaacatgcgcccattacctggaggcgctctaggcccttgtcttgcagacctgttacgaggactaacagtccttgcgtttctcgtaattacctgtaaatggttggctagtatctcctgtctagagttttagatggtactgcacaccatttctttcatcatgcgattcaacaactcgctttacaacagacaggaaaaaactgttaactctggtgtaactatagactgcgttcattagacactcttgagccagcctccactccagagcaaacccctgactccatagacccaccccccaaataagctaataaccaaggcccacatcctacaattgctacttcctgacaccctcttaggagacaccccagctcactgttgtttgggtcccccttgctgcagggagcaacaagcccagctgctttaactgcggtgcgttgctgctgcactgcggggaagggcgttgaccatttgggtgtacacatgagtgcagtggcatggatgagtgtggcctgggttccagtcctggctctgccatttactgatcatggcccttgggcacactctgcccctctcagagcctcagtttccctatatgcaaaacaaacatcctcaggaggatggtgtgaaacatgaggccaaataaataagtggtagcacttcctattgtctgttactgtggtattccaaagacatttcccagtgttaaacccctagaaatggcaacttcctgatggggatggaactcatttggcagggggcatgaggccaccaatctggagcctcctgagctccttgccactgcctggggcccctcctcccacgccctcatccctcccaccctcaccactgggtccaccgccagcctgggctcccgtttgcctcagccccgcctctcagcagaactgcggcagcatgtccagggacaaggttcttagagggactggatttggaccattcctcccagccagatattttgcagcagggagaggaggctgcatcagattcctatgcccacaaagcaccacctccttttccagttaaggcaatgtggggctgcaaattttcatgcattcaggatccttctgtaacttaattcctttgccgtcagtcccctcccgcttctgcagaatgcatgctcctagcaactctcacagacctgacccctgacagtcattgcccacccggaactccaaagccagcagggcttgctgctgcctagaaagacctattgccatcattcccttgtccctgctctataaacgtccttttgggaaaagcactcccatctccctcctttcccacacagacagcgcactatgcgtgctattagtctgtgccttttgtaaaaataggaagtgtcagccgggcgcggtgcctcatgcctgcaatcctagcactttgggaggccgaggcaggcggatcccgaggtcaggagatcgagaccatcctggctaacacggtgaaaccccgtctctactaaaaatacaaaaaattagccgggcttggtggcgggcgcctgtagtctcagctactcgggaggctgaggcaggagaatgtcgtgaacccgggaggcggagcttgcagtgagccgagattgcgccactgcactccagcctgggcgacagagcgagactccgtctcaaaaaaaaaaaaaaaaaaaaaagggaagtgtcacatccactgtaagcaatactccctctacaaacgcactcccagactaaaccgtcacggacctaagaagagcacatgagatccgcaatcagccccgggctcatggcctcccacgggagggaaagcctgtggctccgctttcaggagcaatgttatgggaagctatatatggaaactagaatttggccttacagtgctacggtgctgtatgttttataaaattagaatccagtgtcttttagaggtggcgggaaccttggagagtgcatgctgggtaggtgccccattgagaacaccctgagtgggagggaaccccgcccagctagcatatggcagtgaacagggagtgaggggatggcccagaacccgcacctggcctcacgcagccagtcgcagcacagaggccaccaggggtcagtctagcagcatcataagtgagaaagaccctggttcttctgctccatggagaacacccctgcagttcactagcccagcccatggcaggcggggaagcagaacggactcttcatagccaccagcctgttgcctcctcgcctgatgaaaatcagaccaatacgaaattacagagagaaggaagagccatgacttcttaaaaaaaacaaaatagagcttcttcttgatcaaagaaaacctgctttaaacttgccaagtggattaacagtttttaatcatttattataaatactgtaccaacacatcgattataaggaactggttttccccaaccattctgggtttagccccatcatcaacattgtgaataaatattcctaatgtagccattgccctgtgctaataaactttcaacaggtaagaaacatggcctcaggtgagatattttacaccacacagacatggagagtcaggcagagaagccacatgcctatcactctatccttgtggattaggtacaggccacccgttacttgggaaatttcaccgtcagtgtttcccacactggggttttaaaatctagacacttggcttcaagatgcattacaaagactaatagtcattagttcctgggaagtgtctgcattagagttggcagacatgtcctgcccacagccttccacactacaaagcagccatcttcacaacagatggctcggccagtcaccaatagcaaaaaaaaaaaaaaaaaaaaaaaaaaaaaaaacctcgtgccagtacaggccaggtccaatagacactcttctgacagcaggattttttcacactgagataaaattcacatcaaacaaaatgcactttaaccattttagagtataaagctcactgctttttagtgtattaacagtgatgggcaaccatcaccactctctcattccagaacatttcatcaacactgccacctcccccacctccaaaaacaacttccatgcccatgagcagtcactacccactgtccttcccctagcccctggcaaccactatctaccttctgtctctctggatttgcccatgcttaacacttcatataaatagaatcacacaatatgtggctttttgtgtctggatcctgtcacctcggtaaagtctttgaggtcagtggctgctgtggcatatgtatcagtacttcattccttcttatggctgaataaggcttccgtgtatgtatataccacacatttatctactcatctgttgatggacattcgagttacttccactttttggctgttatgaataatgccactgtatacacaatgcattcatgtaccagtttttgtgtgaacatacgttttccattctcttgagtattacccaggagtggaattcctgggtcagatggttaatctatgtttaaatttttaaagaactgccaaactgttttacaaagcagctgcactttgtaacatccccaccagcaatgcacgagtgatctgacttctccacatccactcccacagttgtttttgcccatttttcctttacctttttttttcttttggaagtgctatctcatttgcatttccctaatgattaataatgttgagaatcttttcatgtgctcattaatgagtcaatggtatgtcttaaagaaatgtttgttcaaatcctttgtccattttttacttagactgtctttttattgttgatttatacaaaggtctttatataagttggatgttagattcttccccaatatatgatttgcaagtactaggcccattctgtgagttctcttttcaatttcttgatacacttttcttgtacaaagagtttcaatgtcatgaagtccaccttctccattgttttcttttgttgctggtgctcttgtgtcttagtctgtgtgtgctgctgtcaacaaaatgccttagactgggtaattcatcaacaacagaaatgtattgctcccagctctggaggctgggaaaaccaagatcaaggccactcctgtccgggtgtgtcaccagcaaaatctgccaagcccttaacctcctctgaaagttctgctcacctccttgctgaagccaaaacttaaaaacacaggtctataaattgtggcatagacaacgttggttgtgcttgagcaagagaccttccattgtattttaatcctcactggacttacagagagtaactgtatattttgtggcggtggtgggtttttttaagctatttttaaaattgtagta

SEQ ID NO: 299 - DNA, 5283 bp, Homo sapiens
cggccgccggcctcctaggagcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgaggaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatatttgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacaggtacggtagaccaccactaaccgctagaaagacggaaggcttctcaagtcggaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatgctggacgctttctgttttgtcgcagtcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaag

SEQ ID NO: 300 - protein, 1530 aa, Homo sapiens
AAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEEEEITLENPADVPVYVQFIPLALYSNPSVFVDKLVSRFNLSKVAKIDLRTLEFQVFRNSSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIIFALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQELQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDRYGRPPLTARKTEGFSSRKFSANSDYLDRAIRPHRGAGTSLIVALHTFGSRQRQIPVLPGQPVPAPRPTQPHAGRFLFCRSRSSVTPAACGPPLHSAAPFGPATLAAPFPSPLQQTRWQASASWAQKTPLLLTLPPPPVQLTTWDRPTTRGGYGAPRLEEEARTLGLIRTFLTRIKLSKKQTNIVGPRLDHDVPVSETSF

SEQ ID NO: 301 - DNA, 49281 bp, Mus musculus
  misc_feature (1)...(49281): n = A,T,C or G
cagtgccaagagcacaggacgaatgctgctcagattacattagctgctacatgcacaaatgttagtttattgggttttaaagctgagactaacattttaagctaggtgttttcttatgctcctccctctttaggttagcaacagaaacaatggctttctttgtacaagattattttatgcaagcattagaactgcttatggaaagaatgcagaataaagggaaattgatatttgtctccaattaaacctccctacctacgttaacagaccccagacagaagaaaccatctggtaaccacagtgatcttgcagagagtctggaagaatttaataaaaatgaggttcacttcattcagctgaggatgcatgggtcctaaatgagttcatgatgctggaccctaatggtaaactgaggcagaggaggaaagctccaaagggcactgagatgactcagttagcaaaaatgcttgccaccaagcccgatgaccctgagttcaatcccaggctcctcatcaagaactgagtcccacaagttgtcttctgacctccccatatactccaggacatgagcaaacccacagtaaatgagtgactgtttatgaacaggaagacagccccagagtccggggtagagtgataggactgcattctgagggctgtaccagtgtgtcacttcatacccctgcacaggcctcggtatagcttactgtatatagctaggctctatggcacctgcatcacatatgtagtctgttgttagcaaaacatcccatgcacacaggactgtgtttgaatattcagtgccatgaatgggacagaaactcctcaaccctcacctgataaccacaggtagggaaaagacacagaaaccagaaaaccaggctcccaggaggtagatccagtcagtgtatccttggggaagttaaaaggaaacaactttttctttttcttttttttttaaagatttatttatttattatatgtaagtacactgtagctgtcctcagacactccagaagagggcatcagatctcgttacggatggttgtgagccaccgtgtggttgtgggatttgaactcgggaccttcggaagagcagtcggcgctcttaaccactgagccatctcgccagcccgaaacaaccttttcaacgcctgtggtgatttctaatattcgtgaagattattcggatgccgagtgacatgttgttgcgctgagtacactgagcagagagtaagacaccacagtgaccttgcggagcccgctctcagagggcgttatcactgccgtctgcctcggagcacttctcaacatctttccattagtcagaaaatatcttaataatttctgtaaccactcccacatagataaaccttacatatttaatacagtgcatgacccctgtacaaatgaaagaaaattaagtctaattgtttctagatgaatatgtctgttaatttccacatgccacttcaacatggcaaacaacagcagtgtattctgcagcagcagcagcaacagcttcccaggttctgcagtcattggaacacaactgtggagacatccagaatgctccatttaaaagagaagtcaaaaacaaaatcccagaaaacagcacaattcagtcactattgtggttccttacatcatcatcgtcgtcgtcatcattatcatttttttttttttttgagacagggtttctctgtatagccctggctgtcctggaattcactatgtagaccaggctggttttgaactcagaaatccatctgcctctgcctcccaagctcccaagtgctgggattaaaggcgtgcgccaccactgcctggctgcatttttttttttaaatagcttctcactcatcacctgaaaagaaaccatctcgagcaacatcagtccaaacatccctgaatcatcccagccactgctacacgtcaccaagcaggtacatgacccacacatcttaccccagccaccacaatacattaccaagcaggtacaacaggatcggtacatttttatgaagggacttctgtgcgccagcttctctcgggcccttgaggattcagtggtctctgattcatgaagtttacatttcacaggaggaagcagacaagcaagcaagcaagcaagcgagtgagagatcaaagtaatttcagatgtgaaaaccatgaaccaaaggacaaagcaaggcatggggttaacagtttagttgcagggtatgagtttgggaacaggatgggtggggctgactgagacagggtgttggggtcactccatgaagtggtggcagtgagctgagccatgacagaaggaaatgagctctctggcaggagcaccccccccctacctcctggagaaaacgacaaacctatcatttgtaaattgcatggaccgatttttttctggctcacttgtctaagtaggtatgcctggtgtgaacggggaagggaagggggctggtagcactggagcctagggaggcctacggttatgcacgatgtggtcagaagctcgcaaaaactaagtcgttgaatggcttggaattggggtttcctttccagtcccttgagaagtcactggagtgctggctctggacacgtgacccatgttgcacttgtaggaatcagtccaacttctcctggtggaatggggtgtgtagctgtagccagaagcaaggatactgtgaacaaccggttatctctctagagattggtgaccatggggtgaaccccaggggcagacatgaagaaggggacagacagatggggacaaggctctctacaggtgtgggagacttgcctcattaaaggtgttttataaaggcagccacaaggcatggcctctctcacacaggcagctttcagacatccatggatttgtttgagctcacagggtaagtcagtggagccagataaccattcccaccactaggaggtatgttgttactagcctcagaatgctttacctcaggtctctccccctttccatctttctgcttgtagctgccatcataatctccctcaaacacctctttcatcatatttaccttgctgataagcacatacgcgtattcatggagctattgagcaacgggagtaagctagtctggtttgatgggtgcggctcacacacctgagatacagcccttacttcctctaggattttatgagaactgacctgggcagatgctattaaaacacatgaaatgatggaatgagaactcaggtagatagtaaagttaataaagcccatggacaaggtagggcttgaaagaaagagaattttagcagtgaggctgagggagctctgtgaagggggaaaaaaagacacatgctatgctttcatatgagagagagaaagagggagagggagagagagagagagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataagcctttcatccccagcagtcaggaggcagaagcaggaggagttctatgagtttgattgaggccagcttactcttccatagagaccctctcaaaacaaacaaaaaccaaagagaattaaaatgaaatactaaagcattaaatggtggtgagtgtcctggagaaaactaggagtagtgttcggggactgaggggagactgcagtcccaaagacgatctttatggaagctctcacttaagaaatgagacatttaaacaaggcttaaagcctatgatataggaagctctgggcattggtagttaggagacagtttttgaggacagtctcagaggaaaaggccaacctccccattctcggagcagccaggagtcaaggtgaaacacgaaggtaaggtaaggtagcaagtggtcaaaggaggcatagaattttagaattttgcctttatgttcttgaactgtgagccacgcgggagctcaaggcagactgagatactgagttagtatctttccttcagcttaacagtgtgaatgtggccgccatttcttcctttccgtaaatttcttccttcatctgtaaaatagtcgagatgatgtttaactcgcgggggcgttgtgataattaaatacgctatgtgcaaaaacatttagcagttaacttgacacagagtaggcacgttctttctttccctgtcttcctcctgtttcccgggcctcccacctggtgctgggagggagaggtagggtgcaagaagagtgacatcacttcagagagctagtgtaacagtttcacgcgtggctggtgatggggctgtgaggacagacggcggtgggtgggtgggtggatgggcagtcttttgggcgggggccctggctctccaggcctcaactgatggcattttttagaaggggcatcagtgcggtctagaggaacgcacgcttatttgcctccctgtttaactctgcggtggtaactgatgaatgaatgtcttctacctggcgtcctgagaagtctcctcggatctgtcctgtggagcgagggcacttcctacaaagcggctctccatgtggtatccgggcagaaggccagcctggtctacacagagagaccctgtctcaaaacaaaaagaggaggtccgggttgggagcctgcaggcttcggacagtccggccaagggaccgcgaggccagcggctggggtccgcccccggcggcgccgcgcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgataacaatggttttctgcccttgtggtcctgttactgagggcttcaggcacagggtaaggaagacagtgtgttggaaaaacaaactgcattttcccctcttggtgcctgtgtgaacagttcttggtggtcaataagtagactgtattttgtgtttgtttacaatgtatatacttacattgacctggaactatctattctataacaaaattgtgactttagtgccgttcttttgtatctatttgtctctttatctgcaataatatatgttctacaagggaaaggagataaagtgtatatattaattttatttcaaaaatgtttggaaaagcagactaagaaactacagtgttgtattcagggctgttaactgtatacagtgccagcacttagtgcacctgttgggagtgcagtgtattataagcaaggcagaagtcacagaggttactgagaaactcttttatgttctttacattttttttcttgccaaaaatagtctttatctctgaatttcattcaattttatttccttgtacagaggtactgtttttagtactcaaaggattatatgttaaaattgatctgatcctataccaaatatttaaacccatttcccacagatagtttatagattaaaatgccatcaaatattatctttatttgcttcattgcctaaatatctttccccagcacagtgcagttttgacaccagcttcggcttcctattttgttgccctttattgcagaactgctctgatggctttaaaacagttctctgcagttgttggctccaacacagatgttcttaggccacctaacttctaacttttaatatccagtcaacaaagaataccgcaagggtaggtgttgggatagctgtcgacaagctcatgcgggtgtgtccacagggtatagcgtactatgcagaatatttgtactgagtgaagtcatgatacattcctttgagagccattagctgctacaaaacagtaatctggctgtttagatcaacaagctaaatgatagaagatgaaagtactggtttccatgtatttttactaagtgttgatgagaaagttgtaagtgacttacaggttactctgtacatctgtagtcactgaattcggaatatcttagagtcttacacacaaaggtgagtgttaaaatattgataaagtttttgataatcttgtgtgagacatgttctaatttagttgtattttattatttttattgtaaggcctgctgaaaatgactgagtataaacttgtggtggttggagctggtggcgtaggcaagagcgccttgacgatacagctaattcagaatcactttgtggatgagtacgaccctacgatagaggtaacgctgctctacagtctgcgtgcgcttgtaaaggacggcagccagccgctttgaaaaagatatcatttttatatttattagaaaattatattgaaagttatttcagttatatgtgatgtcctttagttccaaggctttaaactgggtgttagggaaccataggtgcaagaaagtccacttctcatgagagctcaccacagagaaagaaagtccacttctcatgagagcttaccacagagagtaaggtccaagatgccatccgtgctttgtatttgcattttgataaataaatttcatgattttgtgagagttaagaatatagctttgcctttgatctattcctgaaaggtttgttgttgttttatgggtttgttgttattgtgttgttgtttggtgtcttttaggcagggtcttactatgcagccctgaccggcctagaactcaactatgtagaccagactagctctgaattctcagagatccatctacctgcctctgctgcccagatgctgcgattaaagatgtacaccaccatgtacagtgaaagttactcttttgaaaacactttattgttatagattacttggaatgttgatgtgatgagaaaatttgattatactaggaaaatagaatcacttgatggttgagctttttttttaagacttatttattttatgtaagtgagtacactgcttctctcttcagacattctgaagggagaatcagatcccattaagatggttgtgagccaccatgtggttgctgggaattgaactcaggacctctggaagggcagtcagtgctctttttttgtttaaagatttatttatttttatgagtacagtgtcactgtcttcatacacacaagaggaaagcatcagatcccattacagatgattgcgagccaccatgtggttgctgggaattgaactcaggacctttggaagagcagcccatgctcttaaccactgagccatctcgccagcccccccacccccccagtgctcttaaccactgagccatatctctagccccgatggttaaaatttttaagcttaatacagtttgatgagtaagatcttcaggattattttcagacaattttcatttcatagaatcttaaccaattaaaggccaactgctaagaaatagaattgatacctagaagaggtcttgaaaaatctggtagtacctcctattgctgtcagtaggtttaggttttcctaaccaaagaagagtgtatttaacctccgagattagcaggaagggcttttcgttttttgtttggttggttggttggttggttggttggttttggttttggttttggttttggttttttagagacagggtttctttgtatagccctggctgtcctggaactcactctgtagaccaggctggcctcgagctcagaaatccacctgcttctgcctcccgagtgctgggattaaaggcgtgcgctaccacgcccggccaaggaagggcttttcacaaggtaattgttccagtatttatgtgtagtctaaatatattaaatttaatatcagtgaagtgtgaaataaatgttactttgcctttgaaataacctattgttagattatttttaggcatctttactgcagtatgatgatatcccaatctttagcttttcctctttgttctaatgtgccattttcagttctttgataggttcttatgtatcccaagatggctcttcaggtagctgagacctagcgtgcaatcctgatcatgcagcttccactccttgagtgacagggctccattacaggcttttatgcctccatgctcattctaggctgtgctggggaatcgaatccacgccctctgacttgctgggcaatcttctactctccaagctacatccttacttcatgtaccaatttaaaaagaagaaaaaaaaagacttgtgtagaattttgtagtgcttcagaatccatagctatgaaatctcaagtaggtcacagtgccctggcttgggtctctttctgtcttgaagaaacagtgtgctgggttgggctttgagggcagtggcgagcttgggaaggtgattatataacttagaatattgaaggttgattaaaaaattgttaggaagtgtcaaataatgttagtagtagtttaccacccttcaaaagatggtacttagatataaaaatgacttttatttgcttgtcaagtttaacaagttacatcagtgacgtagagctcctctgtactagtcttcatacactgatttttgacaggtcagctcagtgctgtaatgtagttctgctttttccttccagaaagatcaaaaaggtcatccattttgactggtattctaaatgcaaggttacttggcatgttataccatttaaatcacatgtaaaaggaagttttaatagaatgcatgtgaaatgtgaacgttttcctgggatttggaagatgctttcagcagaagttaaccttcattttccttgaaaatctgaggggttctattgtgcttcctcctgttagttcagaaggcatcccgaatatctacagcatgacgtcagagctgtaggagcagggtaaaatagagcttaggaagcctttagttcacgtttgctaaaatgtaatatacacctaacaattcatcatgtatgaagaaggtagaaaagtctataaatttaaatttctaaccttgattatgatttctgccatgccagaagacttgactctggggagcactgataacctgtgaactttgaccctgacattcccccaggtagtttagcagctggagaaaagtctataccttatctcacaatctgtggtgagtctgaggaaactgacatggtcctctcttggtgtggtttagctgtaagaagggcaaaagagcaaaagagatttaattgactaaaaatgccaacttcctacatgtacaaaaagtttcaattgaagaaaagtgccagagagaaaatgagagcatggaagctgggtctgggggcagacgctactcgatactgggaggcagaaggatttccagcttcatatctgcctgggttacagagcaggtgccaggtcagcctgcacagcttagtgagaccctgtctagagtgaagagtgaaggaggggctgtggctatagcccattgctgaagtgcttgtactttgggattccattacatctttacatttaaaaaatggcaggatactttttaaaaatttaagtgataataccattacatttttttttagtgatttcaaatttgtaaaatattatcctaggaggtgaaagagagcagtcactgcttctttgatttatatctgtaaacttgtgaggtgttttaacttggcctaaagatatttagctagtttgagactgaatttattaaactttgtgaaacaagtgataattccactacggtaagtgaaaaagtagttatctttgaaactaagaaaatatttaataatcttctagtctgtgcatcagtatactgtaacttgaatttactaatgactgcttgatggcagatacatatagaaaactaccatagaacatgttaatattggagatagtggatatgcgaatcaccttgacttctgaaatttttgtcctttttgaagtgcactagtttttcagttaactttgttagtgggaaatggttattgcaatatcatatgaagtcctcacacagctcaactagaaatagcaaagaaagaactagcccagaatatcagcagttctgagttaaagccttttgagctacatacagttttaaccattgctcagattaccaaatttatgtcccagtgataacttttattctgattttcaagtatgacatagatttgttatgttactgtgcagtatgttatcttactcttaagttgtattaaaactttttgactagaagtctattttttaaaagcagttttgtttgaagaaaactttcctctaaagctgtggccagctcatctcccttttttgagtgccctctagtggtaacttacctgcttttgtaataaataacaatgaaaactcaaggttgttttttgtatttttaacctttagatgcaacctgtaattctatcagtttataaatctgctaactttacttgggagtcttttatacagttgatatgtaagaggaaagaaggtcgtgtgggagagcacagggtgcatttcctttgtgaacactggttgggctgagcttgttggatgaagggactaaatgctgcagtacaacctgaatttgattgcttgtgctttatatgtgccttttagtatccttgttttcaaaattctgataatatttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttttatttattcctactttaaaagaattttataatcttattttatcatgagaacaaagtctttaatatccttgtttaccaatcaaaataggaatcttgaactgtcagttttcgcttgtttttttgtgggtcttgtccagacctgttgtgttttgacatggtaaggagaactgcaaagaccattttaagtccagatgtctgtggctgtataacgataaggtgtacttctgggtagtcattaagagccagtggtctgaataccactttgtggtcagtagtagaatgcttggtgtactgtataaaagaattataatggatttgtataacactttccatcttatgaaaggatttttgttgtttttaatcctcacctggctattagtcctgtgtatgattatatccattttcatcactgaaagaacagtggcttggagtagatgggagatgaagtagtttgataagtccataccacaaggaaggaaattctacagctgtcaatagctaaagactccaggccctgagtaccaagacctgcatgccaggatgtctttaggttgggaattaaaattacactcatcttctctacacttcgtctctgtttgtctttaaaacattgagctgaaaatcacatagaacaaaataacattttaaagtacacagccagtgatgactagttatttcttagggttacaactatcactgctatctggttccaggatattttcattacaccagaaaggagccccatacacattagtggtcagtccccaaacccttctccttccagcccctggcagccactaactactctctgcttgcatgtgcattgtcttaatatgtcatttaaaggaatcatgtatcattcagtgtagtttttgtgtcagatatttatttatttagtctcatgacaggatttctctttgtagctctgtcttggaacttgctttgtagaccaggctggcctcgaattctgccttccaggagctgggattaaaggtgtgtgccactgctgcttggccttgtgtctgatttttacatatttccagagtttgtccttgttacaatattagcacttcattcctttttatgggaaggtagttctctcttgtagacattccacagtttgttcatccattcatcagttaatgacatttgggttcttctttagagctcttttaaataacagttttgttgtgcatttatgttcagatttttttgtgtgactatctcttctagttcctctgagattggccaggtttaactttttgaggactagccaagtcactgttgagagcatctgtacctcatctacatttcctgctagctgcctgtgagggcagctgtgccagttagaccagctaagtgttctccatccctactgctttggccaccttagtaacattctcttgtcttcttgtaaggacttcattattcctcagttcctccttctccccctttggattttgacacttactggagtcagcagtgcactagatacttccacactgagaacttcatatggagaattaattaggcatgagaagactgaaaagacaacactgaaatacaatataacatcaagaagtggctaccactcctgatagtcagggattgcagcaatgatttgggggatattgtaattaaaaattcaaagtcttcacctgcaactatcgctggtacctctgagtgtgtgtgctgagctgaagcagtatctggaagggcaaaaaaatagctctcccgttccacagttcattccaatgcttgcagtcaggttggagagtctgagtgccccttcttacctagaaacgtttcagaggtgactggacagtgtaaagtgcggctcttaagagctgtgtttaagactctcggaagctggtttttgcttcattgttactctctgctatttgcctttatcttcactaagctaagaccaactgaactctttgaatctacaatactcagtgtggtatttcatgtttgtacgttttctctgctcctgtcttgagtgaccttctctcccctgtctttaagtcacataggcaaagttgacctcttgtatggtaccattccactttgtcctgcttagtgttaacatttatttctatttgcttaattgcttaaatgcatttcttttcctctggatctgcttcctccatatacagattgagctggttgtggtggtacacacctgtagttctatcacttggaagagtgaggcaggaggattttgaatttgagaacagtctgggctacatagtgatactgtgtcagagaaaaaaaacaaaacaaaacaacaacaacaacaacaaaaaaccaccaggcagacatggtagtgcatggctttaatcccaacacttggaagcagaggtaggtcatctctgagttctagatagcctgttacacacagcaacttccaggactacatgtttcagggaaaaataaacaaaacaaagaaaaagaaagataaaacaaatttttttgctatctttttgaaactatatacaaattgagtatcttacatgaaatgtttggaaccaaacatttttcaaatttaatttcctaggattttggaatgtttgtgcaaattttactggttggacatccctaatccaaaaatttagactttagaacatttttgttttagattaaggagctgtaatacctagcccaaaatgggacctttaggattgcagtaactattcctggagtatatagcatagtaggtaggaatgaatttataaatctattagtgtacttcacattctcccctcttttgcagttgttggagttttttaagagtgtcatgtaccctaggctggccttatattgaattcactagactctgacctcaaactcctggtccccatgcctcaacctcccaagtgagttctgggattacagaatgtgtcacccaagccccagccttggctcttcaattctgttgtgttctggtattagtcatatccagccgctgtgcatatttctagctacctttgagaactgagtgtacaatctttataaacagtggtatggaacacatcattcttcaatggatttaaatatttagaaaggtaataatataaagtgctagaccataaacagagaaagtcaatttcataattttttcccataggtgttactaaacagtaaaaagtacttgtaatacatgctaagaaaacagcaaatcactgcagaagtaaatccccaaataacacatgagctgatatttcagcatccctattcataacaaaagacaaaggcacagcctgaaggtagatcggataagacagtacctgtaataagcttattaccctgtttgcatataagtaagggctcagtacacatcagctgctgtaattactattaatagtaataggagtcctttcagtgaaagcctcattaccttttaagtttctgttcactgttgcctgtcttcccaagttgattattctaaaaaatgagcatactaaatataattgagttgcactagaaaaccacaggcctttctggtcattgagtttttctttccttgagtgatctcccacctcgaccccaattcctcttaatggttctacagataaagtttatgttcattaaagcataaaggccggcaaacaaacactttttaaaaagccatacaagtaaacaaaaaagatacaaaggagtcaaggcatagcagaagtatgaagattcaaaaagtaatattcctcaaataaaaccacaaccatttgtactgtatggaaacattttctcaaaatagaaacacaaaacttttgttagtgatgaatgggtgtgttctcagtgctgcttgggaaagcgatgtaatgcatggcgtgtgtgcaccaactttgtctttttttttttttaatattgagttttctcaggtagctcaggctagtattaaactcactgtacaatagctcagactgatctcctccctctctgggattacaaatgtctggctcaaagtcgggctgttttgtcatatcttagcagttgttcctcaattgatgtcattcttcatggtctaaaatttaagatacttgaaaaccttaagatacttgaaaaacctcagctttctgtcttatatgttctaaaatagttatattattctaattgtgtcaacataatatgatttgaatgaaagtaccatatattaaatttgttagaatttgtaattaaaaattactattgccatattaaaatttatggaatcttttaaaaatttatcttaaacttatacttagctttagaagacacttaaaacactgaagaaagccgggtggtggtggcgcacgcctttgatcccagcacttgggaggcagaggcaggcggatttctgagttcgaggccagcctgctctacagagtgagttccaggacagccagggctatacagagaaaccctgtctcggaaaagccaaaaaaaaaaaaaaagaaaagaaaaaacactgaagaatatttaaagctgaactgtttaaaaaaacaaaaacaaaaaaaacctttcttgcaaactaataaaatgaataaaaataaaaatgtggtttcatttcagatgagcagtgtctttagtacaatcttttaaaaattctgttgtgtttgtattaacataattgtaattaaaattacatttaggtttttcatatttgcatgtatttatattaaatagatgcatccattcaacagatatttactgattcctgcaatatttaagacttagcactgctacttttcagttcaaagcatgttgggggtgggcaggcatgagtttaattaaaatacatggcacaaaggaaacgttggaaatgttggataaggaatgctcttcagattttgtctttaagatagaagggaaatagaactgagagactaagagatgacatgatcaacatttaaagaacagtcctccgcttccttgaatagaacacatcctaggagtccaggaagtacaccagtgcctgccgagtagccagccagtgccttccttcatgtgctctagggatgcctgatggggtagtggtgctggtgggtgcctggatttatgggatattttgagaatagacaaacggtgtaatattgtgagttattattgattacctaatgtaattttgtaagatattttaagatacctcattagtcgttattttaaactaaactgttactttcttaaaatcatcataaatggcatcgtgtcaaaggttatgaacatttatattactttaactacaaaatggctttctgaaaggactgtgcctcatcaccagaaatgattttattccacctgcagtgccttattgccggcagagtacattttatttagaagttttatactacttcatagatggaaaaaaagtcacttttgctgaggataattcccctatatggaataacttctatttatttgttcttttattgtgctcagtgagtttaagtgactttattttgtcctgatttcctgaggacagtagtaagttattacctggtgtgccttcttcgaaggcaggaaataacactaatttaagatgtgaaatattggtgtttttctttgttccatcattaactagtcttgtagttggatctatttttaaattggttgaactttgacaatgtgtactttgataatatgattatttttaataaaggaaaacattgttttcagaatacctcaaatttatgaagttattttgctggcttacccacagggattggcaggtttttctgtaagggctacatgagtctttgtcacatcatcttcagggtctcggagttgctggcttcagaatcatttagtgtgtaaagtctggatcttggggcatacaaaacagtgggcaagatagaccttggcctgtggggaagtgtgttaagctttttgtaaaaacctcttggggttttagatgctacattgatacagagttttgttttgtttttccctactttttgtcaataacactgaaattggaacaaaatatttactgtacatgtatcattttaagttaatttattaatcttcgtgtgtgtacaaatgtgcacactctgctgtgtgtagtggttaagtaacaaattgtgggtattgattctctccttccgctggatcttgggaccaggctcaggctggcagatttagtgacaggtacctttacctgctgagccatttcttcagccctaaataccactttttgttctgcttgctttttgctttcttttcagacctgtggcttctttccagatcacacttagttatttagcatttttgacccttagtttttgttgaattgccctgtctttcatgtagcacggggactacatgcttctgagaatactggctgtagtcaaataacttcacagtgactgaatttttaacataaacccattgtttgcaattagcagcatagcttataagtaggctgtggattacactttatgataactgcatgtggatcagaattttgctgtcagtatgcatcaggaaaggaacagagtgagacaactttcccagtgtcttggtctatttatttgaatgagtgaatggtcattacagaaacatcttacaaaatacctgcagagccagctgttattttatgtgtgtactgtcaaatgaggtctgaaagttttgtaagttgttggtacaggggcgcacctgtaatgctgatacttaggaagtagaagagactaaagtgtggggctataattatagctcagtggtagaccatatgcttagcggatgtgagactctaggtttaatcctgagcgtgaagaaaacgaattcagaaagtaaaagcaaaagctaaacaaaaaaatatatttagcatcagtacaaaagagagacaagcaagagctgaatctccgtagaaattatctctgtcaaggacatgagcccttcaggctggtgaggtgctcagcaggtaaagatggcactggccgtcaagcctggtgttctgagctgattgtaaagtagtgtttctgatatccaagtcatcgtggataagagttgtgagcgctgtttttgtagtattaatttttaatacattttaaatctatataattacaagttttaatcttcacataccgtgtgtgcgtgtgtgtgtgtgtgtgtgtgtgtgtgtgtgtgtgtgtgtgtgtgtaagtaaatcaaagtttgccactccttttgtttggtttggttagttgtgagcctaacctttaatggctgagccatctttcctgactgtttttaagtgtgtagtttagcggcattattatattcacagtgttgtgtgaccattagcattgtttgcatttagaaagtttttgctctgtactcattaaacaacagttctaattatctttttcttagtctctagaggaacttctgttgttttgtctctctgagttgtcgtattctaggtgtctagtatacatgaaataataaaatgttacttagcatatgtattcacgattcatctacgctgtagcatgttttcagaatattgtcccccccttatgacacttaagttgtttctatgttttggctacagaatctctgctttcattttctgttttttgtttttgtttttgtttctttggccaggagtgcattaagacaaggtctcactatgtagaccatgttggccttgagttctcacagagatttgtccacctccttctcccaaggtgcttgccaataaccatcctaatgggtactcaatggtgtctaatggttttgatttgcagttctcttaatgatctcttcaagtgcttattggccacttgtctgctttggagactatctgacgtgctttgcctgttttgaatggggtcttctattgttgagctgtttacatcaccttgtaaaagatgcactgtaataatccagactgtgtttctcccttctcaggactcctacaggaaacaagtagtaattgatggagaaacctgtctcttggatattctcgacacagcaggtcaagaggagtacagtgcaatgagggaccagtacatgagaactggggagggctttctttgtgtatttgccataaataatactaaatcatttgaagatattcaccattataggtgggtttaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagatctggggatatgaaccttccaatcagcatcttggatatccacagaaattgggaagaaatacattttttccccaaatttagaatttatttatacgttgcattgacaacaaaacataaaaaagactttgcacagaatacatattgtattccctttagtgttgctcttaaaaaaaaaaaaatcagtcttcagggctggagaaatggctcagcaattattgactatgttgcttttccagaagaccaaagttaattccaggtgaatgtccatttaaggcatctcctaaccacatgtaactctatctccagggaattcaatacttttggcctgcactggcacctgaattcacatgcatgtacctatacacagacacacatatgtgtggttaaacatggaaactgaaatcagtctttcatgattgtctttgtgtctgagtaatgcaggagcccttacccatagctttgttgtctgatgtttcactcatgtgcacctcacctaagtatgaaaatacgaaatgggaatttcaaaaaatgaaggatttctaagttttgaatagtttttactatatattgttatgtttttttgttttattttcctactatattgttaattaaactgaattattgacatgtactggaggagaagatagtatatgaagagtttggtaccatccctagtttcaggcactcatgcaagattctcagaatgtttacccacagatggcagggagagtcctgaaatgtcagttatgttgatgctgttaactcatgtttggtaaaaacacacacattttttcttgagatagggttttactatgtggctttggcttgcctggaactcactttgtagaccagactgtcctgaattcacagaggtcctactgcctctgcttccttaatgctgagattgaaggcatgagtcaccatatctgttggataaaaatattttcaattgtatacatacacatttacatatatgtatcatatttctaagataattttaaaccaaaatgtttgaaacttttgtatatttcttatttttatatatgtaagtgaacagatatgtaagattttttttttttttgtcttagagggaaaataagagaagtgaagacaatttggtagggtagaaactaggattcatatgaagaaaccactcagtcaagctttgtgagatgaagttgagggcaaggtttgaagtatttttgtgttacttatgcttctgcttcactttgtttcttccccagagaacaaattaaaagagtaaaggactctgaagatgtgcctatggtcctggtagggaataagtgtgatttgccttctagaacagtagacacgaaacaggctcaggagttagcaaggagttacgggattccgttcattgagacctcagcaaagacaagacaggtgagtacaactggacagacgtgagtctgtgctctgcttggtgctccagatggtgttcgtcattgatcttcatttcctgatggcatcattaggggtatacatgctaccataactcttgtttcatgttaatcatctaatgtgattctccagtctttttattatcctaacatagaaataaaataagataatgcttatttggcaaatgttttctcttgaatggagagtacttcttatccagggacctaatattacttggattttttttctcttttctccccctggcccctctgtgggatgcgggggttgaaatggtctctctgtgtactccagcttggggttgaactctcagtttcctaagtctgtcttgcaggtgctgggatgacaggtatacttcactatgcctggtattttgatttcttttcatattgaaattttttgttccgtctagagtacattttacatgtagggttcaagaaatgtggaaaaaattttccactgaaatgataaagactaagaacgatggaataaagttttgggttttctattttagaagcagttttaaggatttgtttttagattaaattttgttgtatttgaagaataacattttggcagaaagtttttgtggagctattctttagggagaatgttgtggttaaaataagggaatatttagaaagtaactagacagtcttaaaaagtgagtttctgtagttagactggtcacatgggcatctcctgtgtactagtttgttcacagttgacttagagtttatagagacttgatgtacatcactaggcttcatggtagaggagctattttattcaagtccatcccacactccaaagacaggaagaggtttgtttctgtgttctatttccaagtcttgttgattttctttagaagtagcacagaaaatataatatctgtaactttcccctaagacttcttatgacataattcaatgtaaggaattttattgaaaatatactatatagatttttaccaccacactttactctttccagtgtttaagcttgtaaagggacctttcatactagtaaacatcactgctgttgacatctcacggaggacagggaaagcctgagcctgggctgtaaacgcagaagcgcttctcacacttgaacacacacacaaaccaaccgaccttgctaagtcacatccagatgtactccagtggacttgtgctggagcccaggattgtgcattccttggaatggttgggcagtgctggcttgggagttgggcccaggttgagtagaggtcatagagcacagtgaacggagtctctgggttacctctgggttgcgctccacttctcacttggtaagagccttaaataactgcatttcatttatgatttgtgtttgacattaatgctttggtgtgctgtggttcattattgattagaacactgcctactttctttttaaaatagctttctagctttaacaatgttttgtgacacatacacacacacacacacacacacacacacactacctacacctttaaaaaatgttttgctttcttcatttgtgtttagtttttggtgttttgacagtgacagcccaggcaaatctcaaactgactatgtagtagagactgtccttgaactcttgcctctactgcccatgtgctgagatcacaggcatatgttaccatgcccagttcactctgacagtttaaagacatacggtatagaaatacatgaacttaaatttgatttttaggtaatgtgagtcatctgacatgtatagagatacagaaacttcttaagcagtgcttagcccttcttgtgtttattcctattttatttgatttcttttatataacaatatattgcctaactataacttggatgctagcttttcactggacttgttttatttagaaattaatttgctttgaaaaatcattaatggttcttaaaaataatttaatatttataaagttgtggaagattctaaagagctactccaaataattttggtaatttataatatctaaggtacatttttttttttcctttttcgagacagggtttctctgtgtagccctggctgtcctggaactcactctctagaccaggctggccttgaactcagaaatccacctgcctctgcctcccaagtgctgggattaaaggcgtgcgccaccactgcccatctgaggtacagtttaataaattttacctctccaatttttgtgaagatttgaagctccttttggggggagtattttgttacttttttatttgcttatttgttattttagctatgtatacctgtccttaatgtattttgtcaggaacctgttttctgcttgaatttttgttgtttttcatgagcttaccaaaagcaccaaaagacttgtatttatggtaataggaactgagtattcactcagaagttctcagagatacaagtcagggcatgacaattgttttctacagaggcccagatggcaatgtgctatcttatacattattttccctaagaagccttgaaaattaaaactcgctgtcagctaataccagaacagctgaccctgcctgtacttggcctgtaggttgtagtgtgtcagtctcatatatttttggttgtgagcctagccttttaacggctgagccatctctccagcccggccagtctccacctctctagatggaaactgataagacgctagtagatacacaagaccttcagcctaaaactcacaggcttattttaccagtttaaagcaaaatttgtatatttaatgaaagaagttatattctgtttctaagatatagttacagaatatgtattttaatcagtacatttcttgctaattttaaatgcatagtaccttgccagtatataatgattaatagattttgtgtgtgtgtgcgtgtgcgtgctttttgcccacattgagacagggtcttgctgtgtgtgttgctcagactattctggagctcatgtgctcaagtgacccccctggctctcatttccagtccctgggactacagatgtatggcactgtgctgagctggatttttgccttttagtcctttcagtctattactcctttgaaaggacaaaggatatacatttttgctggtgttctagtatgtgacctggatattcctagtatataaaagtgctagttcacatttatcaagacacttagtaattgacagatttttctggtttctttggacagcacactaggaaaacctgttgcaactgaaacacagacaccttgggaaaggctgttcttttgccaggctcctaaaaccaaaagtcagcacgagcttgtgtcaggtgatggcaagcagggttttctgaaggactggtccagcctttttacatttgctgctctgaatttgagcagtgtagaaagttttcagacttaaagatcacccaatactgattaatttcttggtttgtaattactttctaaagatatgaaattagttgatagaaggcatttctgaaagaaagcttatcataaagctatttaagaaagcaaagcaaattttaaaaccttaggtgcaatgaaatgagtattctgaactttatgagctattaaacacttgctatgttgtacttcaatagttcttgagatgggttatagtttgatggagtttcttgggaaaaaattagaacataagttagtttctctagccctcctccccctcagaaggctggcgttctagcctctgtgtagagtcgtagctgatgctacatgggatatctcatccccttcacagtatttcagcaagttttacaaattcaaaaggaataaaatacttaataaattatagtcttactgagaacagataaagagtattatttgttaacagttcactacagtggtgctctactttcatagtctcagtctgctttgagttgaaaatattgtcagatctttttgtttaaagaagaattacatacttaaacttggatatccttgattatagatagatattttcatttgcccttagagtttactaagtgtcatttgaaagtgttccaatgtggtggtctgtcatatcctcaagtatatatcgctgtgtccttaggggctaaacatgtagtcataattgccttatctttaaaaattaattcaaagtttgaaataataaatcaatattccatatttataatgatgtagcttatgtagtatttaaaagtaagagccagtgttggtggcagggcaaggacaaataacagtgttctcaggttctctggatacctgtgtaactttaacgtttattttcaaggaataagtatgcaaaatgtgggtaaataactttaaaattaatttaaatttcatatttataaagctaagaaagaaagtttttcaataataaatatttcttggttttaattttcttggctactgagatcctaatgctaaatttctggtgatgggtggttgtctctttaattattggcttccaattctctctctgcattgctggaaacaacaatcacagtcttgagttggtgatggggatgctttctttcactgaagccgcagacacagccaactgattcagaagtgtgctacaatcagactgtgcctctgctaaattagaggacaaaggccctccttcctcccttcatagcacattgacctttacagtgacattgaactttttttcgaaaagaaggtatatttacattctttaagattttaagaaaatatgagcttttgcctggtttgcctctttctataaagaaatgtgtaaatatttggagaagtttttcattggctttcaagttaaaaaagaataattatttatgaaataaaagttgaccagtcacactttacactttaaatactttgcaagtcatttgccttaaataattttctttatataatgtgaacatttgtgctagatgagtaaatgaataagtaaggcctttttctgtcttgaggatgaatgataaaactactaagaattaacaagtaggggttttatttaatgatttttaaacattgaaaatgttttcttccttgctaggatatgcataaatggattccattaaaataaaattatgttggggtgttagagaggtagctcagggttgagaatgctggtcgctctcgcacaggccctggctgtggttcctgcctcctccacccaccagtcaccacagctccaggtcatctggggctgccttctggcctccaaaggcacctgtgtacgtatgtacacacaacacacacacacatacacactattttttaaagaagttttttttttcctggggctataataatttttattagaaaataattaaaaactatgaaaattaatttgagaataataaaaaatactctaaaatttttttcgctggatgacacacaatatttgctagaagtatatactttaatatggaatcatattatttaaatgcctattttgctgacacaaaattttatgaattttaaaggcaaattactgaatttcactgattcagttcttatatactctagagatttgtaaaacataatatgccctaaataactgagctatcttcttaactgttgacggctacagatgacgtaacatgcagggtttcagcccagtggttggcttactgcccttagtgccgagttacctgactctgcctgcctggcttcaagttttcagtgtatcagctttgtaggtcccaggtgcatcttagcacttttggttcagtggaaacattgattttactaattgtagaaaataaaacataaaccagtcacctacataagcaattcactattaaaatgaaatgttttaaattaaataggaaatttggcgtattttaccacataagtattttttttttaggagcatggacatcagtattatacctgaagttaaatttgtactatgtatatgtgaagtttctggatattgctcttagataaaaacttagtggagtttttctgaagaaattggtgctatagttataattatgttgcactttttaggctgttgcctaattttttctttgagaaagttgaaccatatggtggctcacaaccattgttaactccagttctaggaaatgtgattcattatgacctttaaaggctccagatatgcacaaggtgcacagacatacatgcaggcagagcactcatgcatataaaatactgaaaaagtagaatacataagtgaaactggaaggcacacagcagcagtctgaacagtgctctgtaggctgttaaggagacatgtattgctcctattttatatatttcaaatggtttgtgaagctttcttgttttgctaaattccccattttacttctcattttaatattgtaatttcccattcactgtggtagcagtctttgatggacctggaaattgactagaaactaattgaagatgaatctgggggtcctatagaagtatttggactcaccttggtcaggacatgggtttttgggtttgttttaacaaggcctcatgttcctcatctgccttttcactctgccatcccactgggtaaaaggtgggcatcagtggtgtatggcaattacaggtctccctttatccaaggagagcctgaacttttcccaactgcaattcatcaaacttaaaattattgtatcgagaaacatacacatatagttaggcttttcatttaaacgcttaattccaaacaacataaacacttttgagaacaaaccaggttctagctcatgttttaacgctgcatcctcaattttattcaatctgatgtctgcttaaaaaaaacaaaaacaaaaacaaaaacaaaaaaaaaaattctgaactgtaaagctcataattcaaaggtcttacacatggctatcccagtaaattacgcttccaaatgaaacagactttaaagaggttgtgttttacaatgcagagagtggaggatgctttttatacattggtgagagagatccgacagtacagattgaaaaaaatcagcaaagaagaaaagactcctggctgtgtgaaaattaaaaaatgcgttataatgtaatctggtaagttgagcatattcattctggtacaaagcagatgtcttcagaggtaacagagcggtcagaaccacttcgatgtggttgtgctctgaggtattaaacgatagaaccttgtcattggtttctgtagtgagtacatttattttaaatgtgagtatataattgacctgtgtgatggctacagtagactgatctgcatttctcatgagctttattggcttcattagttttaagtaagctaaatatttgaaactaataatttatttttgagggaaatcaagttttaagataaccagcaattttaagtaaatatatatatatataatagtaatatggcccagaagtaggaaaggcctaacaagctatactcctgtacccatttagaagcagctgtaggttcctatgctatggctttgtctcattattatgttattattgatttctcctgtacagtgaatgacatcagcaacaagtaaatagcacagtctttttcttgtaaatttagacagtgacttagatagtgcgctcactgtcagtatctctaaacacatctactggggtccttaacactctcctccttctagtcttttgaaactttatatctaaaacgacgtcatcttacccgatttggccgtgtacacacacgttctttctgccttccatttagtcttgcctcttgtttggatcaccagtattcctagtttgattcatcagctaacatatgattcccttctctataagaatctctacagtcccttaaaatggccattgtggctttgtgtatttccaatatactgtggcttcctttgttgcattatgtgtcattcttttattagacaatagaatcctaaagagctggaccttatgttttagctttgtgcccattgcatgttgagattctagtatataggtatttcctagtaaagactgagtggactctaactttcctgtctaaatcaacccagattatattttgtctaactcagcacattcttcactcagtgaggtgataaaacctcatgttgaagtgtgtgcttttgttgtaatattgtgttccttgaggacatgaagcagtcccagtgtttaagactaagagatttagatgcagaagcagtggtccttacttgcagggattctaatgggattatgaactcttaaaacttttgtgattgggtaaagccatactttacttttagaaactgtggtacaatttaacattaaaatacaatttgaaaagttaaagtttgagataatggccatgaccagattaaaatggtaattttaaccctattcccctttcttagatggttttaaaatagaacaatatttagagaatgtagtacactttacattgtattcaagcaaacattgaagcactttgctctgaatgtctaaattatgcagtttgtagcaaagacttctgtaactgttaatagtggattttatgaattgaatcactaatcacatagcactttctacataaagaaaaagtgtattttatatttagaattatagtgagataaatatttaaagtttgtatttgatagtgataagtacatacaaattagcttttcatcctaggaaagggataagtctaaacaaaataattagcaaaatatggggtgctattttatgagactcagttcccaggtgaacaaagagtccagtgccctttgtacattagctatgacatttctctaacatcagagtcatctaattagaattaacatagctggagactcacacactgtcagaacttgacaagagggtaaatgctgtcaaattctgtcttccttgtctcctaaatggctgtgtattattccatcttaaaaactgtcttacagctatctttctcaggatttttattttctgcatcattgttttagtatcattggtacttttcttcattgtaaaaatagttggtggggggagggggaggcaatgagatggctgtcaagactgaggacctgagcttgatccttcagatgcaacgggaggagagaaccttaagttgtcttctgatcttcatacgtgtgctatggcatgaccacaaacagaaaaataaatggatgtaatttttttaaaaaagatgatgaaatagagtagataccataatgtgtgatccaagggaattgatgatggataagggagttaggtaagactccatttcgggggagtatctgggagatagttttcattagtgaatatgctagtgaaaatatgcatgcttgctgcacaaacattaacactgagttcaaatccctacaactcaagaaaataaccagccagaaaacacctgtaacccccagtgctgggacaggggccagaagtaactggtggagtgagctggttaccaacctagcccagtttcactgcgatgctgtgcctcatgggaagaaggtggagagtgagggaacagattcccagtggcctgctctggcctccacttaaatgtactggtcccccccgccgcccccccaccccccacatacagacatgtagacaaaagatactgtcccatttcaagtgtcttatgtccctaagtcgtacagtgctgttgaattataggtccctttattatgtcatgggaagagtttcccactgtgtgttaaggaaggagacatctgtctcctgtatccgtctgagtggacctcactacctagttaggccttgactgtatcgcttgttgtatcagtaatggatctcaggaggtgaaaagcaccaatgagtgcagattggggttagaggcaatatatatttattcactcatattcaaagagatgatactgacattatccagcttctgtctgttaaatgtgagcaagcttcattgcatgttgtacattttcaacagtactgggtgagtgtttcctgaattagagatctgttgtcaaaatgagttattattttgaaattacaaaatatcttagtaatatggtaaaggaaaaatcttgccacttaagacattcaattattttgaagataatgtgtttaacatagggtgcttaaatacatattatgctacttgcacaatttataatactaaaacaggtgattacaagagtgaagacccgtgtgccgctgcttttaacgtggcttagactgttgggtgcttgttctccagacccctctagtgtcgaggtttgaagcattggtaggttaagattcctttcagtacttcctacaggatgagcgaacgaggtgaagcatggccgctttctgttcagctttcctttgactctagtgtgaacttgggattgaaggtctaaagttggctcctgaagctctgctcctagaatgctcttgtcactcccggggttaggaggttgggaattactttgactgaatcagttttagtcacaactcatttaggtattttactttaatgaaacataggtgtagactttaatgactaatgttgaatgttctttgaagacggggtatttatatgacaaattttgaatagctaaatggtaaagcagtaataagacaattttggagggtggtcaagtacaccaccggtcagacaatttcgcttatcatcagaggacaggggcatcacagcttttaaggcaccaatatctacagataatgtggcttactgtctgaagtccagaaacttggggggacaattaagatgtatggacacctaccatacatggaggcaggcatggggagctgagtggctaagtttgctagtagagaaacattagtgggaatcaagtccttttggagaaaaagccatttgttagacttacattgtgcatcacttactatgtcgcctgttgtgaaagtcagagcttccatttaaattatcagcacgcctgagccgggaaatggcttagtggttaggagcacccagctaacacttgtcagtaactcctgtccctggggatctaatgtctagtttgggcctccattgggtactggactcacatggtgcagacatatatgcaggcaaaacactcataccataaaataaagttgttataaatgtcaggtagtttgctttgaaagaaagagtaacttgaaagtatacaagtaataattattttgaaattactaaatatctaaattactaaatatcaggtattttgttagatattttaatacctaaatttaaataataatttaaatttaataatttaaaagtctaaaaacatcaactatccatgaagagatatagcctaaagaattcttaagcccattcagttgccaaaatataaccataaaacagaactacactctgggtactcaagcgtccattaacagtgaaagtctgtcatctgagcatggcaagccatcgcatattaacatgtcttatatatacttttttttttatatttcagggtgttgacgatgccttctatacattagtccgagaaattcgaaaacataaagaaaagatgagcaaagatgggaagaagaagaagaagaagtcaaggacaaggtgtacagttatgtgaatactttgtactctttcttaaggcacacttaagtaaaagtgtgatttttgtacattacactaaattattagcatttgttttagcattacctaatctttttttttttcttctgttcgtgcaaactgtcagcttttatctcaaatgcttattttaaaagaacagtggaaaccttcttttttctaagtgccagtattccctgggttttggacttaaactagcaatgcctgtggaagagactaaagacctgagactctgtcttgggatttggtgcatgcagttgattccttgctagttctcttaccaactgtgaacactgatgggaagcaggataatgaagcttccggaccatccctgctctgtgtccatctactcatccaatggagtcattagcagtcaatcgcagcttcactggacactgaggggtcacagacttaggctccctttgagtcacgtccagcgtgtcctagactttatcatctttcagaggcgtaggcagactgttcacaaaggctttctctagctttccactgcaattaatcttggtcactccctcaaatagtatattttttctagaaaaggggaaaaatggaaaaaaaaaaaaaggcaatggaaaatgttgaaatccattcagtttccatgttagctaaattactgtaagattcctataatagcttttcctggtaaggcagacccagtatgaaatagtaataaccatttgggctatatttacatgctactaaatttttgtaataattcaaacaactttagcatatataaaaagttctcataagaattaagtacaattcccctttgtcagattgttcttatcctaactttcaagtcttttttgaatttctgttgttgaaagtagttttaatggttgtgaagctgaagatgatctgagacagttatagcttggcaggtgttgaggagaccagagttgcagggttgggccttacatgaacctgtgaacgctactgggttttgcagcactgctgcattcaatgttggcgacgcattgtttggtcaacataggggataaggagagtttgatggcttagtataatgcattctcaccatgtaacagtcctactgacaaatcaagaaatttcttttgtttataataataaaaaattttaaaaaatttcgatgttcgcttcaaggttgagattttggggtaggaggctacaacaagagtaaatcttaaagcaaggttttaagaaggtttgaaaatgcaggtttgactagtctctcaactctagctaaacaaacattcctaagtacttcccaaatctgataggtatttaaaattatctaatgctttaagaatagttaacaggaaaaaaaatctcctcagtgcacttaaagcatcccttcacatcatttgaaatgagatggaaatatcactggactatgaggactggatatctgtctgattttaagcaaatcactgtctgcttggttttgaatcatctcaaagacattaacctcccagccgtgtaacatagtttacatgttgacacacctagttatcaagctcagcacaatctgtaactgttttacatggattaacatcttcactgccagtcttgggcaaattgtgcaagaggtaaaatttatatttcagtatccattctcccatttcaggactcccctccaacattatgctggctttcagcctgtctctcacctgcccatcacttagtgtagttttaataatttcccccacttcaaactttgtttccactatggacaacttcatgaactttgcccactaaggtaggtacatcaaagctgccctatggctttcttccccaagactgaaaataacagacaccatagtgggatttgaactaatagatggttttcagggccactacaacaattcaatctcaatcctttggacttcattcctgctgcccaggccactggtgcctcagtaggaatttccaaaattactgtgaacagacagagcacagtccagtggaaggtgagcttaatcttcatctagccatcatcctggtaagtgatagattctattgttttaataaatacagtctaacaatgaaaaacacttcgaagtttcgatcataaagctctctttttaaaaattttatttactcaacatttattcagtgcttgtcatattctgggaattacactaggcactcagggtgcggtgtcctcaagaagggatacaatccttggccagtggtatgtagcgtgatctgtaatccactaaataaggcatatagcatatgacttagacataatgaaatacatgatttgagttttgcagagaggagtttgggtttgtacattcccttcccccccagtttagcaagaattgtttgctgtgaatccaatgcaacttttaaatcaaactactttatataattatttcatttttctaaaggaacagaagtaccctaaactatttttttgaaatgttctaaactgtacatattcatagaacattctttgggtgaattttaagtcttaaaatgcaattagtaatacttctcatttctattcagaggaacaggtgtacttcaaaagctgcagtgtataatcagatatttttaatggacaatgtgttaaagaagtggtaattaccactatgtaaatttgaattgtgttacactttggttaacaaaaggggaaagaatcctagaaacaaatatgttatctagttactgcagccttaaagtccttgttgaagttaaaaagcaatgctaagttacagtcataggcattaacatgtttatgggaaggatatagtaggcaaatacaatttgagtaaatattttcagtagggaattttaggctctactgactgagtcacactgcataggaatttagatcttaacttttataggttataggttatcgacctttgccaccattgcacaattttgtcctaacataaatacaagttctgtgaggcatgtcaaaagttacagtttgcataaattcatctcattttgtattccactgattttccattttcctcaaacatacatacatacatacaacacacacacactcacacatgaagggttttttttttgtaggcaataaaaatttaactaatttccatttgttaaaaagtagtgatttattgagaattatgcagtcatttttttaaacccaaaagttatttaaaggtgaatttatactcaataacttctgtgtaatactgggtagcatgaattctgcattgaaaaattgaacagataataccaatagctgtaaattctgtcaaaacgtgaaaattatttctaaagaagtacattagttttcaaagaacagttattagaatcagatctgtggtttagttcaataatttgaagtgcctgtttgggatggtggtaggcattttagatgaatttgggaaaaataaagttctgcagaaatgccagtttcagaccccgctaacccgctgagtgggctgtgtgctgtgttagctccagtgccccaatcccgtttcatgtcttcatgttgaaacacttctgcatttttatttgagtgccaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctataggtatttcttggtggaaatgtctgcttggtagttgataaagactcctttaagactttaagatttattcgtttgtttatttattctatgagtacactgtctgtgttcagacacaccagaagtggacatcagatcccattacagatggttgtaagccaccatatggttgctgggaattaaattcaggacctctggaagagcagtcagtgctcttaaccactgagccatctctccagcctgatacagaatcctataagcaacactatttgcagcttttaagttagaaatgttatttataacgttgctaaaaacattacataaacatttttgcttaaacttacagtcctgcctgggttaggtccactgccacatggactcggttacaggtcgacagaaaatataccagctttaatggcagaaatagaggaccattacaactcctcatgaaagctacttgaagtgattcagaacttaaggcaggccagcagcacaaagaataatgggaataatagctacacaatgctagtcacccactgagcttctcaagatagaggtcaccttcacatgtcttattttgataactgcatttaaatcattttgaggtgtctgtagagagccttgaatatgcactttagtatactagatgggctaacaaaacaacaaaaaacaaggacaaagacactctagaagctaaagggcaagcctgtcagacaccattcgatagtgacaatctcatcagtaaatgaagaaatagactaagaaaattggctataacatgtttaaaaattaagtgtattttctttcaaaattatattatcatgaaaggtactaaagttactatttcagtaataaaaggattatgggcaaagctctcagtatcaataaggttgaaacctatttcagtacagtagggcaactcatttttttaaaaaccatgtatctcacccttttaaactgaattattttttaatagttggtacaggcaaacagccagcactggttgtcagctcgactggtgcaatgattggtcagactttggtatctgaatagtaacgttgcttcatagctctgtatttcctaaggaagtacaaggcctctagctccttcattacaaattctcctcgtgcgataagttctttgatcttctctgggtcctccacatccttgtttttaaggaaaacgttcttcaaacgccttttaaaatagcctgctccttttggatagtcccgtccaagatacagcagctttaaaaagagagatgcgtttctaagcaatccatgttatataataacatttataaagctggcagcataaattacttacatttttataaagagtcagtacttctcctcgtaacgaattggccattttcacttaacatggaattgatccacttttatacatgatatacctaaagaaaaggaagattttctttttttttgcaaataactgtattgtaaatcttaaagaaccagagatcttcccatggagctggtgagctggcttttcattcttgtgtacagacttgcacttgccagtgtgcatttggagctgatgacctcagatgtcagtcctttccacgggtcttagttgttgctgcaaacagctggcccttccttcatttagggattctcctacctctcacccccctgtatgtacactgggattacaaacttgcaggtctacaggaccctcttgtttgtgcaagtgctttgccattaagacttcttatccccccaaatggttatttgtactgagctgttttattgaggcactgggtaacaccacttttctaagcctgctttccttaccaaaagtaaagctgtctgccctgctctcaaggcttggcttgattatttggaagaaactaagagtccaaatctagaagagtattcttggaggaaattttaaaactaaaataaattgggttgttcgatcaagatcaagaaggttggtccttaaggagaatgcagagtaagaggcagcgggcaaagggagcacttggaaaggttccacgggaagcagagcagacagcatccatgctgctgaccatgcttttgactcggtgctttagctgccaaggagaaggagaggcctcgttagaccaaacctaaaaaagattcccactgtgttccatccagtatggctgatggtagttctgaccacccgaatacagtacttgccaccattctccactgtgagattatttcttcccaagagcctcgttcatgtagcaggtttataaaccagcacacggatggggtatcttaggaagtacgatgtatgtactagaaaactatttctcaaccttcctagttctgtgaccccttcatatagttcctcacggtgtagtgattccccaaccataacatttcactgttgctttgtaactgtaatgttggtactgttatgaatcataaacatctgacaagcagatggtcataggtcacccctgtgaggatcattttgaccccaaaggggtcatgacccaggggttgagaaatatggtagtagaagcactacaaatggaactgcccatttggcagtaagtgccacctagtaaaggtgtgcacctgtagacttgagtgttgtgtgcatgtgtgtggtttttagtgacctttctataatctggtactagcttgttcccatattacaggatttatttttattttagcttcctgtcagtaattctaaaactcatgtccaacagcaaagaagctggttcctattatcctcattaattgacttttttggatcatcacttctactagaaccaaattcttaccactgtcaccacctcgtacttccctcccagatcccactcttgcctggaatgctcaccctgtcctaactccaacaacctgtgccactaccctctccacccaatcagtgtcctcttctgctaggctgctgtcacaaaccacttttacctgagacctgtttcctttgtcttgaattcttaaggtctcccagcccttcatcctgtcccttatggctgctgcttttgcttagagccagacaactaatatcttttggactgtattattcaggaaaaataaattttcaaagtagattatttttaaagatgaattaaaggttactttacaattaactagcagaaaatggagattctcaaaattcgtccaaaaattattgtgttgagctggatggaagctgaggcaggggaagacccttagttcaaggagagctatgattgaagttacatagtggcaccctgtcactaatactgacaattgtgactggtgttgcgtttagtgtccaagtgtacagatcctagttgattctgcttgcttcctcttgggaagagtagtgagtgtccactgaggtttgctagggttgactatagtcactcatgggctccagcttccagagtcttactgccataaccatctctctcttttctcttttaatttcatggtttgttttctttccctgaagatttagtgtaatactgaaaggtaatttaacaggtgtgtttaaccaataatattaacagtgggagtagggagagaggggaggagtaatataataccaggatggtataccttgttgaagaatgacttaaaactatgtggcttgaaattattatatagataaaacttggcatttgtaacttgtgaaagcttttagagacctgccttagttctccttcccaattgcttttcccacagagtatgagtaataaaagattcgcctacccctgccccatgcactttgatggtaatttatgatacagttgattttcaggaatttttagtttatttttgctgctgggaaaaacctttagtttgcaaactagaaaacaacttaattgctgcagagacctgcatggagtcctggaagttatcaaagttggatgagtgcatggctcaaagtcacgggctattccaggaacatggatatgtgcaaggaggagctgtaagtcctttctccctggggactttgagtaaaggaatgatggcgttgtcattttagtaggacactattatttctaataggggcttgatgcccaatgatgttattctgccccatgatgttcaagtgaccaaaaaaaaaaaaaaaaaagttgaaggaaatggagacggcagtgtattatttcagtggtctagtgaactggactcagtattccttcagactgtactggaaaactgtcctgtcagatttccccataccagaggttgtgcgaccatacgcctttagatggtacaggtacatgacaggagagaggggctagtacaacccgtgtcaagatgaagagatgccagaaagcagccctcttattactcacaaatcctgcccagggactagaggacatcaaaactcaaaaaagcatgcacagagtcttgaaccatgggatctaacacatctctactattagttttcctcttaggagagaagttgataatgacacagtgattttgagtaaggccatttctcctgagtcaccatgttaattactgtacttccacaccacttcctagtttagtctgaggttttctgtcactaaacactagtagttgctttgttgaataattcaaaacaaaggctaccttccatacctcaacagctaagataaaacaaatttgaatttatatgcagtaggtgttaagtttttatctcattaccaaggttcggagggcagtaaggtcttaagtgttgtgcaaccaatgaccttaacccacaaaaactagctgtcagtcctactgaacagaacatttagtttatgtaagggacagagcattagtactctatcttgggttagacgggccgtaagctggggttgggttaaagaactgtctccattcctctacgtctcaagtgccttttcttatggagaagggctgaaattcttcaggctgccacaacagtacagcgctcggtgaccttgggacaacaatggcttgctggttcttagaggtcacgttaaactagtgtgtgagcagctcttgagaagggcgaatgctttgcatagaaactaaactcccacgatcagtgaagaatctgtactactttaatctcaaggtagcgaccctcttggagctcgcctttgtggcaagatgactccctgggggacccgcccggaacctatggcttcacctagtcgtgagctggcgccatcccttccccagattccccgggaagggctcgtccagacgtaaaagaagcgaggaagaaacctttttacaaggctggccggccgtggcgggcctcggctataaccccagctctcaggaggaagctgagggatgcccgcgagttccaggtcagcctgcgtttcagtgtgagacgcagctctccccacgcccggaagccctcgcctaaggcatacttcaccaccagcaggtctggggtccagacgacagcttgctcagaccgcctcactccagcgctttgcggcaccacggccgtaaatgctccgaccgtctgccggaagtgggcggagctgagaggcgggggtgggctcagggcgggactacaggcagcagtgtatgggactcgaggccgctttcttttctggggcggggcatcaggcggaaatgggcgggattaggtaaaagccgcgatgtgggcgtaccttatgtgggaagtgtggcttgtgtaaccagtctacgacttgggcaggactcaccggaagactacagtgcgattgcgcaggttgtccttcgcaaagctctgggagttgtgagtgggcgtggcctgtcgtcttgacaaccgtgagcgttcctgctctgcagcgttcacttttccctaagcaaagttcctgcttctgtcatggtaagccaggaaagtgagggagacaggaaaggggcaaatgcggattccacttcagcactgtcgagggagggcaggcaggcaggggcagtgcgatccagaggtggcgagatccagatctctgcagtgactaaactttactagcttccggtgatgtacattcccactttggctctgactgccttgtcagaaaagttttcattccaacgcagaacaatatggagcaaatttcgtgtgttgtttcccattctccatcaagagatcatcaattatcacactcgttgaggggagattcagagtgcattatttgtgtttgctggctggaagccagagacacacaaaggagaatatgacagccctccggctctgtcagttaagcagaatatcagacacaagctttaccaaggtaacagctggtgtatctaaagcggagtaaacaagctattaagggtgggagagaagaaaagattggtgcttttcagtctcttttaagatataagtatgtattttctgtaagtggtgggaagaaatgggtagtgaaggcctcccctggcaagacccccaatgggtcatcagccaagttaagactgctggcaaattacaagaacaagcacgtatttgctacatcgaaaggtggatttaatttctttttcctatctacatagcactgtttctcaaagacttccaagccatttgggggaatatttaaaatgtagattccaggaggttgcagcttcaaacctaactgtatcatggggcttccaggaaacaaagtaccataaacatgtttgcttaaacagtagaaactgcttacctcaccattctggagactgaacatctggggtcagggtgtcagcatgggggcagggatttattcagatctctcttctacttctaaatagttctttagtgtgtagcagtgtaaactcatttttttcatacgatgcttattttcttcatgagggtctgtatccaagattcctctttgtaacctgtaccagccatattgagccagaggcctgtccagttccagtatcagctattcttaattgggtgaaataattacagacccttttcataagcaggtcaaacgctaacacacaagaagttaagattttagtatatgaatttgaaaatgcataattcaaccccacaatctaaggaagtatacaattcaggaagggaagcaactatactgtaagtccaagaggacaaatttctcaaaaagcttgtcaggaaatcctttgccacttgaacgttgaaaagttttactactgatggctcttatgtttatgtgaaggataaagataggactttccccacacctgtttcatgttagaaatactagtgagggataaaaatgtgcccatcatctttaggatatgctctttgaggaggatatttacatagcctaccatacagtatttgtttcaagatggaaatatgttaacaatgtgtcagggaatactacagccaggataaaaactatttgtaaaaatcacatgagagcaaagcctccctcgttgctctctccctgatgaatatttatggagagaatttctgaaatgtgtgcaccttgcaggaagatgtcgtctaaatctcatttactgtgtgccaaatttggcactggcattttagaatgatgttcccatggctcgaactagcccttcctatgtgcagctcttcagatatgtaaactgtgtaatttacactcagacggcctcttacaggttctttaccagagagctgatgggcacacaggccttctcaggagtttacaaatagcatcatgggaaatacctgtacttgtaaatcagtattgaaggacagagctttccaaaaagagcagactgactgtaaatcatgtggctggacagtcttcacttcatcgttaattggcaaacttgaagaaactgattctctccccattaaaaaaaaaaaaaaaaaactatcaatcttatgtaatagaaaggtttcttttagacagccgctacatctgcaaatttgaaatagtatcaatagtcagtggagatttagggcatcttttcaaccagtccttttttagcttgctctcctatcatagactcattgatataggaaattgtattgactacctcaaaaagatgcttcgtgagaaatcttgtgggttttcttgcttgtgttttcagtttgttctgacttctttttatagcattttttcagtttaaggtagccaaagagtcacagaaaagttgcagtggaggcacaaaggaaattccctcgggctcttctctagcttctcctaattaatgtattttgtgatgctctgttgaaagtatctgaatactgttttaaaatgtgtcaattcttttgttttccaactttttaggctcccaaatcaaaaaaggtatgtagaaattatgttttcaaaataaatagttttatgatcatactgtacaaatgaatatcttttggaattttataataattttctagttagttatagtttatcgaatttgctactcaccttttagataataatgttatttacatcattggataattcttcatagttacagatgtgtttcccatttgatggtatttctagtttgaaaacatatagattgcatttagtgctgaccggtgtctggctatgaggcttcacctttttcttctactgtagaatatgttaggttagtccttccttttctctatttcagataaacataagccatagttacagtcctcctgtgactaaaacaggaccttcagctagcacacgtgtggttttctgcttttgtttgtacagtg

SEQ ID NO: 302 - DNA, 1409 bp, Mus musculus
agaactgctctgatggctttaaaacagttctctgcagttgttggctccaacacagatgttcttaggccacctaacttctaacttttaatatccagtcaacaaagaataccgcaagggcctgctgaaaatgactgagtataaacttgtggtggttggagctggtggcgtaggcaagagcgccttgacgatacagctaattcagaatcactttgtggatgagtacgaccctacgatagaggactcctacaggaaacaagtagtaattgatggagaaacctgtctcttggatattctcgacacagcaggtcaagaggagtacagtgcaatgagggaccagtacatgagaactggggagggctttctttgtgtatttgccataaataatactaaatcatttgaagatattcaccattatagagaacaaattaaaagagtaaaggactctgaagatgtgcctatggtcctggtagggaataagtgtgatttgccttctagaacagtagacacgaaacaggctcaggagttagcaaggagttacgggattccgttcattgagacctcagcaaagacaagacagggtgttgacgatgccttctatacattagtccgagaaattcgaaaacataaagaaaagatgagcaaagatgggaagaagaagaagaagaagtcaaggacaagatggttttcagggccactacaacaattcaatctcaatcctttggacttcattcctgctgcccaggccactggtgcctcagtaggaatttccaaaattactgtgaacagacagagcacagtccagtggaaggtgagcttaatcttcatctagccatcatcctggtaagtgatagattctattgttttaataaatacagtctaacaatgaaaaacacttcgaagtttcgatcataaagctctctttttaaaaattttatttactcaacatttattcagtgcttgtcatattctgggaattacactaggcactcagggtgcggtgtcctcaagaagggatacaatccttggccagtggtatgtagcgtgatctgtaatccactaaataaggcatatagcatatgacttagacataatgaaatacatgatttgagttttgcagagaggagtttgggtttgtacattcccttcccccccagtttagcaagaattgtttgctgtgaatccaatgcaacttttaaatcaaactactttatataattatttcatttttctaaaggaacagaagtaccctaaactatttttttgaaatgttctaaactgtacatattcatagaacattctttgggtgaattttaagtcttaaaatgcaattagtaatacttctcatttctattcagaggaacaggtgtacttcaaaagctgcagtgtataatcagatatttttaatggac

SEQ ID NO: 303 - protein, 246 aa, Mus musculus
YPVNKEYRKGLLKMTEYKLVVVGAGGVGKSALTIQLIQNHFVDEYDPTIEDSYRKQVVIDGETCLLDILDTAGQEEYSAMRDQYMRTGEGFLCVFAINNTKSFEDIHHYREQIKRVKDSEDVPMVLVGNKCDLPSRTVDTKQAQELARSYGIPFIETSAKTRQGVDDAFYTLVREIRKHKEKMSKDGKKKKKKSRTRWFSGPLQQFNLNPLDFIPAAQATGASVGISKITVNRQSTVQWKVSLIFI

SEQ ID NO: 304 - DNA, 38605 bp, Homo sapiens
  misc_feature (1)...(38605): n = A,T,C or G
tgtattcacatagcatacaatttacacttttcaagtgtacatggtttttagtatattcacaagggttgtgcagtcattactactaattccagaatgttattatcaccccaaaagtcccacatccattagcagccactccccaatcccttctcccaccagcctctaaaaactgctaatttttccatctctgtggatttgtccactctgattatttcatataaagagaatcgtacagacgtggccttttgtgtctggcatcctccacacaggatgatattttcagagttcgtctatgtttttgcttgttgatcattccttcattcctttttctggctgaataatactctgttatatggatataccttattttgtttatctgttcatttgatgggcatttgagtgatttcctctttttggcaattttgaataatgccactataaacatttatgtacacgtttttgtgtgaccatatgttttcacttctctcgggtgtatatctaaggtacagttgctgggttatatggtagctctgtctttgactttttgaggaactgccaagtggttttggtagtgattgtactgtttacattcctaccaacaattttacctaagtatttctcaaatctatttaatcttttcggtccatactgctgttgctgccttagttcagattttgtcatttcttgtaataattcgtagctcatctcccagtctctgctcccctctctccctccctcccccttcttctctctcttatttccacccatttttaacatttatagaagtcaaaagtctagttcagaaagcagaaaccacactagatatttcagcacagagaactaattaggtgttggaagactgaaaggcaaaaaaacactgaagtaacacagtaacatcaagaatgggcactactcctaagattcagggaatgctgggaagatttggggtttatcagaactggaagctcagaggaggggccccttgtcgctgaggcttaatccctgcagaggtgcctttggctgctactggtgaatctgagtgggtatgatgagtcagtgtctgggaagggccaaaacattttgtccctttctataatttgtcatgataatgctagtaatgaatctgatctcccttcctattttaaaaaccttttagtgattttgtataggatgaagtttaaaactccttacttaatatacacatgaccctccgtaagctggcccctgcttgattgtccagtttcacttcttggtgcttattctaaggcctctaagccttagagatcctctaagcctttgagatccccaaaccctggactgcggactggtacccacctgtgtggcctgtgaggaactgggctgcacagccggaaggaggtgagcattacttgccttagctcctgtcagatcggcagcattagattctaataggagcgtgaaccgtgttgtgaactgcccatgcaaggatctaggttgcatactccttaggagaatctaactaatgcttgatggtctgaggtgaaacagtttcatcctgaaatcacccccaactcggtccttggaaaaattgtcttccacgaaactggtccctgatgccggaaaagttggggaccgctgttctaagctaaagttatatggagctccttggttctgtgtcctcaacatgctgttctatgttttttacattctgtttgctccttcctgcttggaatgtccttcccctccccgtctttcttaatgcatacaaagttgatctctcctgtgtgccaccattgtacttcgtcttgcatatggtgttacattcattttattttaattatttatttacgttcatgtctcttccactcaccttagttgcttgaggtcagaaactatataatgtgtgacacggaatgtgacacctagattttcaataagtgtttctatgatacaagggagactgatgtgggtagatgggaatgaactcatcaacctctgtttacataccctaaattccctgtttcttccctattataattctgacagtctacaacagtctttgatggcttataaacggaaagtgcggaacacatcattctacagtgaatttaaataacctttcggaagagtaacgtaaagtacttgagcattaattgagtaaaagtttctcatcttttcctacaggtgttattaagcagtatgtaaaaagtccttacaatacttaatacattaagaaaacatacaatttcaagaggaaatccccgagtaatacattattgacattttcagcagttctagttatattgagaagagcatctcatggaattggcagaatgaagatggagattaaatgagatgatgtttgtaatatgcttatgacagtatctggcatataagtaagggctcagtaaatgttgactgctgtaattactattaatagtaatatgattacctttagtaaaagttattagtttctttaggttttttgtttactacaatatagtaaacaaaatctatacttggaatgtatatattgttttgttttgatacatggaatatgtctctgtgtcagagtcactgcctgagttggaaaacccatactcgagtatgttaaaaggtgaacacactgaataatttagttattaattataatggaaaaatgacaaacttgatgttctggttaatgaggttatcttatcttgaatgagttagcttttaaattcctcaaaataaaggcatttaataaaccaggaaacacttcattaaaaaaattatgcaagtcagtgtaaaagaagattaaaattccacatgggcaaaggacacacgttggcgataaatatgcagataagaaaaaaaacctatataacattattactcctcaaagaaattggtatgaaaacaataaaaatgtgtagcttatcaaaccaacaaaaatttaaaaatatgaaatccattttaagtaatgataaaatgggtgcactcttagtgctttatagaatagtagtataatgaacctcatgtgtgtaccaaccagctctttcatatcttaacatttagcaacatttgatttagctctttcttttttccaagatagaaaagttaatattgttgaagactcctgcattcttttccctagtcttattttcttccctcccataaatgtgttaaaatctctgtgtgtattgttttggttgtatttttacataaaactttacatattatataaaatttaattgaaggtaaaatttattaaattattcttaatatatattgtaatttaaaaattaacagcttcattgtcttgataaaatttatggtatcttaaacatgtgcttgtttttctaagagaacattgaaacatagattttaaaacaaattgttgaaagattaaaaaatctgcctttgcacactgttacattgaaagtggggcatttgtcgtgaacattcatttcaaatatgtagtatcttcagaatatttgagaaggatttgtattatataattgaaaaatctgttaaattgtatttatgttaactgcttaattctaataaaatttccattcattttttagtatctgcatatatttacatcaaatggattcattcacttatttaagaggcagtactaattacctatagcgttcaagactgttaggtagagggtgtgtagtggtgagtacaacaggcgtgagccctaccaacacggagtttaaagcctagtagaggatatagacttaaacaatttcacaagtaaatacataattacaaattataatacatgctatgaaggaaacataggaggtaccagagaaggaagagtgctttgcatttttatttttaagaccgaagagtgctattggaggactttgagcaagtgaatgacatgatctaacctaccttcgttcattcattcattcattcattttcttccttcctggctcaagcagtcctcccacctgagctccccaaatagctgggactacaggtacacactaccacacctaatttttttttgtattttttgtatttttgatgggattttaccatgttggccaggctggtcttgaactcttgacctcaggtgatccacctgtctcggcctcccaaggtgttgggattataggtgcctagcccatggtgcctagccctaacctacatttataaactatcacttgctgctgtgtggagactatattgtgagattaacagcagggatacctgctaggaagcaattgctgcagattgcctgagacaaaatagttatcatggactagggggatggtgttggtggtggtggtaggtggttggatgtaggatatattttgaagataggtaaatggtgcaagattatgggtcagttttaaatgcttaagtaaattttctttgtaagacattttaggatgccatgttaagaatctctttataactgtcatttaaaaaaaaaccacatattttcttagcataatttcccatagtaacattactatgtcaaaggctatgaacatttgaatgactttagataaatactgtaattgctttccaaaaatattgtgcttattatgtcaccagaaatgtttgaattctgtctacaattcagtcttgccagtatagtacatttcatttagaaaaattttttactatgtagatggaaaaaataatattttagctgggagtggggggactatggggaataactttccttcatttaatattttattgtgagttagtttaagttactttattttatcgtagtttcctaaggctacaaattagtaaccttggtaacttatgtacctaatttaaaagtttacttttttgaaaggctggaaatactaattaaaaacgtaacaccttcatccttgtctttgctccattattaactagtttcattacagaatctctgtgttttaaaatcagatgggttttcataaccagtactttctcagagtggtaaatttaaaaaaatatataaagagaataaataatatttgttgagaatacttcaaataatgtgaagagttattaacttacagcaggagttggcaaacttttctataaagggccatatgggtctttgtcacaaagtcttgggtttttgtttttgtttttttaaacagctatttaactattcctagctaatgggcaatacaaaagcagtgggcaagatttggcctgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttgaccccttgaacaacatgcgtttgagtgaccatgggtccacttgtgatacacgtttttttccccaaccaaatgcagatatggagggctgacttttcatatacctggatgttcctgggccaactgtaggactagaggctgggggggtcttggaaccaatgccgtgtgtataccagggatgactgtttcttatggcctgacctgaagttggaacagaatctttattaatatataatttttgttgtgtttgttttctctttatatttatccattctttttagatcgtatttcatttaacactttttcttctttagtttttaccaagttgcactgaaaatagctcagtgactaattgcacttctaagagtgaggaccctagttaaaattaactctaaaaatactgaatttttaacctaaaccttttgtttctaatcaacagtattatttatgagtaggttatagattactttgaaacggaatgtgtctcagaactttgctatcgatatttttaaggtctggtagggaaaagataataggaatgagatttatcagtgaataggggactgctttcccagtttctcggtcgcactggtgtattcaccatggaagcatcttatgaaatatgtacataaactactaatatcccacattacaggttgactattctttatctgaaatgcttaggacctagaagtatttttggattttggtttttcagagtagggatactcagcctacattggtaagtaaagaatgtgaggtgacaggctgggcgcgatggttgatgcctgtaatcccagcactttgggaggccgaggcggatcacctgaggtcaggagttgaagaccagcctggccaatctgtactaaaaatacaaaaattagctggacacagtggcacgtgccagtagtcccagctactcaggaggctgaggtaggagaatcgcttgaacctgggaggcggaggttgcagtgactcgagatcgtgtcactgccctccagcctaggcaacagagcaagactccatctcaaaaaaaaaaaaaaaaaaaaaaaaaagaatgtgaggtggcagcaataggtaggaagagtctttggtcagctttacatgctctgtagccatgcctgggtaatgggttgactctaagactctgtgctttgctcccacctcctgctttttcattactctttagaatggtttttaatttgtgatctataggagttctttcaagtatttaataagagaataggctaaattaagtaaatgtcaactgaatgctcaaatctctactaaagagcctcttatttagaaaataaatatccatcttttttttctgactggtgagataatttttattacagatggtttggaaaataccatatgctttaaaagataagcacaaaattatagtctaatatgtaggttttcatactttaaaaaattgaaaaccaaagaaaaacatttaacatagcatctagtacaaagaaaagagataagcaagagataaatgtcttttttgggacagagttttgctgttgttgcccaggctggagtgcaatggcacaatctcagctcaccgtaacctccacctcccgggttcaagtgattctcctgcctcagcctcccgagtagctgggattacagtcatgcaccaccaggcccaggtaattttgtatgtttagtagagatggggtttctccgtgttggtcaggctgatctcaaactcccgacctcaggtgatctgcccaccttggcctcccaaagtgctgggattacagacatgagccatcgcacccggccaagataaatgtcttttaaattatctccattaaagacataacctttataacattttgatgtatatattaccagtttttaaacacataatagatttgtataaatacataaacacatattattgtgatcatgctgcacttagacatctttatattctccttatactgtaaacattttgaaatactttactaacaacatttgtaatgaccattctttctctctttctccctctgatagaatggtctacagagtaattcataaactaaacatactttagaggctgggcgcagtggctcatgcctgtaatcccagcactttgagaggctgaggcgtgcagatcacgaggtcaggagttagagaccagcctgactaacatggtgaaaccccatctctactaaaaaaacagtacaaaaattagctgggcgtggtggcgtgcacctagaatcccagctactcaagaggctgaggcaggagaatcactcgagcccaggaggcagaggttgtagtgagccgagattgcaccacagcactccagcctgggcgacagagcgagactccatctcaaaaaaaaaaaaaaagatacattaatactatagcctacatgtggaacattaagaaaataattgcttttatgtttatgctttatacctgttgttagccctgcttcttatttcatgatttcatggcttcacattgtaacatccctttaccatattttttgaggactgttttggcagaatatgtgaaatcttgagcagaagtattacccaaaagtcagaagaaaatcagatttttatttcaagattctgttaaagttacccactcccttcttttacttaatcttatagttgcagttctctctctttttagaaaagaaaaaagaggcccctcaggatttgcagatgaaacaatattgctctttagagatatccatctggctgttagattatttttccacagttttcagaagtggatgaggccattagaatcttgagtattgcccatttccttatgtgtgcctttgactatagataaaatagatgcatgacaattatttataagttgattgatttttcttgtcatttaaatcatcttgaataatagagttggtagagctatcccatttttgaaattattttgttttgtcaataactttttgttaccagcatgtacacttgcattgttgactctccatataatacctttaaaaaaattttttttgtggtaaaatatgcataacataaagtttaccatggtagttttctttcatttgttttgtttttgtttttttgagatggagccttgctctgttgccaggctggagtgcagtggagcgatcttggctcactgcaacctccgcctcccgggttcaagcaattcccctgcctcagcctcctgagtagctgggactacaggcgcccgccaccacgcccggctaatattttgtattttaatagagatggggtttcaccatgttggccaggatgttcttgatctcctgacctcatgatccgcccacctcggcctcccaaagtgttgggattgcaagtgtgagccaccgcgcctagaccatggtagttaattttaagtgttcaattcagtgaccttaagtgtgttcataatgttgtgcaaccatcaccatgttgtctaaccattagcactatctgttttgagaacttttttttatcatcccaaattagaattctgtacctgtcaaatagtccccagtaatcctccctcccccagcccctggtaatctgtagtctacttttcgtctttttgaatttgcctattttaggttcctcatataagtggaattatgtggtatttgtccttttgtgttggcttacttcatttagcataatgttttcaaggttcatctgtgttgtagcatgtatatacaggttgaagcatccgttatccaaaatgcttgtgaccagaagtggtttggatttcagattttttttttggattttggaatattcatagatacttaactggttcagcatccctcgtccaaaaatccaaaatcagatggagctcagtggctcatgcttgtaatcccaacacgttgggtggccaaggcaggaggatcgcttgagcccaggagttcaaccagcctgagcaacacaagaccctatctctccaaaaaaaaaaaaaaaaaaaaaaaagatgaaagaaaaaaaaatccaaaatcaaatgctccagtgagcatttccttttagcatcatgtcaggctctaaaagttacaggttttggagcattttggatttcagatttttggattaacctgcattaatgctcaacctatatgaaattttattcctttttatggctgaataatgttccactgtatgtatatactacattttgtttatccattcatctgttaacagacacttaagttatttccacattttgggtattataaatagtgctgctgcgaacattggtgtacatgtatctgtttgagtccctgtttttagttattttggttatatacctaggaatggaattgctgatcatatggtaattctgtgtttaactttttgaggaactaccactgttttccacaatggcatcaccattttacattcccaccagcaatgcacaaagatttcagtgtctgtatccttgctaacacttattttccattttttgagtttttttgttttgtttttttaataatagccaatcctaatgggtatgtggtagcatctcatggttttgattttattttcctgactattgatgatgttgagcatcttttcaggtgcttagtggccatttgtccgtcatctttggagcaggaacaatgtcttttcaagtcctttgcccatttttaaattgaattttttgttgttgagttgtatataacaccttttttgaagtaaaaggtgcactgtaataatccagactgtgtttctcccttctcaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattataggtgggtttaaattgaatataataagctgacattaaggagtaattatagtttttattttttgagtctttgctaatgccatgcatataatatttaataaaaatttttaaataatgtttatgaggtaggtaatatccctgttttataaatgaagttcttgggggattagagcagtggagtaacttgctccagactgcatcggtagtggtggtgctgggattgaaacctaggcctgtttgactccacagccttctgtactcttgactattctacaaaagcaagactttaaactttttagatacatcattaaaaaagaaaaccataaaaaagaatatgaaaagatgatttgagatggtgtcactttaacagtcttaaaaacaatcgtgtgtatagcatagaattgcttggattggataaacagtggcattatatattttaaaaaataaaagttttgaaagattgaagaatttgggcattacagttctcttaaatctgacaaagctgcataaaactattaaaataatcattattatgctattttatattctatttctttgagggtttagttttccaaaaactacatattaagcaaatgaatcactcagtggctatgtcatataataacgagttagcctagttataagaagtttaacattttatttaagaacattgttacagcatgtttactgtatagtctagtaatagaggaaaagacatttgggtgggtggtagtggtagtatttttatagaggagttaccaaatttcagctctattatccaagtttacccagctaatggtgttcggaaccgggaatttgagccaattctgactctgttgtctgctctgctccttcttttgtgctgtgtctttgaaagtcacctaaaattgtgagggaatgtaatttcaccccaaatttagagtttatgcacttgttatattgaaaatgattaacatgtagaagggcttttaatggaataagtggtgtagtaacttcagtgttgcctacctagaaatcaaaatctttctagttgtccactttgttttttgaaaaagtaatatgaaaattatgttaatgctttaattcaggtttttgtaaaatattttttatctttacacatttaacatacgtttctaaaattatagtctgttatatagcactttgggtctagaatttttcagtagtttctgttttactattatgatctacctgcatattaacctattaggttatagttttactatacttctaggtatttgatcttttgagagagatacaaggtttctgtttaaaaaggtaaagaaacaaaataactagtagaagaaggaaggaaaatttggtgtagtggaaactaggaattacattgttttctttcagccaaattttatgacaaaagttgtggacaggttttgaaagatatttgtgttactaatgactgtgctataacttttttttctttcccagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacaggtaagtaacactgaaataaatacagatctgttttctgcaaaatcataactgttatgtcatttaatatatcagtttttctctcaattatgctatactaggaaataaaacaatatttagtaaatgtttttgtcctccttgagagggcattgcttcttaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgcaatctcctgtggaccaaaatgtcattatgtggtacatgactgtactaagaaattgatccatctatattccatcaatttgtttagggctttttctggttacatttacctgtgagcccagaaaaccagttttgtagaaattaacttctgtaatgctaggagttaaaaaaaattgctgaacaacttttacattgttaaacatttaaaaacaagcgttctagaagtttatcaaatttcataaaggtgcaaaaatgtaaatgtaaatcattatccagctaatatatatgttgtatttccctagtaggagagcatatgtacctcttcctagttatacaaatttgatatatagtaaagaaacagtaaattctacttcaagtcattttgggaggattaaaaactgaatttctctagtttgaccattgtacagatttatctggcaattttactaaaacctgatttataggttaaacttggtgtatatcatatatcactttactttagaggaattaagatttcacataaatccatttccaggttccaaagaccaggaagaggcttggtttttgtttttctttttactgtcttcacagtctccttgacttttcttaggagagaaggtactgagaaaacatgattctaatatttattattttttcttccaacattttcttatgaaacattttcaaatacaaaattgagttttatttaaaacatttgcaaatatactacctagattctaccattgttgttttatatttgctttacttacaacttttaaaagatgctttttataccactgaacattttagcttacatttcacaaagaaaagaaaaaatttaagagactttgcataatgttttaaggggttgcagtaaagaagtgcttcttatattttcttatgcatacaaatcagctgggcttattaaaatccagattctaattcagaaggtttaggtggggaccgagtctgcatttctaacaaactcctaggtggtatttttcttggtacttggaccatactttgagtagaaaagcagtagaggacataaaaagagtcttgttagtcccactttgttgctgtccacttctcatttgataatatcctaaaatagctttgtctcctttttggtggttgtatgattactacctcagaagtactaattgattcttgctatttgaccttaatactttaatataacacagcattcatatttgatcagaaaactatctggcttccttttataagagatttttaggttttatacagttttgtggccttgggtttttttgtttgatttgtttttttgaaggtatataatatgtaagtagataaacaaatttgatttgtagacatttttatgtggatcatctaattaaaaatggagggatacagtatgaaagaatacttgtacttcttaacagagcactcaacctttcttttacatcctgtttcactgatgttattatgtaatttatgttgctaaactataaattagatatttaatttctgttctttgatttccttttattattaaatggacttgttgatttgcctagaaattaatttgcctttcaaaagtcttattaatcttcctccgttgaaattaatttgatatttgcatgcttctggaagactttaaagagctattccgagtaactgtagagattataaaatgaaatatgggaattttaataaattttacatctccagttactggtgaaaatgtcaagtcctcctttctgcagagtattttgttactcatctgttattcagcttatttatttatttatttatttatttatttttctttctttcttgtttttttttttgagacggagtcttgctttgtcgcccaggctggagtacagtggtgggatcttggctcactgcaggctccgcctcccgggttcacaccattcttctgcctcagcctcccaagtagctgggactacaggcacccgccaccatgccttgctaattttttgtatttttagtagagacgggtttcactgtgttagccaggatggtctcgatctcttgacctcgtgatccacctgcctcggcctcccaaagtgctgggattacaggcatgagccaccgcgcctggcccttatttgttttttaaacaaaattagtgtgcatatccttgttgtattttatcggcaagttgttttatgccctaacttttggggtcttgatcatgagcctaaaacacgtaaacacccaaaaagaattatattccggttaaaggaacaaaacattcatttagaagttctcatccatgtaaatcagaggctggcaaatattttctgtaaagggccaagatagtaaatgttttaggctttgagggccacaagtggtatctgttgcatttttttttaattatgaccctttaaaatgcaaaaatcgttgttagcttgtgcatagtataaaaataggctggccgcatgcctgtggctcatgcctgtaatcccagaaatgaggtgggaagccgaggtgggcacaccacctgaggtcaggagttcgaggccagcctggccaacgtggttgaaaccccgtctctactaaaaatacaaaacttagccaggcgtggtggcgggtgcctgttatcctggctactcaaggggctgaggcagtagaattgcttgaacctgagaggcagaggctgtagtgagcccagatcaagccagtgcacaccagcctggacgaccgagnnnnnnnnnnnnnnnnnnnnnnnnnnnnnnnnnnnnnnnnnnnnnnnnnnnnnnnnnaccgagcaagactctgtctcaaaaaaaaaaaaaaaaggctgtggctgcatttggtccattggctgtaatatgctgattcctaattctctgggtaactttagtgtttgattagctactagaagttaggttaaacttttgtattttacaggctaactttaataatcttaaagtaaaacttaacatagttcatggaaaggaaatagaaattttaccctagtactcttttttttttttttttttttgaggcagagtctccctctgtcacccaggctggagtgcagtggtgggatcttggctgattgcaacctcctcctcctgggttcaagcaattcttgtgcctcagcctcccgagcagctgggactacaggcacgcaccaccacacctgactgatttttgtatttttagtagagacagggtttcgccatgttggccaggctggtcttgaactcctggcatcaagtgatcctcccatctgagcctcccagtgtgctgggattacagacgtgagtcactgtgcctggtctctagtatttttttttttttttgagacggtctcactgttgccaggctggagtgcagtggcgcgatcctggctcactgcaacctccgcttcccggattcaagcgattttcctgcctcagcctcctgagtagctgggactatgggtgcacaccaccacgcccagctaatttttgtatttttagtagagacggggtttcaccatgttggccaatatggtctcaatctcttgacctcgtgatctgcccgtctcggcctcccaaagtgctgggattacaggcatgagccactgtgcccagctgtactttttaagataagaattgcagggtatatatttttaccaacttaataacttataattttaaaaagctaattacttggctagaatataatgcgttacatattctttacactcagttcagtccatatctgaaaggcaaatagaattattttctgctagtacattgtgtagtccctatgttcctagtgtataaggactgttacctagttcacatttatctgggttgttgacagattttcctggtccctttggacagtgcatggccatgttggcaaaagctgtcaaaattgaaacattgacaccatgagaattgtgtgttttccagtctgctaaaatcaaaagtgggagggttcagtaaggtgaataacagaagcagagttttcggggtatctgttactcctcattcggcttttctgctctctgggggtctcaatttaaatataatgtgaaaattagttttacgaacctaaaaatgttgagtgattcatttcctggttttgttgttaatttctagatatttaaattaattgttagaagaaccccgttaaagaatgctttgcaaaacaacctccttatgtgctatgtctctgtttaatagtagttgagtttgtgtacatgagatcaatattttgaactatagctttttatgagttaaaaattgacggaacagttactgtgcacttgctgtgcaccatggtagtctcccaagtagtggtttttctgcatttcaatagtacatgagataggctgtgggtggcaaggtttcttgagaaagtgagggatgcacagttgggttttagaatacatcttgttcctccatgcccttccccaccaaaaggctggtagtcttgcatttgtatatagttagggtatttgatgtgttgcttccttgacagagttttgcaagaatttgcagatttaacaggaacaaaaacttacttaaaacaaaatctcttagtaaaagcatagtctagcaagatttagaatgatactttggctaacagtactttctctatatggagtgctttgtttccatagcctcacaagtatgttttcagataatagttgagttgaaaatgttgtcaatctcttgattttaaaaaatttactatttaaagttgtatacttttgttcctacgtattttcagttgttcttaaagtttaataagtgacatttgaaaatgggtatatgtgtataaaaacaaaagtaggctaggcacggtggctcatgcctataatcctagcactttgggaggctgaggcaggcggatcacaaggtcaggagtttgagaccagcctgggcaatatggtgaaacccccctctactaaaaatacaaaaattagctgggtgtggtggtgcatgcctgtagtcccagctactcaggaggctgaggcaggagaatcgcttgaacccggaggtggcggttgcagtgagccgagattgcaccactgcagtccagcctgggcggcagagcaagactccatctcaaaaaaaaaacaaaaaaagaaaaagttaaaaaaacaacaaaaaacccccacaaaatgagtatatgtggcaacaagtcctattctcaaaaaaattattgtgtgctagttaagagcttaatgagtagccagtcggtattaaatatctgtttcagctatattttatctttaaaaattatctacagattttggaatgtgaaaaactagtgttttgtttcataggtatatactgtaggcattttaaaaataagagccagtgccagtggtttacagtgtacacaaggataatgttctcatgttctcttgatgtcagtatgactttaaagcatattatcaagaaataactaagtctgaaaaactgtggtaaataactggtactctaaaacctaagtttcttattactaaaaataagaaatggtaaaagtcaccctgtgctgttaattatatgagccactgaggtcctgacactgaattcttggtggtggataataatctcttctttttaattattggcttccaattctctctgcattgctggaaacaaaaatcatatatttcactattggtggtggggatgctgtcactgaaaaagtagacacattcatattgattttagaaataagttaaaatcaaaatttgcttctgctaaattagtagaggaccaatactgtttttctccttcatagtatgttttggtacttctacattgacattataacttttttttttttaaacagaaatagaagtttacattcttagaaaatttatgaaaatatgagcttttacctggtttgtgtgtgtgcgtatatatatacacatatttttaaatttcttacattgattttcaaattgaaagagaaccatttgtgaaagtatcttaacagagctcatgctttacattttacatgctacaaagttattttagtgccttaaattatttatgttgcttattaatgaaaattttggatacataattttttcaagacaaaggtaaaaataataaaccctttccttctgaggattaatgataaatataaactttaaaacgattaaaaaaatttttttagagacagggtcttgctctgttgcccagactgaagtgcagtggtgcagtcatagctcaatgaagcctcaaactcctgggcccaggcaaccctcctgcctcagccttttgagtagctgggacttcaggctcatgccaacatgcctaatttatcttatttttagtagagatgaggtctcaaactcctggcatctcttgccctctcaaagtgctggtactacaggcattagtcaccacacctgacacttaaaatcttttatatacaggtgtaagtgggtatctaacttaaagtgccaacgaatgtagttgaaagtttgtagttggcttagctaactagttaactaaattgattccattaaaaataagactgctcttagaatataatgatttttgttattcattaaatataaatatatcactggatagtatatgttaatgacttgagatacgcattttaacatataatcacgttacttaaatgcctgcctttgaactgaaacttaacattatgaatttaaattaaagtttgactttagaggtaaatttctgtactttactaaagcagttcttaatatacttctgagatttctaaaaattagtgtgccctaaagaattgaggtgtgtttttcttaactactgtaggcagtagatgtacagatgacttctgcatgcaaaaattaagccctagccattggtttacttcaactaatacttagttgccaattctctgtgtgtgattgaatttaaaactacaaatggtactggtgatacattaactttttaggtgctaggtccactttgttacatttggttcagtagaaacattgatgttaccaatctcagaaagctaaaatatgtatgccaatccccaaattaggtaatttattcttaattttaagataaaagaatagaattcccttaaaattaaatgtggagtaaaatataccagctttaaaaaatattcacctttctgttagaagaatgaacataatattacatcttttaatttgcactatatatagattaatatttctgtgtatttctctgtgcccctactttgatggtatgcttttctgaacaaactagcagcacagttaactaagcactttgccccgtttgatgactgcctaattttctagattggaaaatattaaaaacttttatctccatatggccaatatatgattgtacctgttgtcatagctctcctatgtttaagcaagaaaaaccctattaagagtatttaaattagaatggaaggcacacagccagtatgattgaacactgttctaaaaattatttttaagacttgtagtaaggccaggtttggtggctcatggctgtaatcccagcccttaggaggccaaggtgggcggatcacttgtgctcaggagtttgagaccagcccgggcaacatggcaaaaccctgtctctacgaaaaatacaaaaatcagtcaggtgtggtggtgcttgcctgtagtcccagctatttgagaggctgaggcagggggatcacctagcctgggaggtcgaggctgcagtcatgatcgtgccattgcactccatcctgggcaacccagtgagaccctgtctctaaaacaaaaaaataaaaaaagaacttgtagtaaggatacaaaatgctcctattttgtgtgtgtcctttaattcatgatgtttttatattatggtaagcagctctcatttaagattttaataatgtaattaaacatgtacagaagacccagtctcagcttcacttgtataccctggaaatagactgaaaggtgttaaaatttaaaataaaactcaaggttccagtttcttgactcacctttgagattcttttatgtttttgttgttttttaacaaaggtttcacgtccatattttaccatttttcttctcattctcccctggaggagggtgtgggaatcgatagtatataaatcacttttttcctaagtcaaagaagtaatttaaagctaacttcagtttaggctttaattccaggactagcaaactaaaatggttgcattaattgacaaacagatgctaatacctgtgtttaggcttgtcataatctctcctaattcctaatttaaaaattttaaaatttaattccattagaaaacaaaactgacttttaagaacaaaccaggattctagcccatattttaaaactgcatcctcagttttattcaaacagtctgatgtctgtttaaaaaaaaaaaaatctcaagctcataatctcaaacttcttgcacatggctttcccagtaaattactcttaccaatgcaacagactttaaagaagttgtgttttacaatgcagagagtggaggatgctttttatacattggtgagagagatccgacaatacagattgaaaaaaatcagcaaagaagaaaagactcctggctgtgtgaaaattaaaaaatgcattataatgtaatctggtaagtttaagttcagcacattaattttggcagaaagcagatgtcttttaaaggtaacaaggtggcaaccactttagaactacttaggtgtagtattctaacttgaagtattaaaagataagaaacttgtttccataattagtacatttatttttaatctagtgggaattaattataattgagacaattttgatggctgtagtagactaatctatatttggcataaagtctaatgatttaatgagtcttaagtaaactaaatatttggaaactgatatttacctttgtttttaagggaaaagttttgagataatcagcagcctttttttttttttttttttttttagtagggagaaaaagatatgagctatagtagacagcagtaatattgaatggcccagaaggtgggaaaaagccactcttaaatgtattttttcttttggatattttacaagcaaataataacttctgcctaagttcgccatctcagtggcatcagcagcacagcactttcttatcccagtgagaaaccggggaattttaggatgactcctaccgccctcttttccccctggtttggaagtatccacaaattcctgtgacgttacattctgtgtcttttatgtcatcattagttcaggcccctatcatttcttgttggactgttagaacctcctatttggtttaccagttgctgccattattcattgtgaaaccggagagatacactttaaagaaatgtcattgttggccgggcgcggtggctcacgcctgtaatcccagcactttgggaggcctaggcgggtgatcacctgaggtcaggagttcaagaccagcctggctaacatggtgaaaccctatttctactaaaaatacaaaaaattagccgggcgtggtggcacgtgcctgtaatcccagctacttgggaggctgaggcaggagaattgcttgaacctgggaggcagaggttgcagtgagctgagaatgcaccattgcactccagcttgagcaacaagagcgaaactctgtctcaaaaaaaaaaaaaagtcattttagctatagaataaaatctcatgttccacatgtgttgcagatagtccttactaccttcccaccactccagctcttttttggtcttatatctaaaaacgtcatcttgcctgaatttcttttgttcttctataaataaataccatgttatttcctaccttcccttgagtcttggctcttgtttggaatgccagtatttttatccctagtcttactaattagctaacactctcatgattccccagtctcctactctctaaaaacctttctttaaacccttagactaggcatggagcccttcctgtgtattcccagaatactattcttaactattatatgcttcccatgttatgttgaaataactaacctcttctgtttcattcctatattacttgacagcaaaatcttagccagaattacatatttttaatctttgcacacccattgcctagtaaggttcctgggacatagtaactacccagtaaatatttattgcgtggaattctcattttcgtttctaaacccgtattaaactctgtcttgctcagaaaatacttcactaggtatcataaagttcatggcagagcttaagctttggatgcatattgtttgtaatatatcatgttcttaagaataggcaataaaattacagttttcaaaaactactacatttattatatttattacaagttggtgttctttattacatgaattttaggtatttcccaaaagtataaaatatacatttgaatagtagactcaatcccaaaagatactacgtggtgtactaatctactaaactcagaaacaaagcatgactggcattaatttttgttgaaatttatgaactctgaatgtttttgaatatcattctgtaaagcaatattttgcaattaaagcaattttgcatgttaaattttaccacaacctctaaaatattgcaaatttaacaatacagtttgaaaagttacacattttaaataacagtaccatgaccagatttaggtggtggttttaattttttattttctcctcctattgtctcaccattagatgattttaaaaatagaattgtttagagtaaaataagtgttatgctctaatttatatttaaaatgaaggtttaagcacgtactattctaaaatttctaatttgtgcaaattatgttttatacagtgactgtaggtgaatgtcacaattgtttgatgtgacgaatccttgtttttcagtacacgtggaagtaattcatataaaagagaagtatacttggtaattaaaaatttaaaattaaatacaatttaaaaaaaaatttatttgacaagctggctgtggtgtgtgtgcctgtagtatcagctgcttgggagcctgaggcaggaggattgcctgaccccaggagtttgaggttgaagggagctatgatggtgccatggcactgtagcctaggcaacagaaagagactccatctcttaaaaaaagtaaaaataaaaaaattttggcacagggacagtggctcacacttataatgccagaactttaggagtccacagcacgaggattgcttgaggtcaggagtttaagaccagactgggcaacgtaatgagaccccacctttaggaaataaatacataaataaaaatttgagaatgataaacatatataaattagcttttcttagtcctgaaaaagataatgttatgtgtatgtgtgagaatgattagttctcatatgagaaaaaaagaattcattgctctgtgtaggttgtgacatttccttcacgattgaaattaattaatttttttttattacttatttatttttaaaatagagacaggttcttgctgtgttgcccaggctggtctcaaactcttggcctcaagcagttctcctgcctcagcctcccaaattgctgtgactgtaggtgtgagccactgcactgggccaaaattacttaattttaacaagatgatgtagagaggagagttcattgcaacataagcctagaatctttgtcagaatcttaggaagtaatgttttcaaattctgtgttttcaccataaaatgtgtcttctctgtgtccatcacatggtttttcattgttttctgctttaccattttagtaccattggcatttttcttcattgtaaaagtagtagaaatggagtagattacataaggatgtgatcagagggaatttattcattcagggtaagggagttagatcctcttttaagattctatcacattctaagggtttatgattctaaactgtcaagtaaattgtcaagtgctggcaagctacagaataatttttattgtatcattggaaattttcccctctatatgtgttaaagagtttagcctgaagggatacatacacatacatatatgtaatcaaaccttgatggtattgtattgctgataaattatttcttaccacttttcctttctcctgtgggagaaacaaaagcatatgtttgtgtagtatcagtaatgatattagagagtgggaaacatcagtgagtgcagtttggggactttattggagactttcactagtgctcaaataaataatgctggtttttatcctactgtttgcttaatgtggactagcctcttattcccattctatgtttacctctcttaaaatattggtcacgctttcttgaattatagatctattaggaaaattcatgaactgtagctaattttcattgttcatgctccagatttattttgaaatatcgttaatcttagtagtacagtaaaggagaaataccacttaacattttttgtttttttttctttgagacagagtcatgctctgtcacccagtctggagtgcagtggtgctatctcggctcactgcaatgcacttcgcctctccgggttcagcaattctcctgcctcagcctcctgagtagctgggattacaggcacctgctaccacacccagctaatttttgtatttttagtagagacagggtttcaccatgttggccaggctggtctgaaactcctcacctcaagtgatccacccgtcttggcctcccaaagtgctgggattacaggcttgagccaccgcaccccgcccacttaacattttaaattaatttcaagataatatcacttgaatatttttacacatataatttttttaatacatttatttacacagtttataatatcctacaaagtgattacaatgagtaaaaacccagttttcattgttcctaaagtggcttgatttatacaacttaatgtgttgggtatttgtttctaagactccctctgctgtctaggtttggaagtattgtgaggttaacagattttctttttatagttactactcagttgaacaggctttaaaatacagagagaatcatattttttcttcattttttgcttttatttatatttttcttttaattggagacatgacaagaattgacttgtgtatggatcttgcataatttaagtactgcaggtttaaaatctactctactaccagtttgagagtgccatttttcacactgtagattattaggttgaaaagtattatggcttaaaatcgcttttagccattaaatttaaataaccttgctttaatcataaatagatggtggtcacaatgactaactgttaaactctttgaagacaggatatttggctttatatggcaagcttttgaatacaacagaaattaaaactttatgggatagaaagaatctcctccaaattggtaaactataagacctttcaaatgatttagctaatttctccacaaatctgaggtattagtgttttttttaaagtggtattctcctgtgttggggtcactttaaacctttttcttaatgataaatatatgaattgaaactaatcccttaatatatatcatttgaaaactgaaataatatgtttagatactgtttacttgttgataaattattggaataggatgttcgaatactgtttacttcttggtaaatttttaaatccaatggattttacgtaagtatagaactggagctcaaatactgttactgtgtgtgaagatatatgaacatagtttacagttgcatggcttatatctaaagtccagaaacataaggacaattaagtgtacacacacacacatgcatttggattttgatgacttaggtttgccaatgtggaaaaaatagtagcaaattaagttctcctgtgaaaaagtcgttaccttatttaaaattctgtgccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgacgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtccttaataaatttactttttataatcatcaccccttctctcactatgtaatcaaaatcctcttgctgtcaccattcggcgcacacactctactctctgagctctgccacctaatgccagagtgccactgccaccatcccacatgcatggtcttctcttccccctttcccccaacctacccttcttgggctcaagcaacttacactgcaccatttcctccctcctgggtaaggctcaccttttgttcccattccaaaaacctgtgccaccatttccttcaccctaataggatgccctcctcatcccctgctaggctgctgctgtgcacaagtccctacccccagaggccctcactgcatttgggctccagtatcccctgctgggctactaccttgccagcctttctctcgcccccaccttccccagatgcctgccttgctcagccccacgtaatgacttttggactgaattactctgataggcaagcaggaagcaacttttttttttttgagatggattcttgctctgtccccaagctggagtgcagtggtgccatctcagctcactgcaacctccacctccctggttcaagcaattcccctgcctcagtctccccagtaagctgggactacgtgtgcgcgccaccacgcctggctaattttttttttttttttttttttttttttttttgtatttcagtagagacggggtttcaccatgttggccgggatggtcttgatctcctcaccttgtgatccacccaccttggcctcccaaagtgctgggattacaggcgtgagccaccgtgcccggccgcaacttatatttttaaaataggcttttagatcagttttaagggttattttatagttaactagcagaaaatgtggattaaaattacagtaccatactcaattaaaaatcatgcgctacataatttaagttctcctgttaacttctgtttgggttgaaccccgaagtacaatagtgtagattctcattgtgacctcacctgcccctttaggcattttgcaaaatttacaccttttacaatttgaaaggcagggtgccagtgccttcatgtatttcatttaatctgaaatttttatacgtattagacatagaaactgcataaaatatgaatgtacaaattaaagtaaaatatacatctgggtacccatcattcaagttatgaaacaaaagtcttagaagcccccatgtgcccctctccaattgcttctccttccccatctctaccaagatagcctctaatgacttcctgcttattctctttagttttcccagcactcatgaacattgccctaaatatttaattttggcaatttgagcagcaagcacgaatctagcaaggaaaagggcaacaatgctgctgttaattaaagccaaacagccctagtctggctttaccttctccaggctttctggatcccttctagagaagttaatttgcaatgtcatgagtgaatactgggctcctcacaactgaagcatgtggaaagatcaaagtgtagaattgatacctgatttctggccaatacatagcaaaaatgggaaggaggaaggctattttctgctttaagctcaccaacgcccaacatcagctttcaggaataggttgaaaaagaagggtaaaaatgagtgtcctcagttggtccagtcagcacagcacagaagagagcaggaatttcatcaccacatggtcaagacaaggcaaataccggtaagaatctgagccaggcttgcctgggcataatgtcctcagattaaaaagatgatacaatggcagcagggatcttagtgataatagccatcaatgtgagtcatgctgcttgattctggactgactgctctctacatcaagaagcacaactgtggtgctggaatcctacttgaccatgctcccagaaattcctcttgcctatcctctatgttgattatcccattttctacattccaaagtgttccatttcctggttttatttttgtttctgtggagcacatcctaacttcttgaaaagggtacatggaaggtaaatgagaccctggatgtctaaaaatggctggctccctctatttgtttgatagcttgtctgagtatagaattgaaagctggaaataattttcttttcaacattttgaagtagttgcttgtctgtttgcttttaccattgctattaagttcaaagcagtcctggtaagtgatcctctgtatgtgatgtattttttctctctctccccagaaacttacagaatcttctccatgaagattttgaaatgttagtgatgtgttgataatggatttatttttatccattgtactggacactcagttggcccttgcaatctggacacttgtttccttcaatttgggaaaaaattttaaatgatttcattcatgatttcctccctcctccattttcttttttctcccttcctggaacttttattatttggatgtttgaacttctaaacatgttctcttccttttttctgtactattttccatttgtcttttttttttaagcatggagtttcgctcttatcacccacgctggagagcaatggcctgatctcaactcattgcaacctccgcctcctgggttcaagtgattctcctgcctcagcctcccaaatagctggaattacaggtgcctgccactaagcatggctaatttatgtatttttagtagagatggcttttcaccatgttggccaggctggtctcgaactcctgacctgaggtgatccactctccttggtttcccaaagtgctgggataacaggtgtgtgcctctgcgcccagccttttatttagttgtatgggggattttctcattttcttcttccaagtgttctactgagttgttcatttctgctcttcctggacagttaattttgaccactcagattgctctcagcatagctggagactactatagagatgttaaaaatactcaaaaattataatagagtagcctgggaatgggagtaggggctggagaccaggaaggaatcaaagatgcacaaggcaacctttgtggatagtggatatatttattgtcttgattgtggtgatggcttcattgtgtgtgtgtgtgtgtgtgtgtgtgtgtatgtatacatatatgtatatatacaaatctatataattagtatagatactatatagtatatagtatgtagttttcccaccacttagccctgttcttagacttttgctggcatttctattacttgcaaaaatatattaaaatatatattgacaaacagaggtagccagccatttttagtatatagtatactatggtatatatatctaccatatactacatagtatgtactatgtagtacatatatagttatgtactatatatatctactatatactacatagtacagtatgtactatatgtactatatgtactatgtagtacatactacgtagtatatagtagatatatatagtatatagtacatagtaattccttttatttttgtttctatggaaacaaaaatatgtatactatatattatactatatgtagtatatattatagcacatatatatctataaatatgcatatatagatgtgtatatatatgaaccaaatttatcgaattatactttgtaagtgtaattcagtgtcaattctacttcagcaaaacttaaaaaaataatagaaatgccagccaaagtctaagaacagagctaagagatgctgaaataacacatggaagtagaaatccatctaaaccacaaggctgccaattcgtgggtaggataggtgactctacctgtcctcagtcgatggctacacagaacttggggtatgcctctctggggaaggaaccctggaatatacacttgaatcaatgaaaaaatctgaaagacacttgccgccagcatagcagtgaagccatgaccttttcttaactgaaggtcatacatttactgcttttctggctcctctttcctagggaaaaaaatacttctacattaatacttgttaaattgtacttactactagttaatgagctaattcacataacaagcatattatgtaggcattttttctttccaagttcactgattc

SEQ ID NO: 305 - DNA, 1528 bp, Homo sapiens
aggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgacgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatcca

SEQ ID NO: 306 - protein, 151 aa, Homo sapiens
DSYRKQVVIDGETCLLDILDTAGQEEYSAMRDQYMRTGEGFLCVFAINNTKSFEDIHHYREQIKRVKDSEDVPMVLVGNKCDLPSRTVDTKQAQDLARSYGIPFIETSAKTRQGVDDAFYTLVREIRKHKEKMSKDGKKKKKKSKTKCVIM

SEQ ID NO: 307 - DNA, 24879 bp, Mus musculus
  misc_feature (1)...(24879): n = A,T,C or G
tgcaggttctgagatcgagccaccatcttgctgtgtagtttttgtttatatttaagagttgctgggagatgtgagccaacacacctgactcgctgtgtagctgcgactctcttcacttcactcttcctttctgaaggatgataatacactcccttcatagaccctggtcaaatttgctaatgcagggacaaaaaaagaaagaaagagagagagagagagagagagagagagagagagagagagagagagagagagagagagagagaggaaggaaggaagggagaaagaagaaagagagagaaagaatatcattgtcttttctcccctaggcagctgtggccctgaaggacatttcttggcagcaaccctaccccatggacttctactctggcagctccttagggccatggacagtgaactacggtcgggaccgagcacctcggggtctctgccagcctgcatctgacaaggtagcccactttaagcagggctgagaggcagcctacaggcgtgacgtggtccaccgccgccgccctgaggacagcgggggaaatgcaagggagccgggtggaggttgcagtagagagacttgaatctatctgctacctcaggtgcagcaagggtccagaggcggctctccagccccagcctgtgagagttgcaactgcgcagaccagaaggctacttcgccggctccctgagagggccagagcagcaggtatttgcagccacgccccacctttttgttttaggagagccccgccttaggggtgttccccgcacgggccctgcccccttgccggttctacttccgcctgggaaggcctgcttccggtcggtctgcagtatggcggcacggcagaccctgcgagtgctgtgtctagccggcttccggcagagcgagcggggcttccgtgagaagacgggagcgctgaggaaggcgctgcggggtcgggcagagctttgtgtgcctcagcggacctcacccggtccccgagnnnnnnnnnnnnnnnnnnnncaggccattccaggtccctcccgccccccaagtcccctggctgcactttccccaagctctgcctttttcttctcaccatctctaatcctgggcctgtgctcttctcccatctgcttctagggccctgttctccggaggagcagcctcgaggctggtggttttctgaggaggaagccgatgttttctctgctctggaagagtccacagtgtgcaggggtctgcaggaggccctggaaacggtggcacgggcccttgacacgctggggccgtttgatggacttcttggcttcagccagggggctgcactagcagcttatgtgtgtgccctgggccaggcaggcgatcctcgcttccccttgccaagatttattatacttgtgtcggggttctgtccccgaggccttaaggaacctatcttgcagagccccatgtcactgccttcacttcatgtttttggggatactgatcgagtcatcccttctcaggagagtatgcaattggctagccgattccttggagccgtcaccctcacccactccggtggtcacttcattccagcagctgcatctcagcgtcaggcctaccttaagttcttggaccagtttgcagaatgaaggatggacaaatgtctccgcactgctcccactttgtccagcagctctcccctgtctcctcaccatggctagttaagacaactgtcagttctcaggacacacataagcccagagagcctgtgagaagacaggggtgggcaggcaggggctggcacccctgtgactgacagacaataaagcgatgctttagatgttgaatgcctttctcctgctgccccgatcctggggcagcaccaaaccaaacccaaggacacatttttggtggaagtcatttattgttttgtatctttaaattcggcttattgtgtgtatgggtgcagacttgtggagatcagaggataagtgcggggagttgattcaaccatgtgggttctttctgagctctgatcatttgacttggcaagtcatgcctctacctgctgagccatgtcaccatccttttgtggaagtttaagtcccagactgaagaagctagatatcttggtcacttagaatcagaaagttttacgtttgaggagtttggggaaagaaaacacttggcaaggctctgcttggctccatctgcttttaggtttcctacatcctggtccctggcttggccattgctttctcttccataactgttccatccccctctgaactctgagcttgaagacttgggtagtaccatatgttgggtagaggccaaagacagcacagagtaacctgccttttcctaatgaagccatcttcagggtttctgagattactgctattcataattgatgatgctaattattgatatgttgagaaagccaaagcttaagtagcctgctcagcttaacttcttgccatttttcttctcacttccagtgcccaatcttgccacacacataggcacgctgctttctgacttctgcctctgaaagacagtttttccaagatatcacaaggtacttacctagtcccacaccacaatatcttctagggagcttagtcactgagcaggagttggagttggccagttactcccaagtcattcttatacccagagttatatgttcttgacacacaagtgtttcaaggtatacatcagagaaatggttctgtggttaaggacatgggctgctttttcaaaggacccaggttcgggctccagcatccacaatgtagctcacaaacatctatagctcttagttccagaggctctagtcccaggtcccagggttgtacatgatatgtgtttaaaaagtcaatgacccaatggccatggtggtacatgcaggcagaggtagaggacagtctagtctaaaaacaaccagttagtggtggcacgtgcctttcatcccagcactggcagagacaggcagatctgagactgagcttatcctagtctacagatggagttccaggacagagagggctacacaggaacgctctctgtaacctctgttagatgaccaaggcagagccttgccatgtattctcttgccccgaactccacttacatagaagtctgactcagttacaaaggcctctggcttctttagggctcaagatttccaccaaaagacagtgagatggctcagcaggttaaaggcactgactgctagctaacacatgccatctcatacacactaaacattttaaaatttcacgaaaggatagactggaattataccccaaagtcccatgtactgatttgagatccctttttaacagcttgggtgggggattggtctctgtgccttgttcttgccttacagtgattgcttccttgacaaaaggagattgaacacgtggaattttataaaccctttggtctatttgcttttctgtaactaattggtgggtttgcaagttagtactcagaccactggcagtcataggcagccccctgtgtcagctccaagctgggggacaggatgacctgtacttggtagccctataaataaaggcaaaggttcatgtgagtggtctgtaggccctggctctaccaggaaaaagggaggagagggttcaagcagagctctattaggtggaacacacagaagggcccatgtctgaagtgaagagccctcccaagaatcagaacagttccgagtcccaacaagtggagagttacttcccaccatgcggaatgaactaccacatgcacatccctgggggccacctacacaaggaacacttgttaaacctggagttcctagagaaaactatagacctatttgtctgcccctggtcattcctgatgtagctatttgcaaactacagtcttgggtagaattttaagtctctggtaaatatgtggtattaggaaagagcctctagtgggactcaaaaccctctggggagaaaaagaagccccctccccccgaggaatcaatgctctaacatttatgtacagcccaggcggataaggtccagaggtagaaataacatttattgagaattaactataccagacaatgagacaaatagaagcctgtcatctaacttatttttgagacgggggtctcacggaagttctggttatccttgaactcacagaaatccacttatctctgtctcccaagatctggtattcagagcatgctctaccatagcctaactcatttatttttggtgctgggatcaaacccaggaccttaggcatgctaagcacagacctactactgagctctatgcccagcacccctgtccccccccccattgtctaatttcatgaaaaagtactgtcattaacctaataactgagtcttacaattgaggaaacaggcacagaaaggctaagtaccttactcaaaattggatgattcagactcaaaagccccatattcttgtctgttgtcatcatcccccccccctttgagacacgaatctcatatttatctcatatttattgtctaggctcctgagcaactgggactgcaggtatacactgcagctcctggttttggttggtctttctgctgtccagtaaaaagcaagcaaaaactaccgctctctataggctaaatgcccaacctgggcttctgctttctaatgtgtaaagttgggaaagaaggcatggtttacactaaatgttttctaggacaacgaacactcaaagcattatatagtcaaccttctaaccacatcttctgatgggttccatctgcaaaaggtcctcttttctttttttcttttttcttttttttttttttttttttttttttttttttgggttttttcgagacgacagggcttctctgtatagccctggctgtcctggaactcactttgtagaccaggctggcctcgaactcaaaaatctgcctgtctctgcctcccgagtgctgggaataaaggcgtgcgccaccactgtccggctgtcctcttttcaaattatccctgctatttgttttctgcatcttgattacactcaggatttctaccctatcagacagagtctctcaacagccctagccacagagagtatttacgtgcagtctctgtggttgtactccttttgggggcacgtttgaagatctcaagttgggatgcattacttacagaccagttgagggaagactgctggctgataccttcagacaatgaattaggggccaggtgaatttcactagcctgccagcttcttgctgtgttaaggacccttttaatgatggcccaggagaaagttgggggacagagttatggctctatcaggaaagggattctttgccctttcccctctacctgctcacctagggttttctggaagaaaggtgtgataaaacttccttctcctcccccttcagctttctgctggcaaaagtgacttcttccttctcacaggactcctgatcccatcggttcaccactcatgagataagaatccttatcgcagaaccacccattttctcgccaccttaggcagcgatacctcgactaggaagacaggagagtctctgaggaggatgttcagacactccgcggatcttgcttctgcaccgaggtagatgcacagcagcctgaaaggccgcctttctgagcacacctcttgccacctccgcagacacatcgaatgttgcgtcgccgccccgcctcctcttgctctgtatctgcccaaacccaggctggcagaactcgggagtggtggggagcgtgggcgtgctgcggggcgaccatggctgtagactgttacctccggttcccacagtaacaatcgaaagccacggttgccctggagacgcgggggcggggcttgcaggctgacgtcagcaccgcgggcggcgggggtggcgcgagtgtctgcggggcctgcgcccaccgcaacccacagggaccttgaacaggcgtgcccgagggaggcgcttgcactgcatcagcaccgcggacagcggcgcagggaggcgtggaggggccgggggtcggcggtcctggggcggggccaggcgtcggtggccgtgactggagactgttactgaaggcggcccgggcagtaagcagtctagagccaaggtgccggcgcgctgcccgggcggggatatcccgtcgcccgcagttgagagtgctgctgcttctcaggcccccccacctcctcccaagcgcgcgcggacagacacgcgaccgtgacgtcagagtcctgtgacgtcaaagatgtcccagcggggaggcatttccggcggtggggagcggtgggggtagggcggggcggcctgatcgaagccccgcccccgcctggtcctgagaggacagctccgcttgcagaggcgggaagtcctgagctcagtgggacagtccgatgggacgggacgggaccggacgggaagggacgggacagggaaggggcgtgtgtggagcatgcaggacgggggtcccaagaaagccgcagggccgaggtgtgcgtctgtctgtcgtgggcgccctggctcagtcagtcggggccatctaggctgagtcaccgctctgcggacaggggagaaatgagggggcgcgtctcctgagacgccagcaccttctccccactttcttgaaaggatggcgcaggagctgctcagcctcgggaaatggggtcgggggctcggctctccgcttgatgtttctccatagtgtctgcgtctgcatttgggtgccggcaggtgctgcatagggttgggtcagccgccggcccctggtccaccaagctgaaaggaaccttcgtccctcccactctgccccccatcctcactccggagtccccctccaacccgccgcccctccggtcccctcctcgccttcccatggcgtccgcgcatctgcccatctccgactgttggtggtccttacctgtcgggccgcgtcgcaccagtgccggcttgcctcccgcagcccggccggcgccgccgcttttataggcgcgcgtagtactcgtgcggcggctcattcatgcggccgcggctcctacacactgacgcgctgccgacgtcagcagagaatttaggaaacgggaaaagaggctatttatagtggcaagcggggagggggggcgtaggggagggcgggacgaagcgacagggagttggagcgggaggagggtgcgcacgcggaagcagggttgggtaggggagtacgtaaccccaggcttggcctccaaggggttaactttccggaactgcaggcgacgggctgggggagaatagtgcagggagggtgaggccccgttctgtgtttattcactctccccttccggggctttgcgagtcctaggatctcagttcttttctcctggaccgcaggggtcctcccttggcagccccaaaccacactgctcattccctagaccctacagtcctctgacgccagaagatgccccgcgatggtatcactcccatttggccaccgtggtatcctcgctctctcctggtgtgtgtgtgtggggggggtggggggtgaggcaagaaactggaccggtttaggaggggagtagagtgcacctcgggactttgacatctaggagctggggaaagaggggtggagaagcctgggagttttggaaggcttcttgactgggtcacaggaggaaaggtaccggtcagatggtggaaaccgcagagaagatcagggagtctaaggagagtggtctggactttagaaatgagcagaagatcttctgtaagagtttggaaaatccctgtacggagtatccacaaaaggaagggctagcctgacaagtactggagagccaacttggcagtgccccagggggcacgagggggccacctcagtggggtggaataggcataggcagagcctgtaagagagaaaatgagactaagggggctcaatagcttggcagagggtgtgtgtagctgggactcctttctaaaggagtcagaatagactaaaggcaaatacgatatggaacaggtcctccaaaacagcccgattctgtctccgggctctaaatggggtcgtcatgcgttcacggagaggaggaagctgcaccaggatgaccagaggagctcaggaagaaggggaaagcaaagttaagaggaggggcatggtggtgcgcatccttgtacgtgggaagtagacgcctttgtgagttcgaggctagccgtagacttgaaactgtggtggtggtggtggtggggcgtggaggagaggagaggagagaaggggaggggaggggaggggagtacacagtgaaacttgggcaaggtttatgtggttggccccatagcgatacaacaagggcttgagtcggtggagagggatagaacaagaaggaactgaagacccagccgacctccttatgggtcaaccagcggataaactccattgtgtaaaacacatacagagctttctctccagactcgcacgatctaaccccattaaaaggagaaaacatttaaaacagagacatcagagacacccttgcttgtgggagaactcagagttgtcaaaactcatccctaagagcacttctggggagccttcttatcctcaaacgctccgttacacttccgcttcagccccaaggcgtatccctcgacagagataccaaggtacctcttcacttctcctagagctcagaaattgtggagtccaccgtgggactgcagtgtttgtcttgtatggacactgtacggagatacgaagtagtaagtggattagatggaggcggagcacactgtcgcggaaacctggtgagccttgaagactctttggaccagaagcctaggccaggcatagaagtctcctgccaaagaaacgcagcctctaggaggcgcccaagaccttggtgtctcactggtacagctagaggcccggccggctgccccgggcgagtgactcagccactacctcaagcgggggagtgggggctcgaagacagcgtggggtgcggcgagcgtagcccccacccgccctgcgccccgcgcggttgctaagctctccaaggcctctgagagatgagatcccgggaacctcattggttaccatagtaactctgagccccagcctctccggcttggccacggaggatggcgcagccaataagaagctgtgggcggtttggggggaccccccctatagcgtgggcgggggtcaggaggtgcggggaagaggcggagcgtgggccacggaggcgcggtgcttgcaacggtgcttatgcctccgccccgctatgcagggacatttccggtgagcacccaagagctggtgcacgctcccctccctcctaaaagaggagtcaccaacatgaatgagctctcccttgtgtggcgtgtaggatctttttttgagggggtctcaagccgcccgttctcgtgatatctctcgaatggtgtattgggggggggcaaactaagatccctcaaaactgcttagatgggggattggggacttgaggggcacgtcgcaagggggctctgtccagctatttccaatggagggctctagggtccttctggagacccgcaagttcggggagggctctttggtaggacctctaccccgtttcacgtagtagcctccgcagtagcccaagaagttgggactccgggagggggtgggcggtctgtgtaaacatggcgcgcccttgtcactgcttggacagagtttgagtgtggacggtttatgatgtgcatactgataacatgtgtctgagggagagttggaatgtgtctctctccactgagtccaagtgaataatggtgttcagaaatgtctaataaaagccgccccgctcctgctccgaacgtatgtaccttcatctcacttaggatttctaagctcgccctctcacagaatactgttcgtagtgttccaccccaaccccttttctaagatagggtctcaggtagtagaggctgaccttgaactcctggtcctcttgcttccaactcctgggtgctatgctaggatgattacaagaatgcgccaccatccctggcttaagagttcctcatttgaagacagaaccttccccccccccccgaattggcgcgatataacatataaatatgtactcgggagcactcagcacaaaacccccaggtttatgggactcccaggtccgatatctgagtctccaggtgggcacatctggaagcgcgcgaacctgcaagatctgctcagctccgcatctgcaagcctcttggcccaggtgtgcgccagaggtcgcagcccagccgcacacagtccccgcgtggccgcgaggtggcgccatggccgcggcagcgtctgccggttcgggccgctccagataagagtgtgcggaaagcgcggaggggctgagacgcgaccaggacgcggggaggacggaccggcaagacagaccgaccgggggcccggcgggcggagggcagcgcactgcagccacgtccccccctggatccgccggcagccgggcccggggcttccgacatgccccccaggtgggtcctcgagttggcgacagggaagggcaagggacccgggacaatctggtcctcgtgcgccggctacctcgggagcatcctcaggcgtgggcgcccgggtcgcgtttggggctctaagtgtcttcctagaggactcgggacggctgggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtggctcccccctcccccccacctgcttcctgcctcagcctcctgccccgatataacgccctccccgcgccggggcccggccttcgcgctctgcccgccaccgcagccactgtctccgctccccgggccgggccggccggccctaacgaaggcctgacagccccgggccagggcggtgcctcgatgggcatcttgctcccgtcttccttatcacttcccctaaccggggcaacttctttcgaggcgggaggcgcttctaactcggctccttgtctccccacttgggcaaacttctcggccctgaatgacttttcctgaagcggacattttacttaaatcgggtaattgtctccgaaagggtcatttcgccctaaacagatttctccctggaagttcccaggacccagcctgagtgcccaggagcatctggggctggaacagataggctaacctggcctactctccatccgcagcctttctcctcctgcaccttctgtctggggccggcgggcctaggcttccactcccggaggccgctgatcctcctcggctactgttcaggccgtggtgctccatgcccctgatcagctgaggggaaggggaagcggaggggaaccgactgggttgggtacaagaggccagggcaccgcactgcgtagctcttacccagctggtgtgtgtctcccgcaggagagtgtgctgggcagatgatgctggacacgatggaggcgcctggccattcgaggcagctactgctgcagctcaacaatcagcgcaccaagggcttcttgtgcgacgtgatcatcgtggtgcagaatgccctcttccgcgcgcacaagaacgtgctggcggccagcagcgcctacctcaagtccctggtggtgcatgacaacctgctaaacctggaccatgacatggtgagcccggccgtgttccgcctggtgctggacttcatctacaccggccgcctgactgacagtgttgaggccgcagcagcagcagcggtggccccgggcgcggagccgagcctgggcgctgtgctggctgctgccagctacctgcagatccctgacctcgtggctctgtgcaagaagcgcctcaaacgccacggcaagtactgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcagccgtcaacacccactgcgctgagctatatgcttcaggcccgggcccagcagcctcactctgcgccccggagcgtcgctgctccccgctttgcggcctggatctgtccaagaagagcccgccaggttcctcggtccccgagcgaccgcttagtgagcgcgaactgcctccacgcccggatagccctcccggtgcggggcccgcagtctacaaggagccatcactcgccctgcccccgctgccgcctttgcccttccaaaagctggaggaggccgtaccgactccagacccgtttcgaggaagcggtggcagtccgggacccgagccccccggccgccccgacggctccagcctcctctaccgctggatgaagcacgagccaggcctgggtagttatggcgatgaactggtccgggatcgaggctccccgggtgagcgcctggaggagcgcggtggggatcctgccgcctcacccgggggccccccgctgggcctggtacccccgccacgctaccccgggagcctggacgggccaggcacaggagcagacggcgacgactataagagcagcagcgaggagaccggtagcagcgaagaccccagcccacccggcggccacctggagggctacccatgcccgcacttggcttatggtgagcctgagagctttggtgacaacctgtacgtgtgcatcccatgtggcaaaggcttccccagctcggaacagctgaatgcacacgtggaggctcacgtagaggaagaagaggcgttatatggcagggcagaggctgctgaggtggctgctggggccgccggccttgggcccccctttggtggcggtggggacaaggtcactggggcgccgggcggactaggagagctgctgcggccataccgctgcgcgtcctgcgacaagagctacaaggacccggccacgctgaggcagcacgagaagacacactggctgacaaggccctatccgtgtaccatctgcggaaagaagttcacgcaacgcggaaccatgacacgccatatgcgcagccacttgggcctgaagccctttgcgtgcgacgcgtgcggcatgcgcttcacccgccagtatcgcctcacggagcacatgcgcatccactctggagagaagccctacgagtgccaggtgtgcggtggcaagtttgctcaacagcgcaacctcatcagccatatgaagatgcacgctgtaggtggcgcggccggcgcggccggggcgctggctggcctggggggactacctggcgtccctggccctgacggcaagggcaagctcgacttccctgagggtgtctttgctgtggcccgcctcacagctgaacagctgagtctgaagcagcaggacaaggcagctgctgccgagctgctggcgcagaccacgcacttcctgcacgaccccaaggtggcgctggagagcctctacccgctggctaaattcactgctgagctaggactcagcccagacaaggcggcagaggtgctgagccagggtgcgcacttggccgcaggaccggacagccgaaccatcgaccgtttctctcccacctagagcgccgtccctcctaggtgcgcccggcgctgcctgacagcccggggataactggtagcagcggcagcgccgcagtggtggccccacctttctacacctcacctggcctcactgtttagtgccttagcctggggaagtcagtgggggaaaaccccgggtcgggggtgggataggggaagggagatttatatttttgatatcagctttgaccaaaggagaaccctgcctctccctgtggctcattggccctctcccccggctccgtgctgctcttgggggaaggatgccattattcggacggttgctcccagccctacctccggcccttgcgaccacacccattctcactgtgaatctccctgctggggtcggagcattgggcacagttggagagaggggaggggactgagccggccggagggcctccccgtcccctgctcctgcccagcccgggactgataatgtgaagttcctcattttgcacaagtggcactagccccagggccaacccttcctttcctcaccaccagggtgggcagctctggcgccagggatgacaaccctgacccatctgtctctgcttccgaggtgtcccctcctcttcctggggtccccggaccatatatttattgcatgcgccctaggtgacccctatcctgagcccaactttagctgggctggagagaggtctccttccttggttcccgttctgtccctttgtatattctctactctgtacacaggctcttccagagccgcttccattttctatactcaaccaaacagcaataaagcagtaaccaaggtccctataatcctgtggctctcttctgcccctgcaccacggtgggtggcaaggccccaacataggtgtacaggcccaaaccagccgcccctccccagtcccaaaaaatagaccagcagaggtcaattatatttcataactaaaaatttattaaggaaacaaaaccagggttccaagtgggacagaaagaagaaaggtattcttccattcccaatcccccaacccccagccaatgaccctcacagccagaggaggggacctcaaaggaagtagcctgcctgcgccttacaatcaagagagcttctgagctgagtcctgggcactgtcctgggcctgagaagggcagagcacccttggtgaagcactgctcctcctgaggtgggttgtgtgatcccctgcttagcctgagacagccttctcaatcctcctctacctctttgctagactgaaggaattcattcctggtcgggagcctccaagtgaggttgtaaacagaggcagcaaaaaacaaaaacaaaaaacctaaaagaaccaaaaccctcaaaggctaaagggccccatgtcccctcttctgggtaaagaagtacaatgacaaagccagaaacgggctcaacaccctggcacctctaccttggggttcagctctcccagctaggagacttctcagaggtgtgacgggttgggaaggaaggacagctgggaaggctttatttggttcctgtcacaggtggtaggggtaagattcagaacgagaagtcccacaaggaactgaggggaggaagtttagggggtttggggtgatgaaaggggccaactagaaaaggaaggcaggcaaagaagagtctgaggaaatttccccaagagggtactgcagtgaaaggaaggccaaggatgggagcatgtgctggtggagggccactcaggacgcacgggcccaagaccagatggcccttcccttaggcccatgactgcccaaaaggaaaacaagggcaaagtgcaagatgtggacaggaagagaaacatgtgcacatgtgctgtgtgagtgcgtgcgtgtgtgttgaagggcgagggctgctgttgctgttacagacagaagtcagcgtgggtccacagggcatctgggcctcagggagatggagacacctgggcacccttcctgacagctgaagcctctcagacattcaggacagagactgtgcagactgaggggttgatcagtttccttgcatctaatggaaactttagaatctctgccccttaccactacagagtggctgggtcctcggggtgagtaggcctccctccagccctgggaccagatagagggaaaaagggtgggagcttggtggcctactcggcttgtccacctgttgtcactgtagccagtcacctccctgctaaatcttggcagcccaggagggtcccagcagtttccgcctgacccttgggagggctctgtgaggagcggctcccccacagcacggccacggcgtgaggttggaagaggatggtttattgtctgggtggattggtagctcaggcacgtggacatcttccgtgttacactgggcgcctggcggcctctcaggaatggctccatgggggtgggccccagtgtggtcccctcagcccacctgggcccacgtaaggaaggctgggatgtccctcacaggcacattccttgtcagcgcctttacacgaaggttccgatcatcggtcagcaacaccacctcccgtaacaggcggattggctcctctgttggcacagaaatcagatgggctcagctgaggatagaagtgtcaaatacaatctcctgtcttggggagaatgtggttgtggaggggcaagttctttccaggctcagagcaccattcccctgatgtttagagggtcaagctaggtaggagctgtgctggggctatgaactcctcacacgggactcttgtgcctggtgcctgagagtactcaaactgcagacctgtcttccaaagactcagaactaataggaagcagactcctaactatacccctggccctagattcctattaactgccctcaccctcattctaacaaagtctctccttctaaaggtgggatgtgtgtgttaatgttttatgtatccaaaggttaaaaaatacaaaggtgaatagaaagtaggaacagatcttacgaatgtgggggaaggggttagctctgggatgctctcaggagaggcttgctaaaggggcctgtggctatggtcaaaggatctattaaaagagtgatctgtgagcatctatcagtacacagggtaacgagcagcagaggggactgtcctgcagctgtctcatgctccatgtagctctgtgccttcttgagttccttacgcacttttgtaaatacactcacgtacataggctagcttcctccggtaacactgagatcacattagccaccccttctttactcatattttatatacttacaacatttttctgtaccagtacagatagccttcatctttttagataattcttacagcagatttttcctgtgtctgactaatgtacaggagaaaacttaaaatggggcccaggaatcactcaagtgacactctaggccctgggcatgactgcttgggtggcaggtctatctctcagccctgccctggcatttcctggtggaggtctggcagaaagcaaaggcacaggaaatgtcctgtggtgtttggggacggctagggttggcgggctgggggattgcaaacatccatgtctgacctgagtaatgctggccttgccagctccaggcagggaggctgagagttggctttcagcctagggaggaatctggggatgaagagggagaggctcagggggctgatggtggtgaggaaagggagaagaggacgacagacagggctgtgtgtagagggtgaagaacacgcctcgtgattaagggaggtctaagagccttccttctgttgcctgggcctggaatgtgagtgtgtggtggggtagtggtgtggggtgctacatggggttcccagctgttgtctgagtctgtctgcaactccaccattcctgctctgggcttcacaccagaagagtcctaggccttaggtcagccaacaaaggcccagcattgctggcaggggtctgcaggggtttctgtggatactttgagacatttttaacaataaacatcctctgttttgacactggtaacttcactttgttagaaaccagagactgtcatcttgtcaggccccatccgccataatccacatgattttaaaattcaacatcgtttacacataaacacttggtgacggtttctctgtgaatctgacaagttaatctgctaagaattcacactgacaaatggggtttgattacaccagccgttgctgatgtaattttgataggggcggtccccatgatggcagtgggattctgtttgggagtaattcctggggtggtaggacaagttcaaatgcatctgggctaagaacagagctctggtggctgaggagtactggaagcacacgtctccacaggacctttgcaaccttgcttccctcttagaaggaacgtgtttagagcttgtgctctaggatagggcacaagctcctctgtctgcatcagccaggattcgaatttgtcagttgaacattctaggtctggtcctcagggagaggatatgtgctgcactcctgactgcccctggtatagaaataccagcacacgcgagggctgtgctaagcaatggaagaaaccgggagaggccagcaagccaagacggagggcatggatacagggtggcagagggtcacacaaagaaagtcatgaggctacataggtccacagagacccattgatattactagatcagcacatgacttagagctaggaaggggtaggattcctttccacaaaaagaaatgccagagtcttgggaatcaggagctcctacatgtcactggccctgtggtcctgtgtacaggcattcagggctgaggtggtcagacacttgagagttttagggtgacccagaaatgggattgtgctcaccaaaacagtttaaaactcagacacaagctcagtctttaaaactctcccacctccagttccagttagcctgtgaaatgctacagctcgctgcaatagagatcaggaagaaaggcctattcttgacttgggagaacctccactgcaggtctgatgcaggttgacgttcaagaaataccctgatatgggtagggaggagaacatggccaaaggaaaaaaagtgtgcccactgctcagggctgcagaaagctggacgcaggagaccatggcctgaacaagctatactgaatcataaagacattcttgctgtcaaaggaactcacccaagaaaggaaatagatgcagactgagtgggaaagcttacagcctagagcagggtttcctgggctagagaggctcattcctagttggctctagatcatataacattctctagggccagggaagctttgatagtcggtctaacctctgggaaggtgaacaagatgctctcaggcttgtataggcttatatagacttatcaggccaaagtcagcagagactcttcttagggactgtggatgggtaggagaaatcagggcagagggatggatggctcaaggagaggccaagctgtacctttgctggtgggcatgtaatccttagccttgtctttgcagtagtgcaggcagcaagagaggatcaggtcatcgttgttaccctggagaaagacagtgtgaaaagcaccactgggcaggagggggcgccatgcagaggcagaggtacttccagggctatgtcctagagtcctattcagacatgctttggctctgcttggctgagtctgtcaaagagcaaggaactctcccctcctgggccttgatgttggctaccctttagctgcccaggttcaaagggcttcttttacttcttccttttgggaacaccttctcccccaccccacaagacagggtttctctgtgtagccctggctgtcctagaactagctctgtagatcaggctagccttgagctcacagagatccacctgcctctgcctcccatgagttctgggattaaaggtgtgtgccatcactacccagctcaggaacatttctaataatggacttctctctggggggtctcaccagctgtccagtaatgtcctcacttcggaaggcgatagattcaagttcattgccacggctggtcaaggcccgcaggcaggagtcccgactctcaaatctccgttcgaggaactcaatggattttcgggccttttcttgcaccacacgggcatagcccccagcccggtggtctgtctcctgccctttggcgaggccgtccagctcattgatcactgacgggacagagtttataatgagcaattatgcctgtctgcgtcctctgctctctgcccagttcctttctcaggcaacagaggccaccttcccatacaagttttccaatgaatctggtaggatagatacttgtgggtataagaggggatctaagactttttttttttttttttttttttttttttaaagatttatttatttattatatgtaagtacactgtagctgtcttcagacactccagaagagggcatcagatctcattacgggtggttgtgagccaccatgtggttgctgggatttgaacttcggaccttcggaagagcagtcgggtgctcttacccactgagccatctcaccagcccggatctaagacttttggtgagctctagctcctttctgcctcttcctctgagctccatcttcctcccagggggaatttataggattatctggagctggcattccttatagtatagatcaatgaaaacataggagcacaaggtgagtggggtgctcttcttcagctactcgggtctgagccgtagcagtctaaaaggaggcagggttctactgccctgtctggcagagtacagggaagccacaaggaagaaggacagccacactgagttgcaagggccctggtatttcgtaaaaccataaccttggcacacattacttccttgaatctacgtgtgtgtgtgtgtgtgtgtgtgtgtgtgtgtgcgcgcgcgcgcgcgagcgtgcacgcgcctgtctgcttgtctatgtgtctgggacatggcttcattttctggtgaagattctttccaaaattccagccaaaagcctgaggtcaagtgggaaatatgcactccttgggggcttagagagagtttggggtctgaggcctctccttagtgcaatgattcatggcttggggagtcggcatgagcatgctgttccatggtgagcctggcactcattgtctgggtattcagaaacattttctggaaagggcccatatgggaacacacacacacacacacacacacacacacacacacacacacacgtgcgcatgtgcacacacacacacacacacacagacacacccccatgcttttagcaccatgaagctgaaaggtccagataatgtgtagcagttatggtacagcaaacagaacatcaaacaggaaaaactggtattctatccccaaatctgctttcctgcttccaaactaaacaggcttcaaaggggacgcttgtttgtgcttctgcaccaggcgggacttctcaatgctggggtcagacctaaagagcacagagcaggttaaagagcacaagacacaagcagggaaggctttccacttaaccctttgttgttctggccagaaagcaggagtccaccaaggaaagtatgagtgaacaggagctctgcttacatccttgaaatatagggatctgcccagctgatacagggtcagtgtctagtctgtgtggctgcaatgcatcggtcggttgctagtacccttaggctcactatgttctgaaatatatcctctagcatttatccctttcctaccaaatctaaatttctttatcaaacttaagctctttagggccaagggccacagatctgactttttcctgtaattattaggaacgaagagactaagcgcacacgaggagcagggcagcgccggtgactgctagcataggaaggcagaagagggatgttcccactcgcaggtgcctccttgagacaccagtgagctttctcagttataccaagtgcagaccagctaacaaaagtgaccaatcgactttctttttcctaactaaaaacctcctaggaggaaggtgcagtgctatggcctgtaagtcagttcactcagaagggcagtggaaagctcagggcactgtgtggctctggtgctcggccttatgacagaagctgctcttcttttgaagtggagcaaaccttcccttaggtctaagggcctgggtttaagagcttctgtccaggccacatggggagggggaaggaagacagggagggaggaggactgcttcagtgccaacattctcaggtggtgctaacgtgtttcccacaaccccccagggttctacaggctctgcaggggcggatgtttcctgccctttgtttccacccccatctggcactaagacacttgggactgggagggaaggcccaatggaacatcttggcatggatgtcagaggtggcctgtcaggcagactgccagtctagtgcctttttcagagaatagtgttctcgaacttacttcaaatggctgctggcagagggatactaaagatccttgtctttgcaatcatcgtacacaccccttccccccataggacagccatcagctgcagtagctacattagctgtatttgacaggtactcagagatcaaagcacaaccagaggctgacctaccattcagcttaagaactaggggtacccagtaatctcccatgagcactcagctaggaaaagcaggcttgctggacttcaagatgctaaccagtaccaatggcccaagtggtaggaactgaaaggcgtgagccaaaggtcttgctctaaagggttcctgtcagtctggccttagggtgacattggccagaagaatgttacctcgaaccaacagaatgatcatgaaaagctacaagacaatcagaccaaaggcatctaaccacttcaaaatcctcccagcctccctgccagaccacccagcagcactgccgttatctgccagggctgagtgtttaccaataacgggaaccagctttgctgttttactgcaagctttataaggaaaaaacaagggctgggctcatgcagccgctggttgctgggacacaggagtccatttgctcaagcagtttaagccatggatcagccataataatttgaactactctgattattaaacaattttccttgccccacgcattctctgcaaatcctgtcttacacatgcacagccaggtcagcctgcctggctctgggcatgtatagagggggctgctgtgcatgtctagggttgctctgtcctcccgcccagctcaccgatgaggggcaccaccaggatgtacttcctgctctccagcagccgagacagactggccaggtggtcaatgaagccgttggtatctggtacgaggaacaagggtctgatctccagctccatctgcctcatctgactctggtcttccaaaacagcctacagggacacagaatatgagggagcaagagagtgagcaggcggatgagccaggcccctgactcaacagtgtgtaagcatcctgcccccatacatctcttccccctccagaggcacagccaccccttaggcctgagggacagaccttcaggctgagctaagcagtataatcaaaatccacacagaccaaatggcccaggcctgaagtctcactaaatgctagctgtcagtgagaaaggagactgatgatattaaaaacatgtttctgagaggatcataaaggtaagaagggaggaagtaactaggccaggaaaggagagtcacatattacaggcagcacttacagggtagttctcaatccgaacacttgaatactcagatcagagtcctccctccccctccctcctttcctccttatccctgtctaaaatgagacagggtctcataagctggcccagactcatacttggttctatgcagtactgagtatcaaatccagggcttcagtacgttagcactctacctacaaccctagaatttgtgattccaactcacttcattgtgcatttcaaccatccacctactccaatcctaatgaaattaacataaaatctgaattttaaaagtatatacacatggtagagtgttggaattaaagttccaacactcagaaagaggaaacactcatttctgtgagttccagactagccagaactacatagtgagatcctgtctttaaaaaaagaagaactgacaagattcgactcctacaaatatacatgtgcacacatacaatgtaaaaaacatttttaaaaactgggtattagcagaatgctacttatcattttctacagcagaaatccataaagaaggaagttatggcccagcccacagagaacaacaatcagatcatagctataccacctgtccttgctttgcacagcatttcctaaatgtagttatggctgtcctggaacttgatatgtacataggctggccttgaactcacagagatttgcctgccactaccttctgctgagattaaaggcataccacccccagcttttttgctctacttttaactctttaccacaagaactctgaacaagtaacactgtcctaccttcattttccctttggcatcagggctttttgtcttaggctcttcaggaaagtcctctaggatactaaggatttcataattgtgctgtatcccagtacaaactgaagtgccataatgaaaatttaaagcactccacctcatattattcaacagttaccccaattaccaccagcaggcctgtgtaccaacctctgtcagccccagaagcccacaagccagggactatctgtgttataggcttttccatttctgtggaattctgtg

SEQ ID NO: 308 - DNA, 3454 bp, Mus musculus
  misc_feature (1)...(3454): n = A,T,C or G
atgattacaagaatgcgccaccatccctggcttaagagttcctcatttgaagacagaaccttccccccccccccgaattggcgcgatataacatataaatatgtactcgggagcactcagcacaaaacccccaggtttatgggactcccaggtccgatatctgagtctccaggtgggcacatctggaagcgcgcgaacctgcaagatctgctcagctccgcatctgcaagcctcttggcccaggtgtgcgccagaggtcgcagcccagccgcacacagtccccgcgtggccgcgaggtggcgccatggccgcggcagcgtctgccggttcgggccgctccagataagagtgtgcggaaagcgcggaggggctgagacgcgaccaggacgcggggaggacggaccggcaagacagaccgaccgggggcccggcgggcggagggcagcgcactgcagccacgtccccccctggatccgccggcagccgggcccggggcttccgacatgccccccaggagagtgtgctgggcagatgatgctggacacgatggaggcgcctggccattcgaggcagctactgctgcagctcaacaatcagcgcaccaagggcttcttgtgcgacgtgatcatcgtggtgcagaatgccctcttccgcgcgcacaagaacgtgctggcggccagcagcgcctacctcaagtccctggtggtgcatgacaacctgctaaacctggaccatgacatggtgagcccggccgtgttccgcctggtgctggacttcatctacaccggccgcctgactgacagtgttgaggccgcagcagcagcagcggtggccccgggcgcggagccgagcctgggcgctgtgctggctgctgccagctacctgcagatccctgacctcgtggctctgtgcaagaagcgcctcaaacgccacggcaagtactgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcagccgtcaacacccactgcgctgagctatatgcttcaggcccgggcccagcagcctcactctgcgccccggagcgtcgctgctccccgctttgcggcctggatctgtccaagaagagcccgccaggttcctcggtccccgagcgaccgcttagtgagcgcgaactgcctccacgcccggatagccctcccggtgcggggcccgcagtctacaaggagccatcactcgccctgcccccgctgccgcctttgcccttccaaaagctggaggaggccgtaccgactccagacccgtttcgaggaagcggtggcagtccgggacccgagccccccggccgccccgacggctccagcctcctctaccgctggatgaagcacgagccaggcctgggtagttatggcgatgaactggtccgggatcgaggctccccgggtgagcgcctggaggagcgcggtggggatcctgccgcctcacccgggggccccccgctgggcctggtacccccgccacgctaccccgggagcctggacgggccaggcacaggagcagacggcgacgactataagagcagcagcgaggagaccggtagcagcgaagaccccagcccacccggcggccacctggagggctacccatgcccgcacttggcttatggtgagcctgagagctttggtgacaacctgtacgtgtgcatcccatgtggcaaaggcttccccagctcggaacagctgaatgcacacgtggaggctcacgtagaggaagaagaggcgttatatggcagggcagaggctgctgaggtggctgctggggccgccggccttgggcccccctttggtggcggtggggacaaggtcactggggcgccgggcggactaggagagctgctgcggccataccgctgcgcgtcctgcgacaagagctacaaggacccggccacgctgaggcagcacgagaagacacactggctgacaaggccctatccgtgtaccatctgcggaaagaagttcacgcaacgcggaaccatgacacgccatatgcgcagccacttgggcctgaagccctttgcgtgcgacgcgtgcggcatgcgcttcacccgccagtatcgcctcacggagcacatgcgcatccactctggagagaagccctacgagtgccaggtgtgcggtggcaagtttgctcaacagcgcaacctcatcagccatatgaagatgcacgctgtaggtggcgcggccggcgcggccggggcgctggctggcctggggggactacctggcgtccctggccctgacggcaagggcaagctcgacttccctgagggtgtctttgctgtggcccgcctcacagctgaacagctgagtctgaagcagcaggacaaggcagctgctgccgagctgctggcgcagaccacgcacttcctgcacgaccccaaggtggcgctggagagcctctacccgctggctaaattcactgctgagctaggactcagcccagacaaggcggcagaggtgctgagccagggtgcgcacttggccgcaggaccggacagccgaaccatcgaccgtttctctcccacctagagcgccgtccctcctaggtgcgcccggcgctgcctgacagcccggggataactggtagcagcggcagcgccgcagtggtggccccacctttctacacctcacctggcctcactgtttagtgccttagcctggggaagtcagtgggggaaaaccccgggtcgggggtgggataggggaagggagatttatatttttgatatcagctttgaccaaaggagaaccctgcctctccctgtggctcattggccctctcccccggctccgtgctgctcttgggggaaggatgccattattcggacggttgctcccagccctacctccggcccttgcgaccacacccattctcactgtgaatctccctgctggggtcggagcattgggcacagttggagagaggggaggggactgagccggccggagggcctccccgtcccctgctcctgcccagcccgggactgataatgtgaagttcctcattttgcacaagtggcactagccccagggccaacccttcctttcctcaccaccagggtgggcagctctggcgccagggatgacaaccctgacccatctgtctctgcttccgaggtgtcccctcctcttcctggggtccccggaccatatatttattgcatgcgccctaggtgacccctatcctgagcccaactttagctgggctggagagaggtctccttccttggttcccgttctgtccctttgtatattctctactctgtacacaggctcttccagagccgcttccattttctatactcaaccaaacagcaataaagcagtaaccaaggtcccta

SEQ ID NO: 309 - protein, 581 aa, Mus musculus
  VARIANT (1)...(581): Xaa = Any Amino Acid
PRGSVQEAPQTPRQVLPXXXXXXXXXXXXXXXXXXXXXXXXXXXXXXXXXXXXXXXAAVNTHCAELYASGPGPAASLCAPERRCSPLCGLDLSKKSPPGSSVPERPLSERELPPRPDSPPGAGPAVYKEPSLALPPLPPLPFQKLEEAVPTPDPFRGSGGSPGPEPPGRPDGSSLLYRWMKHEPGLGSYGDELVRDRGSPGERLEERGGDPAASPGGPPLGLVPPPRYPGSLDGPGTGADGDDYKSSSEETGSSEDPSPPGGHLEGYPCPHLAYGEPESFGDNLYVCIPCGKGFPSSEQLNAHVEAHVEEEEALYGRAEAAEVAAGAAGLGPPFGGGGDKVTGAPGGLGELLRPYRCASCDKSYKDPATLRQHEKTHWLTRPYPCTICGKKFTQRGTMTRHMRSHLGLKPFACDACGMRFTRQYRLTEHMRIHSGEKPYECQVCGGKFAQQRNLISHMKMHAVGGAAGAAGALAGLGGLPGVPGPDGKGKLDFPEGVFAVARLTAEQLSLKQQDKAAAAELLAQTTHFLHDPKVALESLYPLAKFTAELGLSPDKAAEVLSQGAHLAAGPDSRTIDRFSPT

SEQ ID NO: 310 - DNA, 21840 bp, Homo sapiens
  misc_feature (1)...(21840): n = A,T,C or G
ctcccaaagtgttgggattacaggtgtgagccactgcacccggccagaagagcatttattgagtaataactgtataccagacattgtaataagcaagagctttaatgcggcctaatttagggccaggtgcgattgctcatgcctataatcccagcactttgggaggctaaggcatgaggatcaattgagcccaggagttcagaaccagcctgggaaacatagtgagaccccctctctacaaataatttaaaagttagctgggtgtggtggcatgcacctgtggtcccagctactcgggaggctcaggtgggaggatcacttgagcccaggagttttgaggctgcagtaagctgtgattgtgccactgtattccagcctgggagacagagctagaccctgtctccaaaaaaaaagaaaaaaaaacaaactacaaaaattggctgggggtggtggcacacacctgtagtcctaactactcaggaggctgagacaggagaattgcttgaacctgggaggcggacgttgcagtgagccgagatcatgctactgcacttcagcctgggcaacagagcaagactccatctcagaagaaaaaaacaaataaaattatatatatataacacatatatattttatatatattaggcaataaatatatatagcttaaaccttacaacttcatgtttaatctcacaacttcatgaggtaggtaccattattattattattatttgagacggagtgtcactcagccacccaggctggagttcagtggcacgatcacggctcactgcacctccgtctcctgggttcaagtgattctagtgcctcagcctcccaagcagctggaattactggcaagcaccaccatggctggctaattttttgtgttattagtagagacggagtctgaccatattggccaggctggattattattaagacagggtctacctctgtcaccaggtgcaggatcatggctcactgcagcctcgacctcttcggctcaagtgaccctcccgcttcagcctcctgagtagcttagctgagactacaggtgccacctatcacactggcttttttttttttaagacatggggtctcactatgttgcccaggctggtctcgaatttctgggctcaagcagtcctccagcctctgccccgccccgcaaaatggtgtgattacaggcatgagccatgtctcccagccctaaataatgattttttttttttgagacagggtctcactctgtcatccaggctggagtacagtggtgcaatcacagctcactgcagcctcaacctcccagcctcaagcaatcctcccacctcaacttcccaagtagctgggactacaggtgtgcacaactaattttctttcttttctttcctttctactttcctttctttcttttttgtagagatgggagtcgcattgtattgcccaggctggtctcgaactcctgggctcaagagatcctcccacctatgcctcccaaagtgctgggattacaggcgtgagccactgtgccctgccctaaatgatttctaagatgctaaacaaccctgacgtacggtcaatcctctggttctttcccctctgaccacattctgacctcttctcagaatatcccaaccatttctgttttccacctctgattccaccttggattcctagagctcttaggagagagaacccccttagcaaggaacctctcaacagccccaggcccagagtgaacccgggaggcggaggttgcagtgagccgagatagtgccactgcactccagcctgggcgacagagcgagactgtctcagaagaaaaaaaataaaagtatatgtatgtataacatatatataatatagattatatatatattagacaataaatatatatagcctaaagctcaaggtgtaccccccacatcccgttcattctgcctaagtgcacagagctggggtcccctcccaacaccaccccttcacaaacatgtagtagcctaacagaatacttaagatcaaaataacattctgctgtttttggatttttacttacatgatcctatttaatcctcacagtgcacctgccgaggagaagagattattatcccgttttacagaaagctcagaaacagaatatggccccttaaccaccagttgctgataatgccaggttggacctctggcttcccagagcactacacccagcagtccactgcagtccacccactgacatcccctggaacccagaagcaagtgcgttttaatctgcaagacctcggggccctggggaggtgggatggctagcatgtgggtgttgattaactgggaaaccggcacgagtgtcttagaagtacttcacaaaggagccgggtggggagtgaaggagggggtggggcgtgagacgttaagaaaaattggattaacgtgtcgtgggctgggttgcattaaccattcccaacactatctctggggaagtctcacacctgatattcaatagacatcccctgtagtgggtgatgttggcagaggcaggcgacatatacaataatatttttagagatccttgttcacacttcatccgcaccagaggacttcagcccctgtggtattcactcctctttagggctaatttgagaaactgtctcagattggaatccagcacctagagataggctgaggtgagcaggctgatctgttcagacgcttcgcggaccaggttaactttacaagctcattggcttccagagggttggggacccttcttatcctcctagctcagagggaaagattcaagagtttactcttcgcccaatgcccacttcagctaggggttcctggaagaacggggctgtggagtatctcagaaaactttcctccctctactgtcttcaggccccaggagacaaacctccttccaagcctcctggtcccagtggcttccctctcaccgaaatcgaaagaacccgagtcccagcccgaccccttctctcgccgagccctggctgggataccttggccgggaggacaggacggcctcaggctggccgccagacgcactccgcaggccgcgcgcgctcgagcctcggtggactcagccgccggccccgggaggccgcctccctgcgcagcacctcctgccacccgcgcgggcacgtgggatcttgactcgccgcccccgcctccttctgctccgcgtccccagcccgcggctcggggcgcggcgtggcgcggcgcgtgggcgtgctgcggggcgaccatggctgtagactgttacctccagttcccacagtaacaatcgaaagccacggttgccctggagacgcgggggcggggcgcgcggacggcgccggcgcggggcgggctgacgtcagggccgcgggggggcgggcggggcggcgggggctgaggagcgcgcgtgggccaccgcccctcgcagcccctagggacccggacggggcggcccgatggcggcgcctgcgttgatcagcaccgcggacagcggcggcgcaggcagcgggccgggggcggggccctgagggacggggactgggggtccccgggcgcggcggcggcggccggggccgcggtcctggggcggggccaggcgtcggtggccgtgactggagactgttactgagggcggcccgggcagtaagcagtctagagccaaggtgccggcgcgctgtccgggcggggtgccccggtcgccccggctgccccggctgggggctctgctgctccgcctcccctgcgtctcccgccctgccccgcccggcgctcgcgaccaggcacgcggcccctgacgtcagagggccgtgacgtcaaagatgtcccagagggggcacttccggcgggggcgtgggggcggggcgggacctggcgaggcccgcccccccggtcctgagaggacagctccgctcgcagaggcgggaagccgtgggcgccgcgggacccgctggacgggacctgccgggaaggggcgcccgacgccatgcggggcgggggtcccaggagggccggggaagcgggggtgggcgtccgtctctcgcctgcacccccgctcagccggcccgggcagcgaggctgagtcaccgcgccgcagggagggagaggagggggcgcgtctcctggggcgccagcaccttcgcctcactttcctgggagaatggcgcaggagccccaagaaagccgggggggggtctccgaggtcggtcctccactcgatgctcctccgaagtagctgcgtgtccatcgggcgccggcaggtgctgcgcgggctcgtgtcgtctctggccccggctccgcagccgcgaggggaccccggtgccccccgtccgcccccatccccaccccggaggggccgccccacccgccgcctgcccgtcccctcctcgtcctcccgtccgtgtccgcacatctgtccctccgcggctggtccgtcccgcttacctggcgggccgcgtcgccactgcccggtcgcctcccgcagcctggccggcgcggcggcttttataggcgcgcgtagtactcgtgcggcggctcattcatgcggccgcggctcctacacactgacgcgctgccgacgtcagcggggaatttaggaaatgggaaaaggggctatttatagtggcgaggcggggggtggggaccgaggcgaccgggaggggaggagggggcgcggaagcggcggcggggtagggggagccgcgcccctgcccagccgacaaggggttaactttccggaaccgcgggcctggggccggggaggcggcgcggaggggcgcggcgggcccttcgagcttattcacgctctccttccggagccccgcggctcctgggggtcttcacgtggcagccccttccccctcctcagttcctggacctgacgtttctgccgtcacaccccgcaaggccactgcggtgtcgccaccctctcgtcctgcagggtgggcaggagaggaagctggactcccgtgggggcctggggcgcagcgagggctgtggcgtcgggggccgggagaagaagagtaggggagcccaaagtagcccaggagtctttagcggaggaacctgggcctgggagggaaggcccagcggggattcaggtaccacccaggagctggagacccgagggacggcagagaagttggggaaggtgggccaacctccccagaaatgatgagcaacgggatcctctatgagggagctgggggaacgcgccagaggtaggggtgagaggaatgggcagcctcagcaagggagagaggaaaggctgtcagtgccacgctccagagcctggcatccaggacccaccttcggaccatttgtggcacgatggacgctcccagagctcacgttagggtaatagagagtgaaggagaccagcagcttggccaagaggggcccccaggggatgaggaggacggtttcctggagaagttaatgttcccggagaccagaattggcagggagagcccatgacttgtggggcagttcccctggttgggagcggggaaatgcatggtcctggcccagcctggctccatcgagatggaggaagggtctaaatgagaggagtgtgttcagacgaggagctggaccaggatggggagggctgtgcaaggcatggccggaagagcggggcagggagagaaaggtcgaagagtgaagtgcacaggagggcaaggcggtcctcaccctgcctgggctggggcagggctgtgagaccctcccttacagaagcaatgagggcttgaggagggggttaggggcctgggctggggcagggctgtgagaccctcccttacagaagcaatgagggcttgaggatggggttaggggcagtaagttaacttggggagcggatgtgggggaacgctgaagaataaagactgtgggcacagcagacccctggggcaggttagcaatgcacagactccactgcacaagatacatggggcggaggggctctttggaagtcgggggtgggggatctgactctatcaaaaagagaaaagataaaagagatggggtcagagaggccctgcatagtctggatttggcctactagagctccagttttcttgccgctagcctttgttccagggattctgttattcacaaatgccttcctgctcggtagaagaactcctattcatccgtcaaagcccagctctaggagcacttatgaggagcctctccacctcccctcaacactccgtaacttccacctcaggccgcagcacgtccctcgggcgagatgtcggggtccgccttccctagagaccggcagctccggaggcctccgttttcctctttgggacctcactgcttctaaagtgaggatgctatggggagacatgggagagggagtgggtaagatggatccagaacatggggcggactcaggcagcggcgggaatcaggcggactcgtttggaccgaagcctccgccaggcaccgaagccgtgaagtcgcctgcgcagcaaagggagcctccggggggcgcccgagaccttggtgtcgctcgggggccgctggtagccgcgcccgctgcccctcgcccggtgactcagccggtacctctggcggggccatgggggccagaggacagcgcggggggcggcgagcgcggttgctaagctctccaaggcctcggagggacaggatctgggcgcacctcaccggttgccatggtaacgcagcgccccagcccctcgcgctccgcgtggagggaggcgcacaatcggaagcggcggagttctcggggacccccccccccccgctccacgccgtgtgtgggcgggggtcaggaggtgcggggcggaggcggacgttgggccgcggagatccggcgttcgcaggaggcttggtgcgcggcggggctgcacggggccacttccggagtagtactgcgagcacggcgcaccagtgcggggtccctttctcccagagagacgtcaccacacaaactgaccttacgtggggcgcgggactttgcgggtacagcgcagtctcctgttgtttccttcgggcggttgggtggagagaaatcacgcgggattctcaaaacgcgtacagggggatctaaggcccatggttactctttgaaccccggagggctgtccagcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctggcccggggcgtgagcgagcctggggccgtgctggccgccgcagctacctgcagatccccgacctcgtggcgctgtgcaagaaacgcctcaagcgccacggcaagtactgccacctgcggggcggcggcggcggcggcgagcggctacgcgccctatggtcggccgggcgaggcctgcgggcgccacgccggtcatccaggcctgctacccgtccccagtcgggcctccgccgccgcctgccgcggaccgccctcgggcccagaggccgcggtcaacacgcactgcgccgagctgtacgcgtccggaaccggcccggccgccgcactctgtgcctcggagcgccgctgctcccctctttgtggcctggacctgtccaagaagagaccgccggtcctgcggcgccagaagggccgtggctagagcgcgactgcccccgcgcccggacagccctcccagcgccggccccgcgcgctacaaggagccgcctctcgccctgccgtcgctgccgccgctgcccttccagaagctggaggaggccgcaccgccttccgacccatttcgcggcggcaggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccacctgggcctcaagcccttcgcgtgcgacgcgtgcggcatgcggttcacgcgccagtaccgcctcacggagcacatgcgcatccactcgggcgagaagccctacgagtgccaggtgtgcggcggcaagttcgcacagcaacgcaacctcatcagccacatgaagatgcacgccgtggggggcgcggccggcgcggccggggcgctggcgggcttgggggggctccccggcgtccccggccccgacggcaagggcaagctcgacttccccgagggcgtctttgctgtggctcgcctcacggccgagcagctgagcctgaagcagcaggacaaggcggccgcggccgagctgctggcgcagaccacgcacttcctgcacgaccccaaggtggcgctggagagcctctacccgctggccaagttcacggccgagctgggcctcagccccgacaaggcggccgaggtgctgagccagggcgctcacctggcggccgggcccgacggccggaccatcgaccgtttctctcccacctagagcgcccctcgccagcccgctctgtcgctgctgcgcggccctggcccgcaccccagggagcggcgggggcggcgcgcagggcccactgtgcccgggacaaccgcagcgtcgccacagtggcggctccacctctcggcggcctcacctggcctcactgcttcgtgccttagctcgggggtcgggggagaaccccgggacgggggtgggatggggtaagggaaatttatatttttgatatcagctttgaccaaaggagaccccaggcccctcccgcctcttcctgtggttcgtcggccccctcccccggctccgcgctgctcttagagggggaggggtgtcactgtcggggcactcctagccctacctccggcccttgcgaccacacccattctcactgtgaatctccccgctggggtcggagcgtcgggcagagttggggagtggggaggggactgagccggccggagggccccccgcacccccgctcccacccaccccgggactgataatgtgaagttcctcattttgcacaagtggcactagccccagggccaacccttccttcctcagtcaccaagggcggggagttctggagtcggaaggcgaagagcctaccaccaggtctcccactcccgcggtgccctcccttcccttccctgcggccccggaccatatttattgcatgcgccccggcggccccccatcccgagcccaggctgggctgggctggaacgcggtctctttagctccctcctcttcgtttgtatatttcctaccttgtacacaggctcttccagagccgcttccattttctatactcgaaccaaacagcaataaagcagtaaccaaggaccccgaccccgctgctctcttctgcccctgcacaaggacctggatgggctgcgcccgctgggtggaggagccagaaagggccaccctcacacaggtgcagaggcttggacctgcctccctccccagtcccagaaacagatcagcaagaggtcaggtatgtttcataactaaaaatttattaaggaaacaaaaccagtgctgcaaacgggacagaaaggagagctgggtctccctcccgaccacccagtcatcggccttccagctggggagagaatcttaaaggagaggccggggaccctgtactccaaagagcccagtcttctgagactctaggggactcctacccccaaactactggccttggctcccctacacggtaccccatcgcttctggcatagtcctgggcctcagggagggcagagctgcgcacccatcctccaggcaggctgtgcagtcaggccatgggctctggggtatcccccactggtcccattaagatttgcccctggctccaccgaaaaccccgtcttcccctaagttgtccttgtctctggccctgggtttcaggaactcattcttggtaaggaagcctccccactgaggtaccagctaaaggggcaaggaaagggcccctgtgtcagtgtcagtttttccggggagtgagggcaaagctagaaaccaggttaggcgacggtgccccagcactggaatgcctcaggctgggctgtccacgcctggaagtttctcccagcacaggagccgagggtggaaggccctgggtgggagacctgtactaggttcctgccatgggtagtagagagggaaagttcagagtgagaacccctatgacgaggaaccgcggtgaagaaatgaaggggatcagggaggtgaaaaggatcaactagaaggggaagaagggtgaggggctattctggagggagggtaggcgggcaaggaggggtgaagggggagctgaggagagtcaggacatttcctgaagaggaagctagacggaaagaaaggccagtgaggagaaagggagcaggtggaggccacccgagagcacgggcctgagaccagatgcccctttcctctagactcatgactgtccacggggacgcaactggcgaagtgtgagggacccaggttgataagggcaggaagaggagcagcaggaagggtgtgtggtaagtctggggtggatggtagaagaggtgggggcccagggctgctgttagggacatgctgtctagaagccgacttgggttcatgggcgagtccaggcctcagggagactggggacacacaccctgggcacttcttcctgacttaaccaaagcctcttgaacacattcacgacagaggttctgaagatgaaagggaactgtgatttcactgcatctgacggaaactctgaacccctgccctgtctccactggagaaagtggctgcgtccccaggcgagaaggccctccctcagccttggaatgagacgggggagggagaaaggctgagagcatgggcggcctatctggcttgcccagctgctgttgctgtagccagccacctccctgctaaatcctggcagcccaggagggtcccagcagcttccgcccgatccttgggaggggctctgtgaggagcaggtcccccacagcatggccgtggcgtgggttggaagaggatggtttattgtctgggtggattggtggctcaggcacgtgggcatcttccgtgctacactgggcgcctggtggcctttcaggaacggttccacgggggggggggccccagtgtggctccctcagcccacctgggcccacgtgaggaaggctgggatgtcccgtacaggaacattccttgtgagcgccttcacacgcaggttccggtcatccgtcaacagcaccacctcccgcagtagccggattggctcctctgtgggcatgagagagcagaaggctgtcactgaggacaggaggcagagggctggctgctcttctcaccctggagaatgtggtcctggggagggggtgccacgctagccgtgtcttggctcttctaccagtcctttcctccgtccgggctctcagccccggggacccttccctgctggcttagagagggctgcactgggcttctgccttgactccggcctcccatacaggactctcttctgcctagttcccaaaagctgcccaaacccgtcagcctcccaggaccctaaactgagggaatagaagcagccccttgacctctactcctttttaccacatggctggcccccagatcacaacaccgctctccccacaccccacttttttttttttaacaagtcctctccctctaaaagccagcaggttgaagctttacgcatccagaggcagaaaactaaagatggaacagaaaatgtatccagggttttccagatgtggggagaggggttaagggagccctgaggagaggagagggtaagggtcttggcagaattgtgccaagggcacaccaaggctttggccaaccggtcgcccctgctaagtaacagtaatccatgtatacaggcaaaagtctctaagaggacagaagagtaaaaaggaagagtagagttaagatgatgatcccagttctccgtcttgtaccccagggaagacctgtgtatccttccaggtttctttaggcacatttacaagtacatacacttggacatataacctttttttcctacagcatcatgatcatattagccacactttcagagtatatacttaaaaggtcttgctatagtggcacagatatctttcattctttttagatgactttttttttttttaagcacagtctctccactacctctctttccctaactccctaatctttaacacattggagagaatttaagccagggacaagcactcacacaagtgacatccctaccctgacaggcctgcttgggtggcaggtctactcgtcagtcccaggctgggcatttcctgacagaggtccaggtccggcagacagcaaggcacaggaagtgtcctgctgtgctcactgactgcgtgggctggcgggggtggggggctgcaaatatccatgtcggacctgagcagtctcaggcttgccagctccaggcagggaggctgagaactggctttcagcctggggaggagtttggaggattcgggagggagaggtttgtggggttggtggtggcgagagaagaggacaggaggaaggagagtgtgaagggaggcaaggggctgtgggcagaggggaaaggaaggtggcctcgggtgaggggatactcagagactactcagctgcctgggccaggcccctctgcagataagtgtggctggggtggtggtatgcagggctgtgtggggctcccagctgactggctgcgtctgtagcagccccactattcctgccctgggcctcaaaccaggagcgtcccaggccttaggtcagctaaccaaggcccgacattgctggcaggggtctgcaggggtttctgtggatactttgacatttttcacaataaacatcctctgttttgacactggtaacttcactttgttagaaaccagagactgtcatcttgtcaggccccatccgccataatccacatgattttaaaattcaacatcgtttacacataaacatttagtgacggtttctctgtgaatctgacaagttaatctgctaagaattcacactgacaaatgggctttgattacaccagccattgctgatgtcattctgataggggcggtcccccggatggcaatgggttcctgtaggctgtttggggtgaagtcgggggtgggaggactagtaggaccaaagccaaaatgtgtccgttctgagaaagaaagttctgaggctggggtggggcccagcagtcctggaaccacacttcccaacaaggccttcagcaatcccgcctacctttctctcaggaggtacccctctaggaagctcaggcttgccagctccaggcagggaggctgagaactggctttcagcctggggaggagtttggaggatttgggagggagaggcttgtggggttggtggtggcgagagaagacgacaggaggaaggagagtgtgaagggaggcaaggggctgtggtgggcagaggggagaagaaggtggcctcgggtgaggggatactcagagactactgagctgccggggacagaacataacctcctctgtttggctcagccaggtctccttttatcactttaatgctcatatctggtcccaagggatatggcatgcaaacctggtggcaggacaggacctctcttgagtagcggctgtgggctcgtaaccagcccctagtaaagagactcatgcaggagtgaggggctgtgtctgtatggggagaggacgcaggagagagtcaactcccagagcagcctgaacacaagggctagaaagaaacacgcacagaaaggagagagcagcagagacggaaaggcaatgacaagagaccacttataggtagacagaaatgaaacggtgagaactgccagctctgcagatgacacagagctggcaggtcctaggaattccttccaaatgaaaaaaatgccagaatcctgggagccaggagcagaaaaccctagtgtcactgacctgtggggtgaggcatgaaggccagctcagggttgagggtgaggtggtcaagcgcttgggtgagaaacccagagtgggcctttggcccaaagatgagattctgcttaccccaaaaggtcttgaaaaccgggctgagggctcagtcctcaagctctcaccaacctcaaactctagccagccttcaaagtgctacagcttgtgaccaaagagaccaggaagcaaagcccactattcactggggaaatgcctctgccccaggcctgaaatagggtaaacactcaggggtgaacagagaaggtaggaaggtaagcatggccaagaaagggaagtgtgccccagggacccctggggggctgccctcagagctgcagagggctgggctcgggagaccatggccagcaccagctacagtgaatcataaagacattcttgctgtcagacggaactcactgaggacacccaagaaaggaaacggatgcatgcggggtgaagaacctcgcggcctagggctgggcttcctgggctaggctcatctctagttggcccagggtgcacctggcattccctggggctgggggagccaggacagggaggttgggcctcaggcatacatcagccctgagcactgattccttagacttcccaggccagagtcagtggagcccttctcaggggctgaggatgggtaggatgaggtagggcagtggggatggaagatcccaaggcggaggcaaagctgtacctttgctggcgggcatgaagtccttagccttgtctttgcagtagtggaggcagcaggacaggatgagatcatcgttgttaccctggaggaagacgtgtgtgagaagcaccactgggcagaagggggcgccatgtggaggaggaggagggatcctctgcctcgggggccctgggcagggccacctccccgatccctcccatgcatgcgctggccctgcctggcctgatctgactgtgctacgagtgacttaggggagaaggaactcccccacctgggcctccatggtggctggccctcagctgcccaggctgatgggcctccttcagcccttccttcctggagaccttgttctggaagctggctgtgggctttcccttcctgccacagggtctcaccagctggccagtgatgtcctcactgcggaaggcgatggattcgagttcattgccacggctggtcagggctcgcaggcaagagtcccgactctcgaatcgctgctcgaggaactcgatggacttgcgggccttctcttgtaccacacgggcgtagcccccagcccggtggtctgtctcctgccccttggccaggccgtccagctcattgatcactgatgagacagagccccacaaggtatcagcctcagcaatcagctttcatcctaggcctctgtccattcactttcccagccaacaccttcccagaccagaatccatccttcccccacaggagtcttccaatgaaactagggccggaggggagcttgtgggggcaagaagtgtctcgagatttcacagggctctactccctttctgtctcttctcctgggccctgccctcctcttgggaggaacttaaaggaatcttctggagctgctgtatttagaggaagaaatctggtccctctattgcattccttggttacaggactcacgtgaaagggtccctcaggagagtccagggtatgcagcagctcgagggaaagggaggcgtccttccttaactccttgggcccacacacactgcagtccaggaggggtaaagttctacccccagccccactggtggagtgcagggaggtcaccatggaggaaggggcagtcacagcctcatttgcaaggccctggtatttctcaagaccagaaccttggcacatctaccttctctgatactgcacgtgtgtgtgtgcgcgcacgtgtatgtctgtgtgcgtgtatgtgtctgtgtgcgtgtgtacatgtatgtgtgtgtgtacatgtgtgtatgtgtatgcgtgtatgtgtgtacatgtgtgtatatgtctctgtgtgtgtgtgtgtgtgtgcctgtctgcctccctatgtgtctgggacatggcttcattttctggtgaagattctttccaaaattccagccaaaagcctgaggtcaagtgggaaatatgtgctcctcgggggctctgggagagtttggggtctgaggcctctccttagcgcagtgattcatggctcagggagccggcgtgagcatgctgttccatggtgagcctggcactcattgtctgggtattcggagacactttctggaaagggcccatgtgggaatacacacacacacacacacacacacacacacacacacacacacacacacacaatgcccatgctttcggcaccctgaggctgcagtgtccacacagtgcatggctgaggttgggaagcagtggtagatgggtgtatggtacagcaaacaacatcaaacaggaaaaacgggtattctatcccaaaatctgctttcctgcttccaaactaaacaggcttcaaagaggaagcttgtttgtgcttctgcaccaggcggggcttctccacgctggggtcaggtctgcggagcacagagcaggttaaagagcaccagaaacaagaagggaaagctggcggcttaaccctttgctgctctgggcacaggacgtgagtctaccaaggaaagcatcagtaaacaggagccctcctcttacagcctctgggagagtccaggagcctgcccagctgaggcaggtccagagaggctggcctgtatggctgtagcacaactgtcagttcccagcacccttaggcgtcgtctctttgtcctgcatgtatctgctgggttttctcatgcgtttgctccctccccaccgaatccggatttccttactaaaccctaagctcctcagggccaagggctacagcctgcctttcaccggatcaagaacaaggagactcagcccacagcctggggtacgatcagtcctggtgacaaaaaaccctggcagcctgggacggcgtctgaggcaccttacggctcttagggggctcctgagatgtccacagcctctttcagttgtaccctttcctgaccatctagcaaaacactttctttcccctgaaaagctcctgggtaggaaagcagagagacatatgacccggcaaggcagcccgccccagcgaggagaagggaaagcctgggacaacgtgatggttctgctgccctgccttggtgacagaaactgttctactgttgaagagcagaaagccttcccttaggtctaagggcctggatttaagaggttctggccaggccacatggggaggggaaggaagacggggagggtggaggcagggaggagggctgcttcggtgccaacattctcaggtggtgctaacgtgtttcccacaaccccccagggttctgcagcctctgcaggggcggatgtttcctgccctttgtttccacccccatctggcactaagacacttgggactgggagggaaggcccaatggaacatcttggcatggatgtcaaaggtggcttggcaggcagactgccagtctggtggcttttccagaagacaaggctctcaaacttgctccaagtagctgctgagaaggggatgtgcaaacgcctgggcctcccaatcatctcctagactctctccctccacagaggccatcagctagatatgagcccagagcccagagcccaccctgaggctgacccaccacagagctccaagaactaagggtacccagacggtcccgtggagacggcccagctgggcctctctggctagagggtgggaaagcaagctagctgggtcctgagatgctgaccctgcaccagcaccaaggcccagacagtggtaagggcccaagtggtaggaatccacaggcatgagccaagggcttgctctggagggttcctgctggcctagccttagggtgacactggccagaagaatgctacctcgaaccaacagagtgatcatgaaaagctacaagacaatcagaccaaaggcatctaaccacttcaaaatcctcccagcctccctgccagaccacccagcagcactgccgttatctgccagggctgagtgtttaccaataacgggaaccagctttgctgttttactgcaagctttataaggataaaaacaagggctgggctcatgcagcctctggttgctgggacacaggagtccatttgctcaagcagtttaagccatggatcagccatgagaatgtgaactactttgattattaaacagttttctttgccccacgcgttccctactcccctgcaaatcccatcttacacacgcacagcagggctctgcctgcctggcccccaggccgtggggcgtgtgtggagggggctgctgtgcacatgcaaggccgctctgcccttcccgcctgactcaccgatgaggggcaccaccaggatgtacttcctgctctccagcagccgcgc

SEQ ID NO: 311 - DNA, 1840 bp, Homo sapiens
tggcccggggcgtgagcgagcctggggccgtgctggccgccgcagctacctgcagatccccgacctcgtggcgctgtgcaagaaacgcctcaagcgccacggcaagtactgccacctgcggggcggcggcggcggcggcgagcggctacgcgccctatggtcggccgggcgaggcctgcgggcgccacgccggtcatccaggcctgctacccgtccccagtcgggcctccgccgccgcctgccgcggaccgccctcgggcccagaggccgcggtcaacacgcactgcgccgagctgtacgcgtccggaaccggcccggccgccgcactctgtgcctcggagcgccgctgctcccctctttgtggcctggacctgtccaagaagagaccgccggtcctgcggcgccagaagggccgtggctagagcgcgactgcccccgcgcccggacagccctcccagcgccggccccgcgcgctacaaggagccgcctctcgccctgccgtcgctgccgccgctgcccttccagaagctggaggaggccgcaccgccttccgacccatttcgcggcggcaggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccacctgggcctcaagcccttcgcgtgcgacgcgtgcggcatgcggttcacgcgccagtaccgcctcacggagcacatgcgcatccactcgggcgagaagccctacgagtgccaggtgtgcggcggcaagttcgcacagcaacgcaacctcatcagccacatgaagatgcacgccgtggggggcgcggccggcgcggccggggcgctggcgggcttgggggggctccccggcgtccccggccccgacggcaagggcaagctcgacttccccgagggcgtctttgctgtggctcgcctcacggccgagcagctgagcctgaagcagcaggacaaggcggccgcggccgagctgctggcgcagaccacgcacttcctgcacgaccccaaggtggcgctggagagcctctacccgctggccaagttcacggccgagctgggcctcagccccgacaaggcggccgaggtgctgagccagggcgctcacctggcggccgggcccgacggccggaccatcgaccgtttctctcccacctag

SEQ ID NO: 312 - protein, 612 aa, Homo sapiens
GPGRERAWGRAGRRSYLQIPDLVALCKKRLKRHGKYCHLRGGGGGGERLRALWSAGRGLRAPRRSSRPATRPQSGLRRRLPRTALGPRGRGQHALRRAVRVRNRPGRRTLCLGAPLLPSLWPGPVQEETAGPAAPEGPWLERDCPRARTALPAPAPRATRSRLSPCRRCRRCPSRSWRRPHRLPTHFAAAGSPGPEPPGRPDGPSLLYRWMKHEPGLGSYGDELGRERGSPSERCEERGGDAAVSPGGPPLGLAPPPRYPGSLDGPGAGGDGDDYKSSSEETGSSEDPSPPGGHLEGYPCPHLAYGEPESFGDNLYVCIPCGKGFPSSEQLNAHVEAHVEEEEALYGRAEAAEVAAGAAGLGPPFGGGGDKVAGAPGGLGELLRPYRCASCDKSYKDPATLRQHEKTHWLTRPYPCTICGKKFTQRGTMTRHMRSHLGLKPFACDACGMRFTRQYRLTEHMRIHSGEKPYECQVCGGKFAQQRNLISHMKMHAVGGAAGAAGALAGLGGLPGVPGPDGKGKLDFPEGVFAVARLTAEQLSLKQQDKAAAAELLAQTTHFLHDPKVALESLYPLAKFTAELGLSPDKAAEVLSQGAHLAAGPDGRTIDRFSPT

SEQ ID NO: 313 - DNA, 23576 bp, Mus musculus
  misc_feature (1)...(23576): n = A,T,C or G
cgtgtgggaagacacataatgcttggaagaagtataaataagactcaaaggacagtgactgcaggcatgcataactagctttatgacacttcttggtctccagtctttgtgccttcctctccgctgatcttcccttctttgagagaggcatgacagagaatttctggcatctcttctggtcctggttgttcctgctgacttgtagagctttggtggagacttggctgtttctgctggctagtgccactgctgctggtgtgtgtgtggtgtctactgagtggactgggctgagaacagcaaagattggaatcgccccaaagagctatttctaaacgggtccacttcctctgtatcctaataacctttcttttccactacctctggtagtagtgggctaggagggaggttgaagcatttaggaaccattaaggctgggcgtggtggcactggggaagcagaggcaggaggatttctgagtttgaggccagcctggtctacaaagtgagttccaggacagccagagaaaccctgtctcgaaaaaccaaaaagaaaaagacattattaaaagtagggtttggggctggagagatgcctcagcagctaagagcacttccagctaagactgctctttcagaggtcctgagttcaattctcagcaaccacatggtagctcacaaccatctgtaatgggatctgatgccctcttctaaagagaatgacagtgtactcaaatatataaaataaataaatgctttgcctgccacaccatcccagagccagtgttttaatttctgatatgtctctgtgcagttctggctggccttgaccttgtgcgtccctcagcctccttcagagcactgacattttgggtgtgtactgctatgtctgactacaacagtgaaatttccttttacagcacgtcccagggtaggtgggcagcattgtgaagagagggcaggacatgcttcatggagacaaaggggagctgagtcatattctaccaaatgtggtctggtgtccctggtcatccgcacccccaaacaccccctcccatttctttcactccctgtgggtttctcccaggcggagcttggctttctggcttagctttctggctcagcaagctgtggctcctcccagccctgagttagagggctctggagggatttacagggttgaaagaaatccccaggttccaagcttaatggtgtacctttaatcctggctttacctagacagaggcaggtcggtttctgtgggcttgagggccagcctggtctacatattgaaaccctgtctcaaaacaaaagagaagtcaccaggaaaaggaagtgtctgctttaatggcctttggatctgaagcaatccaacagcagatccaaacagccctgggcaagcctggggacatggctggaagtcttgggcagtggtggcagagctgtacagagcccaggaggattctggttttttgtttgtttgtttgtttgtttgtttgtttttgtttgtttttatttccgagacagggtttctctgtatagccttggctgtcctagaactcactttgtagaccaggctggccttgaactcagaaatctgcctgtccttgcctcctgagtgctggaattaaaagcatgtgccactaccacccggctaggattctggttttgtagtagcagtttatctctgcagagcagatatggggacagcaggggacatggagacagacagggacatggaggcagacagagggacatggagacagacagaggtacatggaaatagacagagggacatagggacatggagacagacagggacatggagatagacagagagacatggagacagacagagggacatggggacctacagggacattgagacagtcagggaaatggaggcacacagagggacagggagagggacagggaggcagacagagggacatggagacagcagctatcaccacccagttttttttttaatttaatttaagttttttgttttgtttttcaagacagggctttttggtgtagctctagctgtcctggaactctgtagaccaggctagtctcaaagtcagagctccacctgcctctgcctttgaagtgctgggattaaaggggtatgccactggctgaaataacctttttttaaaaatctttaattttgatttaatgcagtatttatttatttatttggttttcgagacagggtttctctgtttagccctggctgtcctggaattcactctgtagaccaggctggccttgaactcagaaatctgcctgcctctgcctcttgagtgctgggattaaaggagtgggccacctcatccggctgcagtatttatttttaaattttattatatttattcatttagtgttcctggggatgtggcattaagaaactccatggagtctgtgttcttttctggcaagtggctcccatgaactgatatcggggctgatgtctctccctcttcacactaaggtagctctcatctcactggtctccgttgttactctatttgtttgtacctgtgtatttatttatgtcgttatgtaatgtgcatgtgtgtggatgtacacatggaagccagagggcatctgtgggggctgctggttctctcctcccatctctggtgagcctggaaatcaggtgacttagtccacaggtgtgtgcacagtggttggttggttggtttcccccactgaaccatctcactggcccagagtgtgacttttttttaaattattattatatgtaagtacactgtagcttcagacactccagaagagggcatcagcttttgttacggatggttgtgagtcaccatgtggttgctgggatttgaactcaggacctttggaagagtagtcagtgttcttatccactgagccatctctccagcccgagtgtgactttttatttcttttgtatgtgtctgcaggcatgccatggtgtggcaatcagagaacagcctgcagtagtcagtttttcttttgtgtgggtcttagggattgaactcaggagtgcaggcttgttggcaggtgccatcttgcttgcccatgccattttcacagagtgttacatataaatgtgggtgtggtgtggagctgagtgcctggaatcacagccttcaagaggccagccttgactgcagagagactttgtctataaaaacaagcaagagccaggcagtggtagggcacccctttaatcccagagctggggaggtggaggcaagtggcttctgggaattggaggccaaccaaggctacatagtgagactctgtctcaaatagataatggatggttggatgattagatagagaaatagattgatagataatggatacttatatagatagacaatggaccgatggctagatagataagtggatacttgaacaaaacttactggagatgaggttcagttgctagactcctagtgtagtataaagccctgggccagagactcctgttgtcccagtaattgggaggctgaggcaggcagatcagaagttcaacacagctacccctccgtatgtgttcagagcaagcccatttgggctatatgagactcttgtctcaaaagaggttgggaatggggtaggggagaaaggaatgagaatgtagtctgcagaatgtggtgatggccacccctcacttcagtaatccagtggcggacttcaagagttcaatactaccctaggccacctgagatggtgtcctctcccgctggaaaaacaacttgactcaacctcacacggtagctcatgtctgtcagtctaacactatggtggttggggtaggaggattgtggcgtgagagggcctaggctgaactgttatgccctgagtctgtgggaaacccagatgagcccaaaatttgtgaagtctgctgcaatttgcaaaagtcttttttattatcgttttgagtctagactcagattgcaagcctccactggcatgtgataatgagcccagaaagcattgagtttatttatttatttatattttattatttatttgtttattttggtttttcgagacagggtttccctgtatagttttggctgtcctggaactcactttctagaccaggttggcctcgaactaaacaatctgcctgcctctgcctcctgagtgctgggattaaaggtgtgtgccaccacgcctggctttatttatttatttttattagatattttctttatttacatttcaaatgctatccccaatgtccccctatagctcccctgccctgctccctaacccacccactcctgcttcctggccctgttattcccctgtacttggtctttgcaagaccaagggcctctcctcccattgatagctggctaggctatcctctgctacatatgcagctagagacacgagctctggggggtactggttagttcatatttttgttcctcctatagggttgcagacccctttagctctttgggtactttctctagctccctcattaggggccctgtgttccatgcaatagatgactgtaaccatccacttaaacattgagtttatatacagtgcagtatgcttgaattccttgaatgcttagggtgaggaggcagggataggcagcaggtagtaactcaaccaggataccttttggtgggaagggacttaagctgggagggggattaaggagtgtcttttgtggggttatcaggaactaatttttttaaaaattttttttagatttatttatttattatatgtaagtacactgtagctgtcttcagacactccagaagagggagtcagatctcgctacggatggttgtgagccaccatgtggttgctgggatttgaactctggaccttcggaagagcagtcgggtactcttacccactgagcacccggaactaatttttttatgtccagccataactgtctgtgacctccgattaacttttctatatgatttaaacctggacccttaatcttgaatttgttacttttttgttttgtttcttttttctttcctttctttcctgttttgattttcgagacaaagtttctctgtgcagtcctggctgtcttgaaactcactctgtagaccaggctggcctcgaatttagaaatctgcctgcctctacctcccaagtgctgggatgaaaggtgtatgtgccactgggctgagtttgttaaggtcccaaggacaggtatctgaatagttcactcatttatcagagggagagctagtttttgtgacgcagaggcagggaggctgtctcaagttagcatatggctcctcggggtgttttcattaaggggggggggggtttatgagcagtgccattctaatgccaggctgggtttcctcagagcggccagggagggaatgcagcacagaaaccagctgcctacacagctggtcggaagggcgggaagatgggagttttgcagcgcgggtgggggnnnnnnnnnnnnnnnnnnnnnnnnnnnnnnnnnnnnnnnnnnnnnnnnnnnnnnnnnnnnnnnnnnnnnnnnnnnncccccccccccaaaaaaaaaccccaaaaatacaaaaaaacaaaaaacctagtcggggatgctggaggaatggctcaatggttgagagcatgtacagtaggtgggtgcaattcaaggtgcatgcctttaatcccagcatttggtagaggtaggcagatctctgagttcaagtccctggactagaatgagttccaggacaaccaaggatacaaagagaaagactacaagaaacaaagaacatttactgcttttgtgaagaacctgggtttggttcccagaacccatgtagtggctcaccagcaacccaactgcccataactctagttcttgggaatttgacaccccctccctgggtacatttgttgtgcacacacatgagtgcaaagcacacatacatataaaataaacagataaagaacaccctctgccccctacactcaactcaaaacgagggccagtgagatggctcagtgggtaaaagactcttgccagaaaacctgagtttaatctcagggactcactcggtagaacagagaggattcccacaaactgttttctgacctccacaggcgctccatggcgcagtaatgtaaatacacagacaaataaaattgggttgtagggtgctggtgagatgattcagcgggtaagagcatcgactgctcttccgaaggttctgagttcaaatcccagcaaccatattgtggctcacaaccatccacaacgagatactgacgccctcttctggagtatctgaacacagttacagtgtacttacatataataaataaataaacataaaataaaaaaaattgggttgtaaaggtgttttgcctatgtgtctgtcgggtatctgaagaagcctgaaatgggagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcggttccgcctttattccaggccccgcccccagtaccgctcttcaccgggcaccttgtcgccagccaagcttcttcagaccattcaccttcacttctattgaggccccgcccccatataaagccccgcccgcataaccaagtcccgccttccatcttgagccccgcccagaaatccgactcctccttctcatggccccacctccagcacatgtaccgccctcacaacaacctacccaatccgcttcgcggtcgctttgctccgcccccataaacagccagaggcctcctcgcttgcgcattcgcctcgcatcacttccgggggcggtgttaggtcaagctcacttccgcccgcggcggagctgcggtggtggcggtgcaggaggctgggtcggggtccccgggggacagacagacggacgcacgggcgggcggccgggagccatggagtgcggcccccgggccggcgggcgcgggcggcggtgagtgcaggcgggcgggcgcgcgcgggctgcggcggtttatggtgtggggccgaatcgagcgggggccctgcgtccgagacctccctgcgctctccggggatggctgtgagaccagcgcacccaccgtgtccctggcatccccatgtcccagtgcagcgatcctggagcagtcgcttaacctcctcaggacacggctgtgtccccaagaaacgcccgggccagccgcagacccaggccactgtcccacaccctctctgtctacatctgtctgctgacattcaccggccacctttgccactcacctggcgtcttcctgccagcgggggcccactgcaggcttcctttctgcagcccaggactcctttatggttcctcatcacccccacgatgaagccctcttgctgaagcaccctcttgctgagggtgcagcttgagcagaccctgctcccctgggagcccttgcagtttttcgaatcctctcctgctgcccgggtttacctctgcggtcctctgtcactgagctatttcctttttttcacgtgtgtgcgcccacgcagaggacagcttcctgaagtcagtcctctcctaccatgctggtcccctgatccaaatcggattttcaaacttggtagcaagtgcctttacctgctgagccacctccctcaaccctacattctttgaactcttcagctcctagagggttgcctccctactatgactggcccggtgaggcatgccagagcagacagtcatatgtaggtcatcctagagcccttacagtagcttggttgcttgtaacaccagggcctggttttatgtctgtgatcacaatgcttgggctttgtggcagtgagtgaataatcccggcttacagtacccagtggccccatctgtgacatgaggtcccacatgctgtctgtcctctccatataacactggcaggtcccagaggcttatgtctttaatgtctttcttccacagctttattttctctggctgccctgcacatggttgttgagtggaagtgggtcttccaggtcctgccccatgcaggatggagaactagttaactgtagaagtatctggaatcatgactgagagttcctccccatatggcagactcaggatactggcatacgtagggacagccacaggcaggaaactgaggcctccccttgcttgacttgtctagaaaacatactgcaggttgagaccccagaaattacacacctgataagatgtgtggctaggcatgaggtctgtgactaggaggaggaaggacaactctagaagggaggtcactcaataggtgtgtgctgcagaaagtgtcaaagtagcgagggccaagcctttgacacggaatgatagcggcggctgagatggaccttcgtaaggaggttagagtgcagttggggaaaggttcaggtggtggttgatggaaccagcaggcttaaagatgatgggagtgacccggaggggagtgtgagggacagcactccctttcctggccttggttcactttgtctccagcttggtcaggtgttctttctcactggaccacaggtccttccaagccctctgtgtctaaggggtgttaaatgaggaggccttgattataaagccagtgtctctaaacattgaccttgtggatatttggagcggggtcattcactgatagcctgttctgggctattcagggtcttggacagagtctctggtccccacctgctctgtaggtgtgctcccagttacagatgtggcctggtgttgtcttggttcccacctgctctgtgctagaagtgctcccaactccattctaggagtgctgtagattccaggtgtggcctggtgtctcttggagacacctggtgtcatctgcatctttgagaattgctacctgggagctggggacttgttggtactatctttgtccttgctctggctgtcatagctgtcctctcagtgtgtccctgaattgttagggactgggatatccctctcaccagtggtcttacacctcagattctcagggatccaaaaatgtgtgtgtgtggacccacagctgcctgagtgtcatgtgtctccctttgcctgttatccatgtctctctgtccctgtggatttatatgctgtgacctaaaacccaggtgtaggttgatatcctgttaaaattgcaccatgagccaggtgtgctggtgcacgcttttaatcccagcacttgggaggcagaggcaggcggatttctgagttccaggacagccagggctatacaaaggaaccctgtctcaaaaaacaaaacaaaaacaaaacaaaattgcactatgaagtcttctgccttcctctcaggttatgagagatggttgtgggcttttctggaaatgtctctgtatctatccattggcagctctgcatacagtggcagtggctttggtgtcacttgaacacattttaggatgtcctgcagaaatggagcatttgggtttnnnnnnnnnnnnnnnnnnnnccttcccatttcacttcccttctgcagtttgctgcctctctgaggcaggcctgggaggttgggtgactgaaccctgaggttgcagctgctggaggccacagctgccctgaccctgcgggagacccccccacccctggccccaagcacggggacaaactattgtcccagtcagtggggccctgtgtctggcatgcatcctgtccttgttcccggtctttgtgtctgtttcctcctttggactctgtctctgtgttccaaggccccttggcttatcctccacatcctcctgcgtgggagccaatgagcctttggatccctttggcttaaaacttggagctgcctttgttacctgttctggaggataactccttcaaggactgagggagaaactggtggggcagacagaagggtctgggcataggcctaggggtgctggaatggcagaagctgggggccatacatagaatgagttctgccacagaggcctgggagagctagggttgtgggcaggccaagaggatcaagatagaccgtggatgtggggacacgccttcctccctgcctggcacaggctggcacctggttctaccctagattcctggagggaacctacatgttggtgtcccctgcagggtatcccactgtatggcatggagacctgtggctgtgaggctcccgggggctcgccttggaccgcgatggggcccggctgcggcctcctaacgggactgaggtgtgcagcccgcgagctgccgctgcccgcatctcggagcacccccgcccctcccctggcccggcgcgggcccggtgcccgccatgaacggcctgtcggtgagcgagctctgctgcctgttctgctgcccaccctgcccgggccgcatcgctgccaagctcgccttcctgcctcccgatcccacctactctctggtacctgaacctgagccggggcccggtggggctggcgctgccccctcgggtcccctgcggacctcagcggccacacccgggcgctggaagatccacctgacggagcgtgctgacttccagtacggccagcgcgagctggataccatcgaggtcttcgtgaccaagagcgcgcgcgccaaccgcatcgcctgcatgtatgtgcgctgtgtaccgggtgccaggtgagctgccccctcccagggctcacagcaggggtgcctgggttctgtactaccctgtctttcagcccacctgacccctcttgtaaagcacaggagactccactttcatgttcttgctttcaagtctccaccaaagggtgaggtggagaggtgacagctttcccaggttgagcctggagtctaaagggcaagcctttacttaggagtcaggcaggtgcttcaggaagacacctgtgcagggccaggcaggtgtatggccttaacctgacacaggcctttgtcttattacaggtctgtctgggttgtccagaggtcaactggacaggatgggtctcaaaagatttctggtggccaggggtggggcctagtcctcctcctagcaatagagcatccactggaaggagtaggctcttcttatgcacagttctgtatcatgggggcatgagagggctcttggcctcctggcctgggcttgtgtctattgaagattgaactcacagcgggtctctctgtagatggggtctaaggcctgctggctgaccacaggcaggcctaaggctataggacttaacagccttcaggtcccatccccagctagtccctgccatgctgtgggaggccagccgtggagctccaagtagaggagacagtgggtgctgttggctcagtgtgggtggtcagctgtgctgtgccctctcacctgcatacccaggtacacggttctcttctcgcatggcaatgcagtggacctgggccagatgtgcagcttctatgttggcctgggcacacgcatcggctgcaacatcttctcttatgactactctggctatgggatcagctctggccggccctcggagaagaacctctatgctgacattgatgcagcctggcaggccctgcgtaccaggtgagggctctgcttttagggcagcagtgttggggagtgtcagtggcagatgggaccttggtccttgccgtccacaggaaaagggaagttctacctcgtctgacagtgaacagaggaccctgggtctaggagatagccatcgagaaacatgggagcaggcagttggtagcccaagtgccagggactgtgccattagctgaacttgctctggggcaggtggcaggagagccaggaagctgtactagagggtgcccaagtgacggtaggcagcaggtctgtgcccttgtcagtctgcttgcctggtcaccccatctcatcccacctcaccagggctcctttttctccttcatagagaagggtccatgcagggggctgagaccatccacccatacttctggaggtccctactcttgattagggccccaggtggctctggaactctgacagccctggggagttgggggccctggttgccctggagatgtgccaggtatcactgagctgggtccccaggcactattggtgctggcactggggacctgtctgagtgcccctccccctgtgccaaggtgcctgtaccctgcctgggctgactcccttgtgcacactgtctggagagccactgcagtgtgtgctgagctctgtccattgtcccacagcactgactgcaggaaactcctgaggtaggggcgactctctaaaggggccgccccctatggtgggaggagtttaggcttgagcaggcagagctgatcagcacaggtgcagtgtgggttgcccctaggtggtccacttcctgcctggcatcaggggaggctcttgtggaggcttgtttcagacagcggtggggactatggcaggggcagcactaggcagctcagccagggtaagtcgccgcacggatctgctggtctgggaacggcaggagaggcgttaggaatgagctggctgcactgccacattgcaagcttctaattgggcaggaaggactctggggaccttaaactgggccgaacatccggggacacagtttcctaaattcccagagacccacactggtggggaggcagcactgggaagagacagccctctgctcgtgggtcagaagggaacaggaacttttggtctggaatcttaggtccaaagtcttccacagtcaggcactgtcaccctgacccccaccctgtgggagggactgaggaaaaagccatggagctactgcttggcagggctttgggagttgctcatctccaggcctgctgaccctgctcctgttgtcgctcaggtatggcatcagcccagacagtatcatcctgtatggccagagcattggcactgtgcccacagtggatctggcgtcacgctacgagtgtgctgcagtggttctgcactcgcctctcacctcgggcatgcgggtggccttccctgacaccaagaagacctactgcttcgatgctttccctaagtgagcatgggggcggagcctgggaaagggcggggcatgagaaagggtggggctccagcctgtgcatcttttccctcagcatcgagaaggtgtcgaagatcacgtcaccggtgctcatcatccacggcacagaggacgaggtgatcgacttctctcacgggctggcactgtatgagcgctgcccaaaggctgtggagccgctgtgggtggagggcgctgggcacaatgacattgagctgtacagtcaatacctggagcgcctacgccgcttcatttcccaggagctgcccagccaacgcgcctagccaagctgcagggacctcagcagtacatgggcctcctgccgggactgcatgtgacccggagcccaggaccctgcctggcaccccaggggccatgagccatgttcaggcgtcagaggtccctcttctctcctcatggaagcaaagagaaggaaagagggaaactaattaaaggattaagattttagggttgcttggctcctttgtggctctagtgcgccttcctagggctgggagatcgctgagaccagctggctatggggaatgtgaaggaaaacctcgggttgtcccacccagggcctgcccccaggactgcagggcagtccctacagcgcacaaggctcccactctggatgcgaagattcctggtccaaagccaggaccaggccttgcactgtgtcacctgggagctgaaggggtccccccagacctgctggctctatctaggctcgtgtgctctgtggagttgagccatgtgttgtttcctctagccacagggtccctagggtgaggaagggcctgtgtgggagatgagcaccctgagctgactcgggatgcatcactttaagagtgggtggtacatttgggcgagttagaatacttgggggtgtggctaaagcccttgaagaacagaagtgacactgcttttttttttttttttaatttattttatgtatttttttttttttttttttttttttttttggttttttcaagacagggtttctctgtaaagccctggctgtcctggaactcactctgtagaccaggccggccgaaatccacctgcctctgcctcccgagtgctgggattaaaggcatgcgccatcacgaccagcatttttatgtacattgttgatttgagtgcatatatgtctgtgctacgtgggtgctgggaattgagcctagattctctggaagagcagccagtcctttcaaccattgacccatctctccagccccctgaaattggtggttttgactccagcactagttagtgcctaagctggctctcaagtccatgtttcaccgcacggggacattgttaacctagagtctgcttactctctagcctcaggacctttgcacaggttgctcgggtgccccactagaaccctgtctgtagtcccacagcctagcttggctcttctgccacctgctgcaggtttccctaccccaacacccccttttctcatcctggtggatgcccactgctcccacatatcccccgggaatgcagaactgcagaactactgtccagggctgtttccactacgaccttggtacacataggcccagaatgtactgggtaaggaggggcacgcctcattctgagccagtcatcctacaatgggggagagggctatcagtactgaggacgcactcaggtacagaggaccctatatcaaaaatgttaaaacagtgtgtgcacagagtgtgtgtgtgtcggggggatggtggtgctgggtcacaacggctctcgataaaatagcaaggctgtgtttgagtacttagaagaaaagatgtgttcttctgtcctccaaccaagctcagctggtgcttagcacaaagtctggtttcctgggtgctggggatggagagcactgcttgcccgctcactccctaagctgcagctgcagtcccctgcttactctgtgagacagggtcttgctctataatttgctctgattctgaacttactgttgccacacctggggctgctggggacagaacttggggcacagtgaatggggaggagcccagccacccatccacaacctgtgctttttcttttttctctttttgaggcacacagctacctcctttatcctggatatataatatatataatggagaccaggacaagcatgttggggatgctggtcgcctttggctctgaggcagccatgttggacattacatacatgcatacgtggctgacctgcccactgactgactcaagagtttgctctattttttcttttcttttttaaaaaatatttattatatgtaagtacactgtagttgtcttcagacaccccagaagagggcgtcagatctcatctccctctgtctctgagcctggctgactgacactcactatgtagcccaggcctcaaacctcaccactgctggaatgacagccatgagccagcatatcagctacagcaagttaaaaacaaagtaaaaaggtgagcatggtggtgcacacctttaatcccaacacgcaggaggtggaggcagaggcaagaggagccctgtgagttccaggccagcctggtctagggacctagagagttccaagagggccagggctaagcagagaagccctgtgttaaaaacaccccaagaagaaacgactgcaggtctttcctttacagactaaacttgcaatgaagccatcatcttaaattcaggataagatcctgtgacctccctgtggctcttctgctctgagacccagtgcttgtggcttccacagcacagcacagcacctcagtcagcagcacccacaggtatccgtggctcgctgtcctacagttgttccttagtgtcttcccctaggctcctcacacacagcccttcaccaaatgctatctgtagtacccccaaggttggctaaggctgtggccaggctgctctccccgacatgctttcatgccctacgtgtagtggtttcctagtccaattcagggccacaaggtcctggggtcacctcatgtccccacacccaacttaacctccagccaagggacctaggattccagggatgtcagggcacccaaaggctcgaggggacaggatcaggcctgccacagatgtctcaaacatggacatagtcgttgatagctggtaggactttcctgtctttgaggaccaatggacccagctgagagtaacaaaggccagggaccaatggttgcccaaggttcagacttccccagagcccaccgtgtccttggacacaggtctctatgacacagctacctcccttatcctggatatatatataatagggaccaggacaaacatgttgggatgctggccacctttggttctgaggcacccatgttggatattattgtacatacacgcaaaagtggctgacctgctcactggctcagaggttgctctctttttcttttcttttttttttttttttaatatttatttattatatgtaagtacactgtagctgtcttcagaccccagaagagggcatcagatctcattacagatctcattacagatgggttgtgagccaccatgtggttgctggtaattgaactcaggacctctgcaagagcagtctcggtgctcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgagttcgaggccagactggtctacaaagtgagttccaggacaaccagtgctatagagaaaccctgtctcgaaaaaccaaaaaaaaaaaagaaaaaaagaaaacaaacaaacaaaaaaatccccacaaaacatagtcctatgaagcctggttcagcttcctgcttgtgttggatgctgcccaggttcaagctaaatcttagggtcactgtccccaacaaaaagcactatgcctggctggcttcagccacatgagttgggagcaacagtgacatggatgggtctgtagtctctgttccaccggacccaagtctgtggatgtccccagggcataggtcaaaacaggcacactttaagtctccaggaagtgacaggtctctgggatctctgacttttctgagacccaagtgcctgccaggggctctcttaggccccctgcatcttagccccatccttcatataggaacccaaagttctcaacgtggtccttaatagttcacctttgggggactggtgtggtggtcacatctttaattccagcacgcggaaggcagaggcacgctgagtttgagaccagaataaattctaggtcagccagagttgtgtcaaaaaaaagacctgaaatttgtgtagccaaatgttgggtgtcagacctgtccccataactcccgtagatcctttatgaaaataaaaacaaaggacaaaccagagctcccccgtgggactagcaaggaccaagtgtttgagccctagggataccatcagaaagagtgacttaccagtactcctgttcttgtgggagcaggctggatattttcccagagtcctcagccttgactgtgccatctgtaaggtagggcgactgtttttaggtctctcctgggtcagatcaacaaccgatccacctcgtgtctggggcttggggtatgaggctaatatgcatgaacggtaatggggggctgctacatgcaatggcaggattagctcacagccggctctcacaggcttaagcccttaggacacaaatgtgcttggggcatgctaagtggcaccacctggtggttgtacaaccaaccttacttaccactctagctgctgttaggcggggcatcatgaatcaattcatcctgatggctcctctcttcaggtggcgggagggagggcaaaagatcccttcagaaagccacagaagctgggtcaggatcgcagggttctggttgttggagggcaagcaatggaaagatgggtaggtgtgtacttctgaacaacgtggacttgtgtaacctgtccatttctgtccagctagatttgtgcagaggtcccccagagtattcaacctctgtcgttgagggacacggtgtcaacacaaagtatagtggggcctagagaaacatggccaactcgacggcagagcactggaacctgaccaagtcagcttggggtgcaggtggggaaggtagagatgacacccagagcaaggacctctgccaccggttagcctctgctggggaataaacatgatggagctcggaccgacagactgctgtcggttggggtgcttcgccccctggaggctgcgcgggccactgcatggcctccgcaacccggcgggagttaggaaggggcgggagcctggtctcctacttccgcgcaaccggcgcctagggcctggggcttttaggggaccatcatttcacaacttggtcgattatccatggaagtttccaatcgctccattagtcagcctcagtttccctgtcccagtctcaaagggccagtgagggagggacgaaacaaccagaactccagtgtccctagcttcgcatagatgaccgagccagaccttcttattgcagccctgttcacttttgccataccggttatccacaggcctagtgattctcgagtcccggtgcgcaaagacgaactctacaaactcgatcagctaggcagggtagtgggtaccctacgctctcaagttcgacctccgggatattttgtccccaagccaagaatggcattggggacccagagatggggagtcaggattggtgggttattgccctgcttcaaggccaggaaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcgcgcgcgggcaggcgtggcggccacgcggtcgggcggcgcgcggagggcggccctggtggccaaatctcccgcgattgcaggttgttcgggatctaccccggcatggtgggtccaccacgcgcgatcacagtcctcagccccctactccttcgttttcgcttggtattcttgtcctgtttttctgcgcttcatggtctcgcccttggtggtcagaacatccggttccgtagttctttctcggccctcccccagcctcagtttccttatctgtgaagagggtcggtagatccgggttacggccttctgggtagcagcgcggattccctccgaagggcagcgaagactctcgcgcagggttaggtggtagcatagcagtggtgaggggtggctgcccggaacatttttctttccattctgtgtacttttaacatggtggagcgaggccacgacccggacctggagttggggcttgaatcttcaatccagtgggattgaaatcctcaccacaactcttcgcctacgttttgtgttggcccactccacacacctgtgatgggtcaggtcaaggtccaagatggacaacgagatttagccacaccagtgtttctgggatgcccaatccccccggattggatggggcaaaccttttgctaggtactggccgcttcctgtccaagggtctatccatgttagctgggatttgcactgggatttgacaatctacccctttaacagcggtgtagtcaacagctccaaggcatccctgggatagggccccctgcttgttatccctctatttacttgcttttggttcgccatctcctgtctatataagagatagaggctgccttactgatacagttgatgtgggcagcaaggcacccaaagagggcttgatgggggtgggggtgggtctcctaacatggtcacactgggagagagattaggacagcctccataggtgtgtgggtggccccaggcatgttcagggcaggtatgggggtggaggagccatctttggattctactgagccagagagagggcatagatgatgcctcctctcactgtgttttgagctgctggcttgagcccctgtggtctaggggctacccccgtgttggtgcccacatgtatgggcagctccatatcacctgtgtatacacatttctctctacagaacatttgagggggccacacatgtagcaaggctgtgtgtgtgtgttgggggttggtttgggggaagggagagagagagtggagaaagatgtctctctttgccacagactggaatccagggtgtcctggctcacaccaagtgaatttggccttgcagtgatgggagcctgctgagccagggaccctgtctttctgattcagactgcaccacccacaccttccaacccagcaggcttcctagttcccagaacttgaggtcgatcacagaggaatccaacgccctccccacctggagacagttctgttactcaaatgtcaaaggctgcaagccacccctaagctgggaagggtgacctgccttgctagagaaattgaggcctgagagctgaagtctggggtctagggatgacagcaggcaggtccacgaggtggggtatggagttccactctacactggatcctgaatcatccttgaccaccaggacacacacgggataccgtgtccccaaactcccttattaacaccattcatgggatcaagagattcatattggatctgggcacctttatgtcattttgggggtgtctggggagcactgaatttacatcctgccttttagttaatttaaacgactgtagccagggcaatcctgggacttgctctgtagactaggatagccttgaactcacagattggcctgcttctgcctgtccagtactgggattaaaggtgtgtgccaccaggcctcaatttttgagacatgttctcactctgtagcccaaactaactttgaaactcaaggtaaatcctcctgcttcagtcttctgcctagggctaaagagccacagctggcttccccagtctcttctctgtgcaggggatttggctactccaccctcaagtgaaggtggcatactgctgacttaggaagcctgtgtggtcacgtacacctcaggtcagtaggactcatctctagtatagggcctgaggtagatctgatcccctccagagccatgccctaaggctgtggactaggagaaagaatcctgtctacctacccactcatgcctgactacgacctggatccgtttagttctctgatggaggcacagatagcaccgggtagagggcaccttgcagccccgctatgtccacttcattgtacttgggggtgcggaggagagctggtggtgggggttacaggacactcccagcaaaggctgtaagcagagcttgacactccagttgccacagcccctgcttgggttggggaaggactttagagactgtgggagatgttgacgtggttgctatggataccgagagagctagccttggggcgggggcgggaggagaggctggctcctgttctgcctgccaagccccctccatctctggcatcctctttccctgggcctcagagggtgggggggtccttgatatggtctcgtgagatagaacccagacctaggagaggtctggacattcatccaggcagggtctcacccctttaggaccagttcttcacagtaagatgttctgggcccttcagcttggcctcctcagtgcccaggatctcctggaggcttcaggctcatctccagatagccgaaaaacccgcttacttaagtctgagaaacttgagtctgggcaagggtgatgatggctcaattgggtaagggtgacggccaagaaagatgcatctcagagaccagcacagcagaaggagagtccccgcttgtcaccggcagtgacttctgcatgcacctggtgcgtgttcctacacacacaatgatgcacacacaaaaattagaggtttgaagaagtgttcatatctgtggtcaccaggacactgtagggtctttgtgggcatcctgccccccagtaaccatgaagtgggaaggtggggagggctga

SEQ ID NO: 314 - DNA, 1500 bp, Mus musculus
ggaatggcagaagctgggggccatacatagaatgagttctgccacagaggcctgggagagctagggttgtgggcaggccaagaggatcaagatagaccgtggatgtggggacacgccttcctccctgcctggcacaggctggcacctggttctaccctagattcctggagggaacctacatgttggtgtcccctgcagggtatcccactgtatggcatggagacctgtggctgtgaggctcccgggggctcgccttggaccgcgatggggcccggctgcggcctcctaacgggactgaggtgtgcagcccgcgagctgccgctgcccgcatctcggagcacccccgcccctcccctggcccggcgcgggcccggtgcccgccatgaacggcctgtcggtgagcgagctctgctgcctgttctgctgcccaccctgcccgggccgcatcgctgccaagctcgccttcctgcctcccgatcccacctactctctggtacctgaacctgagccggggcccggtggggctggcgctgccccctcgggtcccctgcggacctcagcggccacacccgggcgctggaagatccacctgacggagcgtgctgacttccagtacggccagcgcgagctggataccatcgaggtcttcgtgaccaagagcgcgcgcgccaaccgcatcgcctgcatgtatgtgcgctgtgtaccgggtgccaggtacacggttctcttctcgcatggcaatgcagtggacctgggccagatgtgcagcttctatgttggcctgggcacacgcatcggctgcaacatcttctcttatgactactctggctatgggatcagctctggccggccctcggagaagaacctctatgctgacattgatgcagcctggcaggccctgcgtaccaggtatggcatcagcccagacagtatcatcctgtatggccagagcattggcactgtgcccacagtggatctggcgtcacgctacgagtgtgctgcagtggttctgcactcgcctctcacctcgggcatgcgggtggccttccctgacaccaagaagacctactgcttcgatgctttccctaacatcgagaaggtgtcgaagatcacgtcaccggtgctcatcatccacggcacagaggacgaggtgatcgacttctctcacgggctggcactgtatgagcgctgcccaaaggctgtggagccgctgtgggtggagggcgctgggcacaatgacattgagctgtacagtcaatacctggagcgcctacgccgcttcatttcccaggagctgcccagccaacgcgcctagccaagctgcagggacctcagcagtacatgggcctcctgccgggactgcatgtgacccggagcccaggaccctgcctggcaccccaggggccatgagccatgttcaggcgtcagaggtccctcttctctcctcatggaagcaaagagaaggaaagagggaaactaattaaaggattaagattttag

SEQ ID NO: 315 - protein, 338 aa, Mus musculus
GVQPASCRCPHLGAPPPLPWPGAGPVPAMNGLSVSELCCLFCCPPCPGRIAAKLAFLPPDPTYSLVPEPEPGPGGAGAAPSGPLRTSAATPGRWKIHLTERADFQYGQRELDTIEVFVTKSARANRIACMYVRCVPGARYTVLFSHGNAVDLGQMCSFYVGLGTRIGCNIFSYDYSGYGISSGRPSEKNLYADIDAAWQALRTRYGISPDSIILYGQSIGTVPTVDLASRYECAAVVLHSPLTSGMRVAFPDTKKTYCFDAFPNIEKVSKITSPVLIIHGTEDEVIDFSHGLALYERCPKAVEPLWVEGAGHNDIELYSQYLERLRRFISQELPSQRA

SEQ ID NO: 316 - DNA, 28454 bp, Homo sapiens
cctggaaggaggcctcccggtcctttccccaaaagaagcctggctacagaatctttgaggccaagctcagaatgacaatacagggccccttgtttaaaaatgtttagaatttttttttttctaagacagtttttttgctcttgttgcccagtcggaatacaatggtgctatctcgagtcacgacaacctctgcctcctgggttcaagcgattctcctgcctcagcctcccaagtagctgcgattacaggcatgtgcctccacgcccggctgattttgtgtttttagtagagacggggtttctccatgttggtcaggctggtcttgaactcccgacttcaggtgatccgcccgcctcggcctcccaaagtgctgggattacaagcgtgagccaccgagcccggcctttttttttttttttttttttttttttttaaagagacggagtcttgctctctcgcccaggctggagtgtagtgacatgatctcagcttactgcaacctccgcctcctgagttcaagcaattctcctgcctcaggttcccaagtagctgggtctacaggcatgcgccaccacgcccagctaatttttgttttttcagtagagacaaggtttcaccatgttggtcaggctggtctcgaactcctgacctcagctgatccgcccgcctgggcctcccaaagtgatgggattacaggagtgagccaccgcacccagccaatttttaggaattttgagacagcaaccacagagcattatatcatgcctagattcctctgagtgtgggtccccagcggacccctgaggcctctgcctgcgaagctggcgctaaccaaacagctcgtctaactccgtggttttatgaacattgatttatttggttgtggtaaaatacgcataatataaagttgaccatcttaacccttttattttatttatttatttatttttttgagacagtctcgctctgtcgcccaggctggagtgcagtggcgcaagctccgctcgctgcaaactccgccttaccggttcacgccattctcctgcctcagcctcccgagtagctgggactacaggcgcccaccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggcctcttaaccattttaagtgcacagttcagccgtattaaactcattcacacggttgtgcgaccatcacctccagaactttctgatctttgcaaactgaaacttggccccatgaaacgctcactccccattcccctccccagctcctggcggcctccatcctactttgtgtctctgtgaatctgaggactcgagggacctcctaggagtggatcacacaagacgtgtccttttgtgtctggcgcctcccgctgagtgtaacgtcctcaaagtgcatccgcgcgttgtggcctgagtcagagcctcgctccttttctttttttcttttttctttttttatattatattatatatatttttttgagacggagtctcgctctgtctcccaggctggagtgtggtggcgcgatatcggttcactgcaagctccgcctcccgggttcacaccattctcctgcctcagcctccccagtaggtgggactacaggcgcccgccaccacgcctggctaattttttgtatttttggtagagatggggtttcaccgtgttagccaggatggtctcaatctcctgacctcgtgatccacctgcctcggtctcccaaagtgctgggattacaagtgtgagccaccatgcccggcctcgctccttttcatggctgcctcctattccagcgtgtgtataggccatgctgtgttcacccagtcatctgtccatagccactgggactgttgctaccttgtggctgttgggaatcaaggtactactgacataggtgtgcaaatatctatggaaatccctgttttccattatttttttgagacggagtctcgttctgtcgcccaggctagagtgcattggcacaatctcggctcactgcaacctccgcctcccgggttcaggcgattatcctgcctcagcctcctgagcagctgggtctacaggtgcgcaccaccacgcccagctagtttttgtatttttagtagagatggggttttacgatcttgaccaggatggtctcgaactcttgacctcgtgatctgcccgcctcggcctctcaaagtgctggaagtacaggtatgagccaccgcgcccagtcccattcttgtaagtatatgctgaaaagtataaatattagtatttaatcacaaagcttatttagaaatctagttttagcctgggaggcagagcttgctgtgagccgagctcgtgccactgcactccagcctgggcgacagagcgagactctgtctcaaaaaaaaaaaaaaaaagagaaatctagttttaggccaggtgctgtggctcacgcctgtcatctcagcactttgggaggccaagagagccacatcactggaggtcaggagttctagaccagcctgcccaacatggtgaaaccctgtctctactaaaaatacaaaaattatggctgggcgcggtggctcacgcctgtaatcctagcactttgggaggccgaggtgggtggatcacaaggtcggagttcgagaccatcctggccaacatggtgaaaccctgtctctattaaaaatacaaaaattagctgggcgtggtggcgggcacctgtaatcccagctactcgggaggctgaggcaggagaattgcttggactcgggaggcggagtttgcagtaaactaagattacatcactgcactccagcctggatgacagagtgagactcctactcaaaaaaaaaaaaaaaaaaaagtcacccagtaccttgttctcccacatcatctatctcggtccctctgtggggggttttctcagggggagacccaggattgctttctgaacacagcagcatggaccttctcatgggacctcctcttccaggaatcctccctgcagggtcctatccatcagtgtgaaacgtctcatgtgccattattgttgcagccaaagccagaaacaccctacatgtccgtcaagaggggactgagcatggagacggcaggtcagctcctggggccccttgctttgcatgagaggattcccgaaacaaatagcatatgtggctgggcgcggtggctcacgcctgtaatcccagcactttgggaggctgaggtgggtggatcacttgaggtcagaagttcaagaccagactggtcaacatgatgaaaccccgtctctactaaatatacaaaaattagccaggggtggtggcagtcacctgtaatccaaggtacgcgggaggctgaggcaggaggattgcttgtacccgggaggtggaggttgcagtgagctgagatcgcaccattgtgctccagcctgggcaacaagagcgaaacttcgtctcaaaaaaaaaaaaaaaatacaaaaattagccgggcatggtggctcatgtctgtaatcccagcactttagaagactgaggtgggaggattgcttgaggccaagagttggagaccagcctgggcaacatagcatgacctcatctctacaaaaaaattgaaaattaactgggtatagccactccactgattcaaatgttaatctcttcggaaacattcttacagaaatactcagaaatgatgttgtgccagctatatatatggtagcccagtcaaggtgacacataagagtaaccattggccaggagcagtggctcatgcctgcaatcccagcactttgggaggctgagatgggtggatcacgaggtcagcagttcgagaccagcctgatgaacatggtgaaaccccatctctactaaaaatacaaaaaaaattagctggttatggtggcaggggcctgtaatcccagagacttgggaggctgaggcaggagaatcacttgaaaccagaaggcggaggttgcagtgagctgagattgcaccactgcactatagcctgggcagtaagagcaaaactccgtctcaaaaaaaaaaaaaaaaaaaaaaaggcgcggtggctcacgcctgtaatcccagcactttgggaggccaaggcaggcggatcacgaggtcaggagattgagaccatcctagctaacacagtgaaaccccatctctactaaaaatttaaaaaattagccaggcgtggtggcgggcgcctgtaatcccagctactcgggaggttgaggcaggagaatggcgtgaacccgggaggcagagcttgcagtgagcggagatcgcaccactgcactccagcctgggcaacagagtgagactccctctcaaaaaaaaaaaaagagtaaccaccacatcttgcagatgtatttcccataaacataaataaaactaaaaaaaaaaaaacaacaattgggcaggcatggtggctcacccctgtaatcccaccactttggggggccgaggccggtggatcacctgaggtcgggagctcgagaccagcctgaccaacatggtgaaaccccgtctctactaaaaatacaaaattaactaaatgtggtggcgcatgctactcgggagactgaggcaggagaatcgcttgaacccaggagaatcgcttgaacccgggaggcagaggttgcagtgagctgagatcgtgccattgcactccagcctgggcaacaagagtgaaacttcatttcaaaaaacaaaacagaataaaacccaacaattgccaggcatggtggctcacgcctgtaatcttagcactttgaaaggccgagatgggaggattgcttgagcctgagagtttgagaccagcctggccaacatgatgaaatcccatctctacaaaaaatacaaaaattagctgggcatggtggtgcacgcctttggtcccagctactcggcaggctgaggcaggagaatcacttgaacttgggaggtggaggctgctgtgggccaagatcgagtcactgcactccagcctgggtaacagagtgagactcttgtctcaaaaaaaagagaatctgagagtggtaagtattgcagtggaaataaacagggtgatgggatagaggtaatggggtagaggtgtatgtatgtggttgggatttagctggggtggttagcagaagctcttggatgttgtggccctcctgtagagccagaggatgctggagaaggaagccagggggccatatggggaagggccctgcaggcaggagccatagtacctgcaaaggccctgaggcagcagcactcctggccaggccagcatggctggggcagaccatgaaggggaagagggactagtggctccccccattttcaatgtatgatttttttcatttttttttatttatttatttttatttttatttttatttttatttgtttttgagacagagtctcgcattttcacccaggctggagtgcagtggcgccatctcagctcactgcaagctccgcctcccgggttcacgccattctcctgcctcaacctcccgagtagctgggactccaggtgcccgccaccacgcccggctaattttttgtatttttagtagaaacagggttttaccgtgttagccaggatggtctctatctcctgacctggtgatccgcccgcctcgggctcccaaagttctaggattacaggcgtgagccacggcgcccggacttattttttattattttatttttttgaagtcagagtcttgctctgtcgcccaggctggagtgcaacgctgtgatctcggctcactgcgacctctgccgccctggctcaagcagttctcttgcctcagcctcctgagtagctggggttacaggcttgaaccactacacccagctaatttttgtatttttagtagaaatggagtttctccatgttgaccagcctgatcttgaactcctgacctcaagtgatgcactcggcttggcctctcgaagtgctgggatgacaggtgtgaacctcagcacctggcctcattttcattttttattttattttattttatttttagaccaagtctcactttgtcgccctggctgaagtgcagtggcacaatctcgactcacttcaacgtctgcctcctgggttcaagtgagtctcctgcctcagcctccagagtagctgggattacaggcatctgccaccatgcccagataatttttgtatttttagtagagatggggtttcatcggccaggcacggtggctcacgcctgtaatcccagcattttgggaggccaaggcgagtggatcacgaggtcaggagttcaagaccagcctggccaagatggtgaaaccccatctctactaagaatacaaaaattagctggatgtggtgataggcgcctataatcccagttactcgggaggctgaagcagagaattgcttgaacccgggagacggaggttgcagtgagccaagatcacccccctgcacttcaacctgggcaacagtgagagacaacatttcaaaaaagaaacaacaacgtaaaaaagatggggtttcaccacgttggccaggccggtctttaactcctgacttcaagtgatcctccagcctcagcctccaaagtgctgagattacaggcgtgagccaccatgcccagccctcatttttattttttagagtcagcatctccctctgtcatccaggctggagtgcagtggtgcaatcacacctcactgcagccttgaactcctggcctcaaagaatcctcccaccttggcctcccaaaatgctggggttcagacatgagccacagcacccactattttctgggacaattgggacagaggctcgatcacaaagggtctctggggaggaggaagggatgggtgtccttctgagacatttgagtgtttacagcgtgcgtttacctttcaccaggtggccttggattggtgggccaccctgcgggcttatcctcctccccttggatggtgtctccctgtgtccctgtgggggctgtcgtttacaagtggagctgggctttctggtgcggtccagccctggtcctgcctagctcacagtgggaaggggctgcagggaagatgggaggggggaaggaggctggggacaggcctcttctggccctggtgctcagagaattcacaaggacctaggaagaagcctggacttgttttggcctttggacctcaggagaacctcagcggaggctgggagcctcgagggggacagcagaggcaggggaacgctggggcagctcttgacagccccagggagacccaggcagctgagtcctgagcaggggcgccagaggtccaacaacaccggaaaatcagaaaatgaggcaaagcagccaggtgcggtggttcacgcctgtaatcccagcactttgggaggccgaggctggcagatcacttgaggtcaggagttcgagaccagcctggccaacatagcgaaaccccatctctactaaaaatacaaaaattagccgggtgcagtggcgggtgcctgttagctcagctactcgggaggctgaggcagaagaatagcttgaatctgagaggtggaggttgcagtgagccgagatcgcgccactgcactccaacatgggtgacagaataagactctgtctcaaaacaacaacaaccaaaaaaaaaaagaggaaagaaaatgaggcaaagaaaccctgggctatctctaagtctctagtcttttgagcctgattccttccctggcagctgtgtcctgaatttgaggaatgagcccctgggggcaggattggcccaggagcctcaggcttatctcagaacagtggagctaagatgagagtccctgggacggcgcaggggctgcggttgcctgcaggctggaggagcattttgagctggaaaaggcacgaaagctggggggaaggcacatgtgagagaaggcctgaaaagcaaggcttcccaccaattcacactcacacttccaggctgggccccttcggtgtctgcagccctttctgcccctgtccctgtcacttccttagaaaggcctgccctgaccacgctctgagattctccagtaaccttcttccattttcttttctttactttttttttttttgaggcagagtcttgctctgtcgcccaggctggagtgcagtggcgtggagtagctgagattacaggtgcgcgccacaacagccggctaatttttgtatttttagtagagatggggtttcaccatgttggccagggtggcctaatttttgtatttttagtagagacaggatttcaccatgttggccaggctgaactcctaacttcaggtgatctgcctgcctcgttctcccaaagtgctgagattacaggcgtgagccactaggccctgccataatgcaatttttttttttttttgagacggagtctcgctctgtcgcccagtctggagtgcagtggcacggtctcggctcactgcaagctctgcctcctgggttcacgccgttctcctgcctcagcctcccgagtagctgggactacaggcgcccgccaccacgcccggctatctttttgtatttttagtagagatgaggtttcaccgtgttagccaggatggtcttgatctcctaacctcatgatctgcccgactcggcctcccaaagtgctgggattataggcgtgagccaccgcgcccagcccataatgaaatttttttaagagacaggatcttgctctctcgcccaggctggaatgcagtggagtgatcatagttttatttatttatttatttatttatttatttatttatttatttatctgagacagtcttcttgctctgtcacttgggctggagcacagtggcccgatcttggctcactgcaaccttcgcctcccgggttcaagcgattctcctgcctcagcctccggagtagctgggactacaggcgcgtgccaccatgcccggctaatatttgtatttttagtagagacagggtttcaccacgttggtcaggcttggtctcaaactcctgacttcaggtgatctacctgtttcagtctcccaaagtgctgggattacaggcatgagccaccgtgcccggcctaatgtaatattttaaaaactaatgcaaaagaatttctgatgagcaatatataaagactttaaataagctggtcatggtggcttgtgcctatagtcctagctactcaggaggctgaagtaggaggttcacttgatcctgggaggtcgaggctgcagtgagctatgatggcaccagcctgggtgacagagtagactctatgttaaaaaaaagaggccaggtgcggtggctgatgcctgtaatcccaacactttgggaggctgaggcaggaggattctggggtcaggagttcgaggccacactggccaacatggggaaagcccgtctctactgaaaacacaaaaattagctgggcatggtggtgggtgccggtaatcccagctactcaggaggctgaggcaggagaatcgcttgatcccaggaggcagaagttgcagtgagctgagatcgcgccattgtactccagcctgggcgacagagcgcgactccatctcataaagaaaaatattttaaaacatttctaaatgttgatgtctgagttttttttggcgtccctgtaaattttgttttccaggcgagaactttactggcctcaacctattccgggtccccaagtgaatgaaacctaagtttggccccgcccacagagcagcaggccacgcccctcgacatatcagccccgccccccaggacgctagtcgcgcggtcgctctgtgcctgcagacccccgccccgcgcgctcctcgcgtcacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtggtgagtgccgggcaggggcgggggcgggcgcggccgcgcggggtcccgggccgggcctcgagggcctgacagcccggttggacgtccccgagacccctgcagtcccagggcttccgcgggtcctgcccgaggagcccagagcaggggcgcggaccgcggatgagcgtctgtgattgggaaagccctgtccccatccattcagccctccggcgtgggttgcgctcccaccctcctgcggacgcggcccttgccttcggggagcacccgtccgagccgcggattccgctcttttgccccgaaactgcccccagtccgacaaacgcttcggcctctcgccccccaaggcagctcccaggggccctcccgagccctgcttcccaaccagctcccagtcgctgtttcccttgtcaggcttcttcctgccaccctgactcctgggcgggcttcccggcctccgctcgcgtccgttctccgggatgcagcccttctcctatgttgtccatcgcttgctcgggacttcttcgcggccccgccatttctcccaggatgaagtgcaaactctcgggggcgcgacctcacccgtcccaggctctctcttaggacccttctgctcacttcttcctcccagggtctgctctagccaggagcctgctctgtcacctcggattttgctcctgcttgtccctctgtcccatccccctgtcacctggcccgtttgtctgccctctgatatggccgcgcctccccccaggcgggtttcccaccctgactggttgagtgaggtgcagtcaccgtctctcatatgtaggtcatcttccagtattttggctgctcggttgcttgctggtcctcagaacacctctagcttgcagagggttgcccagttaagtgcgtgggaacggaattggtgggattcagggtgtcaagggtgtgtgcccagtgagtgaggcgtctgggtttgcactccccagtccacgcccattagtgacactagggaggttccaggtacctgtggctggagaggagaggagactagactttcccttccctgtcaaagctggcggaccttggggattcttttcctcctgtgcttcctccttaattctgtgctgcctaccacctgcccattcctttagtgagtggcaggtcatggtcctgctctcatagagtttctggtttggaggtggggggagatctggccaaacgtgtgaaaaatacaagctgtggaaagagcgtgtaaggggtcctgtcccagctttgaggactctgagagcgttggcagtgaggtgcaaagggtggttgggttgggcaaggctgtctagtgaggttggggaagggagttcctggcagaggagcagaggcaggaaggggcaatttggcttgtcttgagggagccaggggtggcagggtgtgagatgagtgagtctggagaggtcggcctgagccggaatgcggacctggcaggctgtggggagggctttgatctctatccagggaataatgggaggcccccaggacaccccaagagggaagcggctccattgcatttgtgtcgtgaaagattgtttggctgctgggggagaatgtcctggagcaggtgatcagcaaggagggaggctgttgctgtggctctggtgaaaggtgatggaggcagggaccgggcggtggctgatgggagacaggcagagccaccgggttggtgatggaccggctcagatccagtgggtggaaggaggtgtcaaggataacatctttgtttctggcctggatagtggggccctggccacctcggtgtgccccttcgtctccggggtctccaggggcctgctgctgtccactgggctctcaggacccagctgcatgatgccacctaaactgcagggccctccaagtccccagcaccagcggggcagcaccagtagggcctggacctctttgagaatatgttgaaaagctgacatcaacctcgacgctgtggatgttgggcctgatcattctttggggtgggtctgtcctgggcactgcagggtgctaagcagcctccacccagtccccagtggtgacacccaaaactgtgtccagacattgacaggtgtctccaggagggagactcgcctccatctgagaagcagaaccagcctgacagtccacctcccggctgaaaagtgcttgcatgtgcgatttgccttccgcctgggagtctgggggcactgggatgccatccttgccccaccctggctttcagagctctctcctctcctcctcgtgtgcccatgagtccggctcacaggaacgtgggtctcacatcaggtcctgagggagcaggtgtgtttctgggcctgaggctgctccttggtagtgagggtgtccccacgagccgtgtctgtggcgcctgcagctgcctgcatgtccatctgtgtccacatctgcctttgagcctcatcttcctggccccacggttttctcatgctgtgacccaaaagccaagcattccagggtgttctgctgaaattgagttgtgagcgtgtctctctcctcgctccagtctgaaggagaagcgtggtcggtagatagacgtctcagacctttgtgttttcttcacgtctgtctgttggcaggtccttacactattgtggttgctttagcaacttagctgttgtcgacttaatgtgtttcatgacgttctgcagcaaggaagaaggtccgagtttccactctcaatcaggcaccttcgttcccctcccccctcacttgacttcctgtggggtgtgtggtgtctgcacttatagatgagaatgctgaggcctcaggagggcaagggactcgcccacggtcacggaaccctaagtcaggggtggagaaggaccccctgacgccagcccacctcccctgcccctcagcaggcctggctccagcacagagaagagccattgttgctgctctgggggccctaggagcctgggatgtatcctgcctttgtttctagagcctttgtttgttgtatttcctctgtctccagacatcgcaggccggtgggacccggcgcctgtgcacgctcacgtagcggggcctgttcgggtccctcgtgggtcccttcagttcgagctctgtccttgcctcagcggcccgtcacccatagggtggcagagatgggccgggggagggagtgggcagcagtgcggaccgagtcctggcgcatggggtttccctggtgctggagccgggcgtttcgggggtgtgggcggggctggggtcatatcccctgcatgccccgcatgccatggctgtactcacatggcaagaggtggtgatcgccagctcagggaaggtgggggttccttcatcctgtggagagggggctgaattggggtcccctgagctgtagggtgcagtgcctgacaggccgtggggagggccgaggggatggggactgacaggccccgggcccatgccgccccctggcacgggtggatgccccgcctcccgggggtgcccagctggactgtggcacccccaaaggaccccacatgtcactgttcccccgcagggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtgagcagctgtggccgcgcctgggctgggtcaccctgttcttggggctcccgtttctgcctgcggtgcttggtgtggttggtggtgcccccgagggcccgagcctgccgtgaagggccatccagccagcaagggtggtatcccccgtcaggccggcctcgtccctctggcaattttctctcgcagacaaggacaccaggctcagggaggccatccccagctggcatgggtgggcaggctgggcgactccaacaacccagcgcctggtggttgcctgctgggcgagagctggggcacaggggctgccctggcctgcgggtacatccaccttctcgccaggtggggttctgaccagatctgagtccagagggcgagcctttaccttctggctgggctaggtgggggcctgggggaactggaggaagcagtccatggcagggccagcctggccacctgctcctggcaccacctggggcagctcccgtgctgggaagcagacaggccttgcagcacagccttggggcttgggcagggtggtgggccaggaggggctgcatgagtgtgagcagagattggccgcatttgcttgttgggggcaggggtggggtccagttgtgccccaacagtgagggcaccattctgtgaggggaggggagatagccctgccagcagcagcgtgggctcccctgggaaggtcctgaaaggtgggcctgtgcgctccatccccgggggtccaggttcttccaggaggaagggcagtgaagcctgcagtatctgagcacacactgcgagtctgccctgagagaggatgcgaccgatggtcccagtgtcccgcttcacagatgggaatcctgaggctccctggctggcctctgcagcccaggctgcctgtccccctgccagctgtcctgtcctctccccatggggaaccctcggagatggagctgtgctgtcgtagcctcccctctccattcactggcttctggcccccttgggaggggagtaaatgaggcactgggcatggctggccaccggggtgggctgtcactacgcatcctcctgccctgcagctgggcgctgggagcgaggatgtgaacggcccttctcggcctgtcccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtgagggcgaccctgggggcagctcagcctgggcacacccaagaggggaccaggcggggggccggggggcgggcttccctgggaggaaggtgggcggccctgcaggaggggagccacagtggatgcacagggccagagagccggacaggcgagcttgggtgtgcaggtgccgcctccacatggctgaggtgtggccaggcggtcctcccacaccctggcctgtggagccaggctccctgggaacccctggcctgaggatgggaaggggctgagcttgtcacaggggtgtggatgccacccggcgggagggagtgggtggtggtctgggggtctgtgcacgtgtggctgggagcccatcggccgaggcagcacttggggccaagtgaggcgaggctgctgcatccaggtccggaggactggcccatgaggccctgtggctgcggagcttggccatcctggggcagggcctacagggtaaggtgcagacccgcagcacacatccgaggtctgggccagcctcgattccagatccagccctcctagtcatccacgtccccagccctgcgcttgcctgggcccttcaccggtgtttgagcaccgcccgggccagtgctgctttggacgaggagacccgggtgggcctctggtggcttttcctgctcaccatccactgggcctgtctcgtcctggccctgcccagcccactggtctgacctgctcccgcagggaccaggcacagctctgagaagtcagaggccctagggaggtggggtcgtcgttgccttggtgatatgcaggcagtccctgcagtgggcctgggagctggtcccctggcaccaccctggctctgggggcctcccagcagtgtgggacgctgacaccaatcaccacttcatgcgacttcctcggcccctcctgtctctactgcctgggccactggcagagtcacacctgccatggccagctctgagctctgtctgctcggccatctgtcctgctgccactttgtcctgcaggaacctaggcccagagctgtgagggggaggccagagcgtgcccagggcctccaccggggatgtgtcctgttcgtttgagtggtgacatccaggtggcagctcggggctcctgcctgtagcaggtggcagggctgggctggctcagcacactactgaccatggctgccagggagcaggccagggaggccgaggcagagctggagccacaggcaccagccaggcagcatcctttggggcatgggtgagtggcgagctgtggagtgctgccaggaggctgggattccaggccagggacggggacagccctgctggtggagatgccaggcagaggggacgcacacctgcccatgctcctgccttgcaagagggcgtctgcctgggatcagagcctagagcatgtgggaggagagttgtggggtcccggcatgggcagggtggcaggtgggtcccgtgtgcttgggactgggcacgaggaggccttgtaactggtgctggatcagctgggtcaggggccgcacaccaatgacctgggggtgagggtgcccctgggtgggagctggtggtgctgaggtggccgaggacttgtccactcccaagggaaggtgctggtgggagggggtgccacctccgcagccaccaccctcgatgctgacctgggttgcactggcatctcattgggcgtggggactccgagagtccaaaattgggtggagacatttggggacacagctgcctgaattcctcatggccaagggggtgggcaagggctgcagggaggaatagtgtccgctgtcctggccagtgcaccaggaacggttttctaaccctggcaggaaggtgtgaagcattcaggatgtgggggccacacagttcccagtgtgcacctaggggtgaccaggaggaggagaggcgccagggcctcccttacccccgccccaggggcactccgtaggcaggatccctgcagatcctagctaggaaacgccagtgaacggcagcgcagggaacggggcggggccgctggcttcgcccaccgccacggtgttgggggctgggggtggccctcgggactggtgtggagcctgagcctgacccactgacttggctgagtggggagactggagggtcgcatccggagctgggcccggggacgcccgctggtgggaagggtgcgcgagcgtcggaggccgcggctgaccctgctccggcgccgccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaagtgagcggcccgggcggggacgggggcggggcggggcccgggccgggcgcgaagtctcaccggctccacgaccctcccgcagcatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaattttagggctgctctccttcctttcatggctctgctcactctctcgagcgctcagcgagctcgaaagggggccggggttcccaggtttcgtccctgagtccctaggagagatcggcacggacccccttataggttttactctgcggaagtggggtgggtctctgtctagtccggggagcccttagggagctggttgcctgggcgatgatgggtggggcagcgtttgagcccaggacccctgcctgcttcctagggaggctggtgagccctgctgggtgggcgcgatgaggacgccaggcgtgggggccctgctgccatcgcgggagtgccccctcgacagcttcccgtcagtcctactgcagaggggccaggacagcgcactctgggtcctgaggtgccgcgcttgacggaccccagagctcggacaggccgcttccttcgtagatggcgaagctggggtccagcagagggcggtggcaggtgcttgggccccgagggtctcccctggaagagggagccgacactggagctgggatcacgagaagagttcctacgatctctagggcagaaggcttaggaccgggaggactcgggaaccggtggcctgttgtccaccttagggttgggcagggttcagcctgtgtcgcgcgaccaggcggtggcgaggccgggatcccaagctgcatccagctagctctagtccgcggcccctttaagggggggcggtgcttcagtctgggcgcgagaaggcgctgcgtcacgtgcggggccgcagcacggacggaagcggaagtggcggcgtgcgtgcggcagtggagacggcggcggcggtggctggcgtcaggctgtggacgaagaggcggcctcggtggtaagtggcggccgctgggacccagccaggtaccggtccggctcggccctgcccctttccggccgctctcactccttccctcggcctcgagttcctcgtgggcccgtgggggccgccgcggggtcggggctgcgaggcagcgcccgccgttccatggtaagcggtgctacgggacgttcggaaggaaacctcgctagagcaggggacgcctgggctcctggctgaccacggggcctttgcacggccagggctttgcgaccgcagtgtcttccttctgtccccggtcgtgcgccgtgcccctcagcgcggctcacgtttcggaacacgtctgcctttcatgcctcccgaagagcctccccgcatcccgtgccccctgctcgctgctgccgctgacccttgggcgctgcgctggtccagagcgtgttgtcctctgacgccgtcagaacctgagctccctgcgagctgggactccgccgtgtcttcattgcctccagtgcaaagcaactgcttgcaagagaacaaaagtgtgttcaggtgcacagagtagaaaattcaaggagcctgaaagggtatttggtgaagacttgatgtgtttttcccagtcctaacctccaaggcccagttctcccctggggcagagagaaacccgtttcttatgtgtctacaaagaaagtctatgcaggaacatctacgtgcgtttctgcaaaaggtcagttactttacttggggcctttatacttaacgtagctcggagagcgccccatgcattcagatacaggtgggattcatccggaaacggagttttatagcaccagactttatcccctttcctgtagaaatttagggtttttgctgtcttttataacgaacaatgctagcttgactattgcttgtacaaaccgttttttgcccaagtcggactattttcttaggttaaattccttggtgcagaagtgcgagggctgtatttaggcccctaaaggggtggtaccaaatcgccctcccccaccagcataagagggggccggcgacacccttgcccaagctggattttgcagacctggtaggcgtgagatagtatttcactgtagcttgtgtttcctgtaagtatagtcgaacgtcgtgatgttcctgttacatctatgttacgttgatcattgttaccactgacagtcgtttcgagattggaaaatatgtttattataaacgtttgactatttaaaagccatttgtattttatcttcttggctcatttttctgttgggtggatggtggtggtttctaggtgcactttacagattaagaaaattcgctttctgtctagtagaagtgttttttttttttttttttttttttttgggactctgacacatttattgctgaataccatttctcggctgacccggaagtgtttcttttttctatctgtcattagtctttgactttgtttgtatttttttctttaagctaagcatctaaaattgttactggtcattagtttttttctctttacggctcctgcatttttgtgtcatctcaggaatatcttctccgctgtaagatcataaaacatttgagattttcttctagaaatgtagtggggtttttttttccccatatatttaaatgcttatgtctaattttagaaagtattcctggtaaggagtaaggtaggaagcaaaactttttttccacaaattgtcccaactttatttcccaaaaaagcattcttttccccactgaagtgctgtctttatggcaagtagatttgggtctgtccctagactcttatcccagttttccagaaccccattgtcttcctgacctcatgtccggaggcccctcctccttgcattattttgcacgtttcttttttctcctgaacagcaggcaagtttatctggttctcccaccgtgatcttctttgaaaacattgagattgcttagattcttagatttacagatcaaactgagataaaattctcatcttaaaatagttgacgacttcatctgatccatgtggtactagttccacaagacactgtgatgaagaggattttggaaatcgaagtatttggggccgcccttccctccctgcgggctgtggatattcacggtgcgcgatgctggccttggtttcaggcagccccattctcaagctgctgcgaactcagcaccgaggcttcggcagggctcccagacgccttcagcgtacactgtgttccctctgcctgtccctctcacatggggtaaaccgagtccgggccttcaggctccaggctgtcaggccaacttccaccctcggcctctccccaccaccccctgctcttgggacccgggaggaccccgcaggggtggcgacaggggaggccagcactctattccaggacgcgcgctctccccacctcccacttggtatggcccggggccaggccacctgggagtagggccaacttcccgttctccattttgtggattttccaggacacacttgttcaagccctgcaacagcgttctcccgggtagggcgcctgggggctgagtctctggtccaccctgtgtcacctgctcctggtacaccccagcacggggccctgggtgacgggacagacaccagccaggtgaccctatggcctaggcccactctggtacccggagcccggggggagggcagaccctccccagggccagtggctggagcatggctgtgggtgtggcagaggcttgcctgagatgtgggctaggcccttccagtgggtcaggtctggggcggtgcccagggctgtgcaccctccagctgctccccaggggaccagtggcctgtcagccccgactggcattcatggggtcccagcatgtgtgtgtgggcggctgaccaagctcttatgacgctgtggctgcattcatccgtcgtcccattaatgccaagctggtgggacccacccggctggctctgttctgcatgacctgagggccctctggggttctggaagaggatggagaccatccctgcttggctgtgattctgtcctcttggcctgtggtggccgtgacctgaggtggggcctctgggagcaggcgcctcctctttcctcccctatggcaggcacctgcctgtccacctctgagtccgggtgtcaggatcaaggtgggagtgcagggccgccttgttaactgggagtccatccagtgggcgcccaactggtatcagagcggcccaggggccagcacaagcccctggtcccacttccctcccggttccgggctccggccacgggccacgtcgatcttcacaacgattctgggctgctggggtgactgtccctgcttccccaccgagagaagtagccgagaccccggccaggcccgcgctccctcggcactcggcgtctcccagccacgacagcacaggtggctcagaaataaggtcccgggacacacatctgcccggccagacagcgagcacctcccgccagaccagagcctattctctccccagcacccagccggaagtggagctcagaacaggcagtgtgtgtgtccgtggaggataagagcgcgactctgggacccgccctccccaatagcctcacggagggaacaggcccaggcggggtgctttatgtgaatgaagcctgtggctgttagcagagtgccctgaaaccccaccactaggctgggcgcggtggctcacgcctgtaatgccagcactctgggaggccgaggcggtggatgacctgaggtcaggaggtcgagaccagcctgaccaacatggtgaaaccctgtctctactaaaaaagtacaaaaattagctggcatggtggcgggcgcctgtagtcccagctactcgggaggctgaggcaggagaatcgcttgaacccagggggcggaggttgcagtgagccaagattgcaccactgcactccagcctgggcaacacagcaagactccatcttaaaaaaacaacgaaaaaccaccgccacctgtccgaccctgttcaagggggaaagctcttatggaagcttttcatcatctttgggaggccaaggaagcggggtgcctgggggtcctggtcccctcccgactctgtgcagataaaatccccggccctggccctgcagtcctgctgaggaggggctgggggtgcaggggttgggggattcgcacgggaaaggaaatgccagccggatcctgcccctgctgcccaccctgtgcaggatggaggaggccttggtgtccctgcagcagctcctagcatggatgccgtggaccccagagatgctccctgcaggaccccacgcaggggcttccttgcagtcggccagcagggtgacctcgctgtgtcctccggttggagggtggcagctgctgccccaccttcccacctggctggtggaaccttgttctctgtcccccaggagcttgcagctgcccccccgccccccaccgtgcgtggtggcccccctggactggaccatggtaagtgatttaacgccttaacacagaaatataccctgagtggctttgggggtcggcgttttggtcacataatgcaacacctgcagtaatgtaaataaaggctatcaccagaccacagtgtcctgcaggagcgccagccccgggggggtggggactttagggttttgttgacaatcaggatcaccgggagaggtcagggtcacaccgtcagatactcaaatgggtggcacagaccgctgagtgcgtcctctgcaggcctcatggccacctccgcagcccgtccggtccctcctgctacggccctgggtccctgcaggcctgtccggaggtggcttccacaggttggcaaaggtcatccgtgaataaacagcctgtgggtacaggtgacaacacacggagaattgaggccatgtctggggcacaggctttactgtgaagcttgcttttgccaccccatctgtgaggctctgcagcaggactgacggttctgcctgattctccagcagcctcagggtctctgtgaccccgccgctgatactggggtccattccctgttttttctgttaccagcagtacagtgcacaaccctgtgcactctttccttacggatctttcttttttcttttttttgagacagagtctcactctgtggcccaggccggagtgcagtggtgcaatcttggcttacagcaatctccacctcctgggttcaagtgattctcctgcctcagcctcccgagtagctgggattacgggcgcgtgccaccacgcctggttaatttttgtatttttagtagagacggggtttcaccatgttggccaagctggtctgaaactcctgacctcaggtgacctgcccgcctctgcctcccaaagtgctgggattaaaggcgtgagccaccacgccaggccaggaatcaggaatctttctttttttctttctttttttttgggtcagactgtcaccctgttacctgggctggagtgtagtggtgtgatcatggctccctgcagccccaacctcccagtcctaggctcgagtgatctttccacctcagcctcccaattacctgggacgacaggcacacgtcaccacacttggctaattgtattttgtgtagaaatgcagtcttgctttgttgcccaggctggtctcgaactcctggccttaagcgattctcccgccttggccttccaaagtgctgggattacagtcatgagccaccatccctggcccttaggagtatttcctgggtgcctttctaggagtggactttaaagcaactccaagcagtgctgcaaatgtgagctgctgccgtgctgccattgtcattattattattcagtccagtcacccccacatccacttttcatatttgtttaaaaagtaagttttggccgggtgtggtggctcacgcctgtaatcccagcactttgggaggccgaggcgggcagatcatgaggtcagcagttcgagaccagcctggccaatgtggagaaaccccgtctctactaaaaatacaaaattagccgggtttggtggcacgtgcctgtaatcccagctactcaggaggctgaggcaggagaatcacttgaaccagagagtcagaggttgcagtgagccgagattgcaccactgtactccagcctggcgacagagggagactccgtctcaaaaaaaaaaaaaaaaaaaaagaaaaagtatttatcttgggttgggtgtggtggctcacgcctgtagtcctagcactttgggaggccaaagcaggaggattgtttgagcccagaagttggagatcagcctggacagcaaaagtaagaccctatctctagaaaatgaaatttaaaaaatttagccgggcgtggcggtgtgcacctgtggttccagttacttgggaagctgaggtgtgaggatcactggagcccaggaggtagaggctgcagtaagctatgattgctccactgcactccagcctgggcaacagtgaaatctcatcttaaagacaataataaaacattttttattttggaatagtttgaggtctacagaagagctgcacgggtggtgcagagaatcccatcaacccttcactggcttcccttgtggtaacaccccgtcaaaaccagaacattttctttttttattgagctggagtttcactctttcacacaggctggagtgcagtggtgtgatcttggttcactgcaacctccgcctcctgggatcaagtgattttcctgcctcagcctcctgagtagctgggattacaggcgcccaccaccaaacctggctaattttttttgtgtttttagtagagatggggtttcaccatgttggccaggctggtttcgaacttcttacctgaagtgatccacctgtctcggcctctggaagtgctgggattacgggcgtgagtcatcatgcctggctaaagccaggagattaacatgggtacagctctgacagtgaaaccccgggctctctgttccagcttcctgttttcccccaaagtcttttcctttcctggcccggcccccatccagggtcccacatggcatttcatccttatgtctcttgagtctcttaaaagtctatcttggttcttcaggctttccttgtctttaatgactttgacagtcttgaggaggcctgctcaagtgttctgtaaaacgtcccctcatcggccgggtgcggtggctcacgcctataatcctagcactttgggaggctgaggtgggtggatcacctgaggtcaggggttcaagaccagcccggtcaacatgatgaaaccctgtttctagtaaaagtacaaaaattatctgggcatggtggtatatgcctgtaatcgcggctactcgggaagccaaggctggagaattgcttgaacccaggagggagtttgcaatgagccgagattgtgccattgcactgcagcctggacaacaagagcgaaactctatttccaaaaaaaaaaaaaaaaaagcccggtgtggtggtgggcacctgtaatcccagctacctaggaggctgaggcaggagaatcgctgaaacctgggaggcagaggctgcagtgagccgagatcgtgtcactgcactccagcctgggtaacagtgagactctgtctcaaaaaaaaaaaaaaaaaaaaaaaaaaaaatgccctaatctgggtttgcctgtcttcctgaggtcacactgaggtgacagggtttggggcaggacaccctcctggaggcccctttctcctcacatcctagcaggggtcgccgagaccctgacgacttcacccctgatgttgacctcggccccctggtgcaggtggggtcactggatgtcccggggcccattgccatcgtctcctgtccctgccctgttctgcggcagcgagtccctcagtccagcccacactgggcagggggtggggggagttttatttagaagatgaattttcatacagaaaagcctaaaaatgaaaggacaaatggcccatcattgcattgcttagatgcctgttgacattcagaggcatgtagtaaatacacatggtaaaaaaaaatgtttgagtactacagaaaagtactattaaaactatcacaaagcaaagacccgactgtcttaaatcaagaagatatggcagttccagtgcatgcgcgcacgcacacacacacacacacacacacacacacacacacgtccttacatattaacccctcttctgctgcatctttgttatttactattgtttttatttatttgagagggagtctcactgtcactcaggctggagtgcagtagtacaatcttggctcactgtaacctccacctctccagttcaagcaattctcctgcctcagcctcccgagtagctgggattacaggcggccccccaccacacctggctaatttttgtactgttcgtagagacagggtttcatcatgtcgaccaggctgttcttgaactcctgacctcaggtgatacatctgccttggcctcccaaagtgctgagattacaggcatcagccaccacacccagacaatctatcactatttttagagacaggatctcgctctgttgcccaggctggggtgtatcacagctctctgcagccttgacctcggggccgcaagcaatcctcccgcctcggcctcccgaagagctgggaccacaggcgtgcactaccatgcctgggtaagttttgaatttgttttttatgcagacaggggtctcactatattgcccaggctggtcttgaactcctgggctcaagcagtcctcccatctcagccccctaaagtgttggggttacaggcgtgagtcactgcacccggccctgcagccttgtttttggccctcacctaccttggggtatccatgttgtgggtgcacccccggttatgtgacctctgccctcatctgtcctctgggagactgtgttctttgccctctatgaggcaaggccccagttcctggctccgtggcccctctgagagtcccgttgtgttcttcctgccctgctagagacccactcccagcaacacctgggtgctgtctgtcccctgctgagctttgctccatagccctcaggcttgggaggtccatctttggggctgggaggagctgtccccctgatcctcttgggcgctgtcagggaagggt

SEQ ID NO: 317 - DNA, 1555 bp, Homo sapiens
ggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaagtgagcggcccgggcggggacgggggcggggcggggcccgggccgggcgcgaagtctcaccggctccacgaccctcccgcagcatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaattttagg

SEQ ID NO: 318 - protein, 236 aa, Homo sapiens
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGMRVAFPDTKKTYCFDAFPK

SEQ ID NO: 319 - DNA, 41874 bp, Mus musculus
  misc_feature (1)...(41874): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtccccagcctgccaccctgaacatgcctgatcttctctgaaaatttatgtaaagttgcttttatccatttgatcttatgtatgaactcccaaatccataagtatttttttttactggatattgtttgtatgtgatttgcaaggaataaaggaatcattatgaaactgctgacccaaaaggaagaatgcaagaaacaattttactggctcctgtaaccttaaaacatggtgggatacagatagccaactggtagtgagagcctccacctctccatgtttaagctcttctgtctgcagcatcagcttcacactcaggctggctctccccgtacagtagccaagatggtcctcagagactgcaaggtagtatcatctgtatctttggaatctctgaacatgagtgattctctgccagcatccatatggttgtccttgctttggtcgtatgttcaccctaactgagcactggctcagacaactagagctcattgaaacgccagtctggtgagcgtcctcttcctgcagtgagaagagagcatcatgattgatgggcaatctcagtagatggggtagtgagggattttgaaagagctgccagaggaagagacaataggagctgagcggatataaataactgttcacttaagtactatgtcttttgaatacaacctttcccctagaattgcgactaattaagtacagttcaaacaggcatcgtctgtttttacaaatttagaagtactgaggggaccttgattccatgtgcacctttggctaacatttcattctcttcgaacacacatgtcatctgaaaaaatcagaatagtagttgccttatgactgtaattaggaaaaaattatatagctgaggatatcttgcaaactagaaggtgctttcaacagaggaacataccatgtgacttctaggaaaaatcagtccctaaagcaaagttaattgtgtcaaagtttatgaagtttttcctcctttaaaaagatgtaatgtcccattacacctgctgaaaacttccctgaggaatcagtccttaaatacagcactatgctttggctgctgatagaattgctggcaagcacagaccctgctcaatagaaacctagagaatcctccacattgctagatttgggggcaatgctgcgaccaagtagttcactaagaaaactagaaacggataggtagtagagaagagttgaatggcaggttggaaggttggcctgagcccaaattcatagttaacaggcagtctttcatgaagagactcctaaataccacaaacttaatgaccaagatggcacaggggtgctcattcccaggaaatgtttgttcagtgagcgtattcttgcaaccaactgcagagaaataagaaaatgttttataggtgatttggtttcatctgctatgtgcacatttcaagggaatgaatcagtcagtctgtttgaatcatctttgtatgttttatttagtcaaaaaatcagttaaatgactcgcactatttcaaaaagaaaaaaaaaaaacgaagagaagtagagagcaagacattctgtgttgaagtctgattcagacccatcacaggattcaatggatggaggcagaaatatatggaagtgagaatatttctgaagtctctaccatcataaacattcaaatttttgtcctagcccggtttggcatagagctaggggagaaagttggagtcgtgaggtaaacacgattctcatatattcaggttgatggccccggagtgacgggtaattgtagaaaagcagtcccagagatcaggattgtcacagttggaacatacattggagttgattggttcacttcaggaatgccagtaaatatttcataaccattccagggtggaaggacaaagctctaatgtgcaatatttgccaatccctgtgaaataacactcccatcatgctgacttttggttgtcaagataaggtggctgaaatgtaagtcgggaagaaactcacaagacaggtgtaactgagctagtgctaggggactgacgcatgctactggttcaaaactcactctacaatcgggaaagatgcccaagaagttaagtgacttactttgggtcatacaacgtagctccattgccacaaactgaaactagcttctactactcgagattatgaatgcattatgagaaaagcatcctaattgattgctaagtctacttaactctatagcctggctacatttcccttctttgaacttctcgccttgagtttaagctgctgtgtgattgtctctccttcccatcactctgtattctcattgatggtttgaaagtaatttaatcaccttcaactcttctcagtctctgaaacatcatagatacccacccatgttttccgagtctaggaaagaacagtgatcatacctaccatgggccagacactatgctaacatctactcctcaaagaattcaaagagcctccctcagaaatgaggtggatcccataatacacctgaccagagtatgtgtctgtgcactgggcaccagagtctgcccgtggcactcggctctcaccaacacacacctctgtgggcaggtcaagtcttaattgcacagaatggtctagaaaatggtgtgtattaagtgattaatagcatccttcctccctgctagcttacttctgatttgctgtcccatccaatgagacaacaacaacaacaacaaaaatctcattcatacatttgctggattttagtttgttaagcatcagcacggtacgtgacatacatataaaccttagaacatgtttcttattttaaaaacataggtaactcgtcagaatgtaaaaacaaaataaagattattctgaagcttctttcacaagagaaaacctaaaagccatgcacactcaatactgcactactgggtcagcttggatgcaaatgagttataagattgcttggccttcccttagggagtcagcattcatttatttaccttcagttttttggagaaaaatataaagattgtgttctcattcctggaagatatactgatgtgtgtcgtgttaagaaacaatttttcataaaatgtactctggactgatatgacaatttgtctcctatccttattttttattccctcttgtttccctcaccagcatcaaaaaaaaaattctagtatatttctgaacaatgagaagtacacttaaaaatagcaagttcagctccagtcgccatatatactctaagatggtcatgtatcttcgaactgtccgctctttttttatacttaaaaacaataagggggagtgggtgtgtaggggagtgggggtgggtgggtatgggggactttttggtatagcattggaaatgtaaatgagctaaatacctaataaaaaatggaaaaaaaaaaaacaatcccatgagaatattgagctgtgggtgcagaggtgaatgaatgaccttaagtcacatggctagacagggaagggctgggattggagctctgatggggaaacctgctccggcagtgacctctctctctctctctctctctctctctctctctctctctctctctctcacacacacacacacacacacacacacacacattcacattcacacagccccctcaacccctgtggcctgtctggtttggtatctacagagtgcggagtgctctgtgttcacacatcttctgaaggtctgtggttcctaatgtggtctcccactctgtagatttcctctcatccctttatagcagggccctccacaaagcaaacatttaaaggtttaagttcagggtctcagtcctttccgtggacccccttggccaaagattttatcctgtttccctgaaattgtttgtttgatttatttgtttgtttatttatttatttttagttttaacagtaaagttgagtcaatggtccgttttgaccgagtgtttgcctgagctgtgaggctggggtcaaggctttgcctgtggatgtcacatttaactgctccagggccacccaaggagccctgcctcctccactgggcttcttgtcttctgtgtcacaaagatgtctgtgcatgttgtgttacacattccaagtgacaccctgggttatcctcagcctgtgcnnnnnnnnnnnnnnnnnnnnctgacggtgtagcagaacgcttggcatgtggtaagcacgcagtgcacatttttgttgtttttactattatatggcttatacctcttccagtaatttagcctattgaagctttcctttgctctctggtattagtgtggctttctggcttcgttacacatcccctgaaatcctatatcctcactcagatacctctacatggatcccaaagaccaccatgtcctcaactgtctgtgctaggtttcttctctttcatgcacgcgaagcagtagccacgacaggttgaatgtatcttatcttaaaggtaagacatcttagcttaatgctgttcttttgaatttcttgctggcctcagtttgcatgctcttctttggttatttttgaacctcttcctccagctgaaatccctaacccctcctttatatccattacttgaaacacatgttcatgtactctgacttacttgtagaacatggactttctatgttctgaattctcactgctcctgtattgtcctgtgacctctcatctctggctctacatggacctctataggaaccttgtgaccagtcttctgctcctggaatcttggaaatactcgtttggagtattgcatcatcagccttatcactcacttgtgcctgtcaccccacctctcaggctctactacttgccaccatcctgcccctgttacgtgcctcccactggtctctgctctgcacaaagccgctgtatctgtgaggacacctcagtcactgtcctccttgaggaatgaactctaacctcatttacagtctggtgtcctcccaactcacacagctgataactcatttgcctctaccaatggactatgagctttccagagcagggcactgtttttgttggtactgaagcagtgttagtaaaagaagggaaagtcttgcaaataagcatacatctttcctacaatttaagagtgaaacccaaacaactgctgttgccttctgcttgttcttcctcaaaacacacactccgtgcaccttaacagcctttttgaaagccgctattaaatggattgaaactactctttgaagggcaacagatagttctttcctgtatgagctaggtgcctcttgagaccctcacctggcttctgtaaccctgaaacaatctcttgatgtctcaatgacctgagccttcttgactcttcctttagttcttttactgtaggtattcgcccagatttaactcgctgaccatctccttattcatcttgtcccaccatgccaagcatgccaacctaggttttagttatcagctttttgcagtttgttttacacagagtcttgaatttgcatcccttcctaattccacttgctaccggatcactcaaagcagatgtgtctcacctggaccactcacatccctcgtccataatggcagctctcctcagaaggctttcattattcacctcggttccttggcataggtgttccatctgctcagaaaattcattcctcatgaattccaagcacctgattcctgataaatagcgtgaactgtcctaatcattcctatgggagaccttttctcggttcccattacataataaaacttggcatgcttaaaatctgtatcttttagccaccttcctattgctgcctgccatgctgttgtaactcagtctacttctgcccggatgactccccatcatccttaccttccttttattctgtctagccagatgtcaaatgctacgtactgaactatgcgtcactatctctttctgttcttaggggcaatatattgcttctggccctcttttacttcgctccaggccattatatttgctggtcaaccatttctttaaagctcccaatttttagaaatgcaagagaacctaagtcagaaagtatggactaaggttcttggttttgacccatactacttatctttatttacacagagattcggtatatattagtttaatgccagactatgtttcaggcttctctgtactcaatattggaatatagtaatgagtcagacagatgtcgtcctnnnnnnnnnnnnnnnnnnnnctctccgactcttgatgcttgtagtttgggatttgtcctgtatggagtgtcttaatgccaggtagtattgtcagtctatgtgtgttacatagtagccattttttttaggttctgtgaaaggcaggaaccatgagccattttccattttccatagtgtaagcacagaattatgcacatattagttgcttggtgactttggtgtggtttcatacatccaaggttagtagtctttgccatcactgtggtgccaaatatggttttaagcatcattcagctcatgttaggtaattagctttccttctaaagcctctcttttgcataacaatacccaaccccgcccataactattatcagtagaattcacatgtttttaacctgtgtcccttatgttttttaaaaaggaagaacaaaccagttatggttcctgggagaaaaactggtccaattgcataccacggaatactgaaataatgttctttttactaaagagctttttggcttgataatgaacaatatgttgttttttcctgggaaatagttctaaaacttcagttccgaagattaaattttactttcacgcatttctgcctgctgtttgttttgaagtcctggtgatcttgcattaagcatttgtctgtatgaaacaataggttaactatagccaaattattaccataccttttccctgcacacacacacacacacacacacacacacacaaatcctataaacagcgtgtgattgcttgcttctaggatttatgattgttttcttccaaaaggaagctaaatttagcctagtgattctacatgctcccaaggaaacaatgcctgctgtgatttctagaataaatgaatctgagccacagttcctttacttgactaaacaagaaagtttaagcatcaacctagtcattagccacagatagaaacccacattaagcaagcagcaagggttaagacacaatgtgctgtgtttcttattgagctgctgaatgccattcagttgctgtgtggcctcaacacagaacattgtttgcatcacagaatggtccttgaacatgactcgtttgtggcctgacttctaaaattaaactatgtggagtcatgtccagccctacaatacatctttatgtgaagctagctagcagtttttttctttttcattctatgtaaataaaattccagttaggaaatgttatttctgatatcgaagctggaggagtcatgcttccatttctctctttgtttctaatgacgactaaagggctcttgcctgaatgtgtcttggcagatcaactcctcacaatgaaggctcccaccgtgctggcacctggcattctggtgctgctgttgtccttggtgcagaggagccatggggagtgcaaggaggccctagtgaagtctgagatgaacgtgaacatgaagtatcagctccccaacttcacggcagaaacccccatccagaatgtcgtcctacacggccatcatatttatctcggagccacaaactacatttatgttttaaatgacaaagaccttcagaaggtatccgaattcaagaccgggcccgtgttggaacacccagattgtttaccttgtcgggactgcagcagcaaagccaattcatcaggaggggtttggaaagacaacatcaacatggctctgcttgttgacacatactatgatgatcaactcattagctgtggcagtgtcaacagagggacttgccagcggcatgtccttcctcctgacaattctgctgacatccagtctgaggtccactgcatgttctccccagaagaggagtcagggcagtgtcctgactgtgtagtgagtgccctcggagccaaagtcctcctgtcggaaaaggaccggttcatcaatttctttgtggggaatacgatcaattcctcctatcctcctggttattcactgcattcgatatcggtgagacggctgaaggaaacccaagatggttttaagtttttgacagaccagtcctatattgatgtcttaccagaattccaagattcctaccccataaagtacatacatgccttcgaaagcaaccattttatttactttctgactgtccaaaaggaaactctagatgctcagacttttcatacaagaataatcaggttctgttccgtagactctgggttgcactcctacatggaaatgcccctggaatgcatcctgacagaaaaaagaaggaagagatccacaagggaagaagtgtttaatatcctccaagccgcgtatgtcagtaaaccaggggccaatcttgctaagcaaataggagctagcccttctgatgacattctcttcggggtgtttgcacaaagcaagccagattctgctgaacctgtgaatcgatcagcagtctgtgcattccccatcaaatatgtcaatgacttcttcaacaagattgtcaacaaaaacaacgtgagatgtctccagcatttttacggacccaaccatgagcactgtttcaatagggtaagtcatataggcttctcgcttaaaagttggtatgaagcagaataaacgtctgtcttaaaaaaaaaaaaaagacacggaagctattctgtggttgatgaatatttgtaaatattcaaaatatttacaaattctttgtaagaaaattaagaaattaatcttgattaatgattaagataatatcttatgaaattcatgtggggctgaagaggtagctcagtcagtgaaatgtttattatgtaagcatgggggagttgtgttacaggaaaccatgtgaaaaaaaaaaaaaaacaggtgtggcagtctatgcttataatcccagcactaatatgagaaaaatgtcttgggctcactggtcagccaaccgagcactttccaggccgatgagaatgaccttgtctcaaatgagtaaataaaaacaaacaggtccctagggggtgataaccaagtctcacttctgacctccatgtacccacacacaaaaaaagtaaacccacgtacacagagagaaagagagagagagagagagagagagagagaaagagagagagagaggagaggcagagtcacagacacagacatagagacacacagacacagacacagaaatagagacacagacacagagactcagacacagagacacagacaaagagacacagacacagagacacagacacagacacagagacagagacacagagacacagacacacagacacagacacagaaatagagacacagacacagagacagacacagacacagagacacagacacagagacacagacacagagacacagacacagagacacagacacagagacacagacacagacacagagacagacacagacacagacacagacacagagacagacacagagacacagacacagacagagacacagacacagagacagagacacagacacagactcagacacagacacagacacagacacagacagacagattaataaaactaaaagaaaatattactttaaggcttagatttggattcccatccaacactttctgttttagattgatgaccattaaaaatggtattttttacaggaaagcataggaaaattattggtggttttatttaaataaagtagaatttggaatctataagtatagaattatttttctgctagccctttgatcactttgtgacagagaaagagtaccaacctaagggggggtccatttctgtcttgggaattgttgtgttgggcctagatttacacatagagcatggctgtgcctcctaacaggggaccctcagggaccataactgaacaaatagtgtcactttgagtcttaaaaacacttggtctttggaaacatgtgtcttgcccaagcagttttcagtctaagaaacggaggttgtaagtgcaaccgggaagagcagtctctttggaagagactcataggaagagaacctatgtcattccgctgagagggactggggctcatgaacacgtgccggatctcgatgagcctggggtactttcttagatggaaaattatttctctgttttattgagttcaggaactacaacctttggtgaaacagacaaagcttccctcctttcccctccaaagtcttatagtacacaaaacacggacacaccagtccctacgaagatgtactgcccacacacatgtttaatatacattgtaagctctctaaggtacaatggaattcttcatcaggctgatcttttttcaatagaaaatattacaaaagaatggaagaacactgaaggcctttcagaaacctggcattcagaaatgcaagtgcgatactcgtagcatctttaacaaaaatgctttgcccacagactgtaggctagttgagcaacacaagtttaaagagcctactaggagttccccatggcttccagggcttatgcccttgatgcttggattttgtactgttaaacgttaaaatgagccttgattttgcagggcggaccggtatcttatctcactgttttattttgtacatttcagcctcccacttgcaagcatccttactcaatttagaaaatctcaaaaccctctgaactttatcttacccgctttgcccattttgtagtgttccagggggaacaaagaggcaagattatccaataaaatgcaggccagttttatcacgaaggaaaaatgccccaaacgccatacctgaaatcattatcactcccatctcaaaaaaattcttgtggaaaacaagatgtaacttgccaacagtcttcgtgcgagggaagccaagtttcgcgctggccaaattccataatatgaaatacctgtagacatcctcttcttctttgcctgttaaccttctccatttactaatggctgaagttttgctgaaactgagactacacacattttttttcacaagcctggcccacggaaagagttccaatcgtcagcctatagtcctagctttgtcctaaacgacaacaaaaccaaaatgctttacaggaccgagcccgtaaggaataagaggatcatctaagcaatacgatgactccggttttgcttggctgattaacttggccagatatcagatgaaccttctaataatatcttggagtatagtctttatttttagcatgaagtttcatgctagaaacacatcaggcagttttgctattaatatctctaatatatgtatgggcagacttaagtgtgttctttagacaagttgaaggatactgtggtggtacctatctacttaggctcctgcccagtcctcagtgtatgtgagaagatctatcagagggactctttgcccttctgtctccttgtcatacggaaaatgtatttctactgcaggatcaagcacagggatgccaggaaagaccatctattcagggatccagcagatgtttcaggagcaactgatttattgatggtcaagttatgctgccttctctcccctcacacttcatgactgtatctagccacagtattttggggcattttctcagatctgcaacaggaaagacccctttgagtcatctgataattctgagagcacattcttctttacctgtgtcttacttgtgcttaaaagcttgtctctacgtataatgcatatgtagagaacttatcccaagccacaagtatgcatccatggaataccagtgctgttgctcataaccttctgtaagaatgtggtcttgattttcacaatgcacacatttttttttcctgttgaatttgaatgtaactcttaaagggcatatttacagtgatatctaactttgaattctatccatttgcatatccacaataatttaaaactcattttaaatatcttttctgacctttctttaacctattcataggtaaaactttataagcatcttaagttattatcagttcatgttattctaggctagtgcatattccattaggaacatgttaatgtgcaaaataaaatcactgagaaaatgtccctctaatatggaaacttgataataattcaattttagagggaaaaaaccctcttccttctatatgaagataaatacaattatacatttattcatttagttctaatttctagcatctccaccaatcattcataagaaattagttaaattgaaagtccagaaagaaatatttaagaacacattgagatagtttctgcaaattcaaatcaatgttcttttaagtcttttctatatttacatcctaaatgctcccccatctcagttcccccctcccagagttcttcacatcatcccccctcccttctgcctctgagaggatgctctaacaccccccccccagcatcataaataggagaaattttaaaatctcacaatcagcagcaatcatattctggaagtatactatgtattttatttggagacctgaagtaccacattttagaaatgattttttttttgtggatgttgagatagggaagatgttttatataaagtactggtaattcgttgcactgttttccttagagcaccattaccaaagttttgctctattataccattaccaaagttttgctctattatataaacatctgaaaaggtaagcttgcagtaaatgtctccccaacaacttggtcttcctttttgtttgtttgtttagttgttttcatacatacagcatattttgattatatttcctccccctcgcccaactacccccaacctccctacccacccaactttgtctctgcccccacctctcccttcctcaagaaaaaaaggaaaggaaagaaaaaaaaaacagaaagacaaaacatattagaaccaagggcgggggagaaatcacaccaaaaaaaccacgaagtctgttttgcgttggccagctttgcctgagcatgagggcttgtcctggcatgtggttgatagacttggtgacatcctggtaatcttaatggtgattagtgcaccaattgagggcaccaatggcatttggtagcagccactcgtgtgtgaaaggcccggtttgcagcactcttgctgtatgacctctgactgctgtatgaactcctcgcagttcgggtttcatctgcaacatgcaggtaacacaacctagttcacaagcttgcacatggcacaataagatgactagaaaacccagaaatcagtagagcctaatgagaggaacatgaagcccaaatatggggtcagtcctgcaccccattgtgttctccctggtacccagaaaatgtaatttacattctccagacggtctggcctcacgccgaagctatcatgtggacaagtacaatacccaacacagtcctgactcggtgctatgctcatattaaatgacagctgttgctatgaggatgcttgtctaaagagaagtggactctaatgacctgtttatttctttaaaaaaggcatattgtagttcgatccctcatgggaatctttcacttccctccctatatattatgagtgaccaaactctatccaagcttaattagttcatgcttaagtttgctgactctgagcgggacaacactgaatcaaattgcattacactccagacagaagtctgcttttttctctaacttaaaatttaaactagctatgacaaagcaagataccctgctgctgtagttaaagtgaaactttgcattaagaattacacaatacagggccagaaaaaagtcaacctcctaggttgtttttattgcgcttccttgtttctcaaataccacttgcactccaattcaaagagtagccaactgcttcccaaaataaaggaaactaaaggtagtaattttccatctccgtcctagagtgccaaagttaaagggtcaccactcagagcggtcacagagagaaaggaaagcaattagaacaattttcaataagagcagaaatcaaaacaagatgcaaacaaggagtatcaggcagaggcccgagaaacaagccttcggtgatgtttcttatcactaccataaagatgatggatggataaaattgagttacatttaagttgtaaggaaagaaaataattgcagcgttccatcaggaaaccacaaggtccattattgatctgtcctcttcagggcatgtcttgtaatatttaataaaataaacagagatttataactctctataggccgtgtatctataatcccccacactattcaaactatggatgtagagtgagcattagaaatagaatccatgtcatttgattggtctggcacggcttatttagactgcagtgctctcgagggaatgcattttgtattaggagtgataaatgtaaagtcagattataaagttgtttcttacttcctgtgttcaagaatgagggaacattaccctatatgtacactgttactggggagtgatgttagacagttctccaaacttaaacattaaatatcttggctgtacagcaaatgtaattgctaccataacaaaatcttgtaagagagaaaatccttgaggtacatggattggatatactttatgtttttaaaaatctaagtaaaactctatttcctcttgcttcctttccatagccgtctctcccagactcagcacattgctgcctcctgtcttgcttgaactctctgtgcatacaaaacggcatagtgcaattttttttattttaaagaaacttacaatcaatttctttccagaatttcaaaacaccctctgagttcattggcatgggtggcatggggctgtgagggtggggtgtctttaaaaagtaacaaatgagagattagtgacttttgcctttctccccatcttcctactaccccccttaaatcatcacatatctgttcctgccccccccccagaaaagattttaagattctatagcatgatgctttcatcaaccaaatgccaaaggataaagtcaaagttgaaagtcaggcaagacataaggcagcctttacctgggcggcactgactcaggatgtgagtaacagtacctccgtgtgtggggtacttgaggttacccgtgccccttgcgtttgaagagtgcttcctgtcctctctgtcttctaaagcccggcatgactgtgttaagttgctgatccctggatggtgattcatttggggaaactgctgtgtcagacaataagtccacaggaaaagaaatcaatcttaaagttgacttttgaaaaaaggcaaaattctgaagccaaaacaccgagatctgaagtttgcattcccacgatgatccacggttggagattactggaagcatgcagagccccacatgttgataaggataataacctacttgagtaataacatatttttttaagcttactataatataacacctcaaatcttgggtgtcgcattcctcctccagacttctgtcttatcaatggccatccctccctctgctcttatctcgtctctcaaacaagaaaagcaaggaatttagagaagactcaggaatttttcctgttgcttattcttggtttggcacaaatacaagtacaatgtgtttaaaatgagcaagcgcccaggtactgctataaagtcacacctccagcatccatggagggctggaaagtaccagggaaatgaaatcaaaggcttgtctactcttgaagtcaatacaactcccttgactttctttttcttttttttttttttcatttctttttctttcttctttttaaaatcatggatgtagtaagtgactctaaggtcctggatatgttccagtcggctcattatatatttttcaaactaatcttttccagaagagttcatttgcatgtgaatcactggctaagcaatattgactacttattctaaaagctaggctttaccttaggaaagcaatttgtgggagctaggttaatgtgggagccgatggactgtgtgtgcacagacacttcacgaagattttccagtctttgggagggaaaggaaaatgtctagtgcatgctatcatagaataaaagttccttttgaccatcctccgtgttcatacatggccacagatggtttctaaatgacattattctaaaacgaaaagatgcattgttaattccgactaatgtctgacttcccttatcttatttggggatatcgtcgaagggaacatcaatcagagaacatgaaatggcaggtgacacttcagattatgctctatgtcaaaggggtgagttaaggtcagtttgagtttggaaggcactgttttgtggagatgacttcatgaaaatccagggagtttctttatgtgttgtcatcacagaatacataggtggttcatggtggcctggttgtaggtcagcatgccgggaacatgtaaatgtgaatgcgaaatttcttattgagagtttacattggaaatatctgtttatcacttagcatcactagactaacgtgaagagccacttaggatttggggacaaagcaggattgaactggctcaccagctctgagggaatcaatagtgcttagagctaatgcactaaacaggttacaagcactaatgcagtggcagtcaatagcaaaagtgagtgcctctaagaattaccttgacaatgaaatgtgtaatattttccatttattttcagctaattacatcacaagcttgttcccccatcttattagcttaagcgaagcacccagaagcctaacagttttatttaggacataaaatgagcagatcactattttcagcaagaatccgaggaaaggatttattatgcaaccacgattcaataggaagcccagtagttgcttcctgagtgctaattctattagtagggcagtggtgagccacctgtatgtgacacttttcttcatgtggcagtgagtgagtggagatggcagtaaatggccaagtcactccagtggacaagatgtcctgataattcatgaaatatgatgtgacctgtgaatacaaatgaaggcaatgtctaaattttatgatttgatcttaaaagactactctggagtgataaagttaactcttccacaaagcttaaaacagtacaaaatgtgttctatctttagtatattttgtttggggcaaacaaaagccaagtatccaatctactaataatcacagccatctcatggccttttgtcttaagcataagctgctgtgtttcactttaacttttttaactgacttggagccattagagcacattattttctacttaacaaaaaatatcagaaggtgtaatgccctggtgggagtttaccttttgaaaaatatattcagccgggtgtggtggtgcacacctttaatcccagcactcgggaagcagaggcagaggcagaggcagaggcagaggcagaggcagaggcagaggcagaggcagaggcagacggttttctaagttcgaggccagcctggtctacaaagtgagttccaggacagccagagctacacagagaaaccctgtctcgaaaaaccaaaaaaaaaaaaaaagaaagagagagagagagagagagagagagagagagagagagagagagagagagagaaagaaagaaagaaagaaagaaagaaagaaagaaaggaaagaaagaaagaaagatataaatatattctgttatgcaaaattgtcggtgcatttgaatagggcttggtgtaaagtaggtaatgtgtgcgtggctagaagctgcagacctcatttcagctaggctcattcactgactcacagcctaccacaccatcagcttctttggaagttggtctctgctgggctggattatttcttccttggctccctgcctctctttgtgtcaacactcagtatttgcgaagacattcttttttcttctgcacatgaaaagggttctcccattactcatgagtcctgtgacaaagaatcacgcaactcagaggacacacaaataagccctttggaagccctcagtattatgaacatcaatagaagttaaggcaatgtgatgctgaggtggcccaaatcccgtcgtccttctgtatctgcagagtgtatctacccttcacaattacatccctttttactgtgtttcctgctcatgaggatcatgtggctgagaggccaagtggaagccaagtgctcccaggcctcacgcacatcttatgagcacctcctgaatgcccaagtgtgggccctccaaccagggccatctttgtgttaccagtcctttcatctctggtgcccttacactaaacttttatgtctcccgttaagttaatcatcttcatctgctgatctgtttaatcacacagatatctaagtgagggaaggtctcagaagggaggcacttgccaggctttgctaccaaggcattatagatcacagacaatacatcgtgtcaacttgttcttagaggactctaaaacaatctatgcatttgaacgtgaaagaaagagcatacaaatcacaggcctatacaatctgggtaaattttactcaagtatttttatgaataaattgtagacagtgttttcatcatctgcataaactacaaagatttgaagtgcaggtgtaaaaatagtctgcaggattcaaagaaacactcaccgttctctgtgtttgtctgttcactgttgtttggccaacaacaaagtgatgtttgccaagggaataggaggcatttaatcttcagagtttgttcctgtgcctacaagtcagggaggtcattggcttgccccttcctgcagcctgtaattacaggcagaggactatttattttccagtaaagtgaccaactcttgaatgtaataagactgcttataagagcaagtggatgtaagaaatatatacaattttggaaaagacaatgggaaagtgaaactattgtcttcatattttcaataatatgaggtagtctgagtctctagaaatgacctaaagtacagtacaaaaggtgaacctcaggtcacgttaggtagtcccagaccttaacattgtgaattattatggaaaatttacaatagggtagaatatgtctggtaattcattaagttagaaagtaattagtggctccaccatcatagtaaacaagaagcaataattatattagtaagaatgatttagaaatatttctactttggaaaagagcagttacattgggttagctggagacactgtggggaaaaaatagcaccatttcttgctctccaatatttttaagattaattattataaaagcagtgactccgggtagagttgggtatgtaacatacaacttcaattccactatcgtcccaatgctagaactatccataggggtttaaaaccacactatgtaagtggaagtttaacgatagtaggtgaaccttatgatctatgtggcaaagccaaaagttctaagttgttgacatgtacaaagagaacttaaacatatgccagccttaagggtggtgtcacattgtggtaaattgtgacaatttttccacctactaaaaacaaagtttcctattgacaattgaaacaaaacaagagcaatccatcacattttcctaggatctagggtagagaaagtgccggccactggtgtcattgtgaccctagtgaaaagacaacagtctaactgagtgtatctcagctcatgaagagaagaggtgtcagccatttgggccgtgaacacctgcattttcttaggtaaatactgcttttgtttcaaagctttccctgggttgtggtccatggaagccgttagaactctcagagccttatctaatgctctgtgtgttagaggttcaagaaataattaagacagtcgaatttttcattttgtctgtaatatataaaaaatatctctcagagtgaatggatggataattatttcaataatgaagatagtatagcttcattttacctttcttgtcttagcacagtttttattttctactctgagctacaggcaaatcacaaaataaattgcactattgtttgcttaaggctctctttccttcaaaccttattcctgtctgtcaacctcagcccagttccccagtagctcaggaaaacctccactgggattaagtaatcatttacacaacctctcattcattaacccatgttgacattctccttctctagcccatcctcgcttaaggattccttaagcaccttatccagcagctggggtgggtgcaaacaacgcctatttaatcaagaaattgaatatttccaaggaatcgtttggcctgcctcagccttcttcatgaccacaattgccttctatttcatcttcaaagtaaaatctggattcttccctagtaaacatgtacttttaaaatccttcatttatttctgcgtattcataaagcagaaatagaaaatattattgcttctaaaaaaaatcttttagtgtgctaaaaatgatgccagtaagagaaaatgagagcatcctggatttgttctcatctccacccaatctgtttgtctcccgagtaccagtgatgtggtaatctttcttgaaaacagcgtgtttttatagctgcaactttagaaatagtttgggggctcccccaatttcttcagagcacaatccacacttatttgtatgatattcaaggagtgtcttacttgggccctggtttccttcacatggagtagaatgccagtcaagaactaaaactcctggcagagggtagtagaaacccctgacttgcagggctggccacttcctagcattttagtgtcccaccatgtctatgccaagctactactgatacaagttttgtcattgataaaaaactagggacaaacctgaccatatggccccatgaactggtacacagcagctctggtttgggctctgccctatacctgggctatgtgtgctgtagcggatagtgtctgtgagtcgccctcccagcccagccttctaatgcctgtcccatggtcagccttcgatttccttcaacactcgttttgtcaaacttacatttcttctccattttttaaaattctctccttagatattatcttctccaggaactgttctctagattccatcccattcagggtgacgaactttggagaacatctagtggataaagctcaagttacagtgtcaccatgagtgatagtcacagtgggaacctcccttgacatttgccctggaaacccgcaggttttcaccgctagacaccaaccatggtctcatgtttaaaatgatgcatagattaacagaaaaacgaataaatgtctgtatcagaaccaccattatggacacagggctcctcttactccgcatcacttcacaggcatgaagggtgtgctaggtagagaagccctgtcttgaactagaaaggcccagttgaaaagagagaactgggttggcgctcaggacaccttgcccacttacacaggttttgataagtagtttcaagtctgaaaccaaatgagaaaacaggaaatgagtctcactctataatgctaagatggaaaagaaggatatgagctaatgcccgttggctccatgactagaatatagtcatgggcttgcaggagcatactagggcatgactgaacactctcatttcatctgtctttctcctcttctgaccttctgctaagacatctctatagtaatagggagcgttctgagcctacaaagaagctggggctcttactgtattcagggaaaatggcttccttttgaaaggttaatgttgggggtttgttttgtgccttctggctttctaatacttctatgaaataagtgaattacaatttggtttctattaactaaatagggaaagagagagaaacttcctcatagcatccaaacctgccatacctggagcaatttgatgaatcactgtcgctactcgctgactgaagctcagtgtgaaggctgctaaccaaaaccacatgggctcagcctgttttatatctgattcaccttaggaaaagacaaagattcgaaagtcttaacatttccaattccaaagcccatatcactgtagaatgttgagtgttctaaccaacatatatattggatatatatttaagtatgaatgcaagcatttgtacacatgcatatagaaagccatagccacacataaaatatattctgttccaagaatctttcctcctgtcgtccaacctctgccaagacctagctctgcatcggtctctgctgcaaggttctgcagctgttgaaggccactctgctctcatccttctctagtctgatagcacatgctgccagtgcagaactgtagttacctatctgctgagctctttgtcttacataatcagttatgtgcttttatgtgttggtccctgctctccctatgtgcacagtgccttcagaagatgggctgaaaaaaaaatgttggcacacatgccaagttgagtgcttttacattttttaaaagttacatatatacaagaaaagtgaaatatgtcacatgggtcctatgatctttaatgtctaatatataatttaatgtatttatatttaatataatgttttaattctttgaaaacttcataaacacatgcagtgggtcctagcctactcagcctctactcaccctctctggcttctcctcccccttccagcttcatgtcctttttttataacccactcagtccattcagtgctgttttatatgcacatgagtgtgggtcattcatgagggcatgaacgcagtctccttcgagtccatcttcaaaataaaaggattccactaaggatggagccttgagagtccctcccctctccatgctggaatttgtaactggtcttgagcaggtatccacagtaaaagtgcaatacttttgtaataaaataatggaaaatatgaccggaggggtgtagcttggtggaacatgtgcttagcattttcagacctttgggttcaatattccacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagtcaatgggtgcagaaagagtgacggaccatcttcctttcatgctgtgccctgagaatatgaaacctgagttctcttcctagcacaggacaaggtccagacaacaccaacttttcacatgaaagactagtctgctctgcccaagagctgattcttctgcaccatacagaaagccctgccttcggtgtggatcactgagaagttctagtgactgggcacttaaaccctgggatggtaacagctcaggatcagtcgggtaatgggcaatgagcctggctaccacgaaggggagaagcaaacatggaccagcctaaacttcctctgtaagaagcgtagccagatgttgaagtccctgcacccctgcattgagcagctccactgcacccctgcagggatggcatttaggaaagaaaacctaacagttgagtgtttagctaactggctaaaagaatctaagagacagaactttccattttgaaagttgagtcacccacaaagccattactataccttctgtacaaaatacgactctgaataacgtttatatgaaaaaaccttatgttaattttccatggtcaaggatggaagaactggtatgagtcagatggactgatttaacaaaactaaatcttaaaacgttatctacatgactgatttaaattagctatagatgagctaaatctgtcctatagatcaattaaaagaatcgctatttcaaatatatcacatccttaattacactgaattaaatgtaattgcatacttgcttcatacatcacagtgttaattgagggaaacattttgagtcaaacctactgaggtttctagcacttcaattttctctttattaaaagaaacaaaatatatatttgagtcatgtttaaaaaagtaacaggcaagatatgataaaatgattttaaaaaaaaacacaccttacacacataaacacaatacactgatttacttaaggtatcacttcaaagagtatagtgcagagtaattccatatatctctaggatgagatataagatagagcccggggaaaggagtttgtaacacctttaaggtgtgtgcctgtgcatggtgcacaatcgtgggtgtgcatatgttgaggtcagggacatcctgccaggacatagtgagtctgactagccctatttgctttgcagtgtggacacacaccccccatcaactcctccagtccttctgctagtccccaactgtgacccctgagctcagtctgaaggttggctccaagcatccatatcgtgactccttattaaaatccgattgctaaggctcagagagcatgcagctctgtagaccaccctgcagcagtctctgcgttgcccaacattctcagcagggagagagataaggagtaatgtcccctctccctcagcgaatgctgggacattacttcttcccagaagccagtgttcttgttgctgcccctcctgctctctgctttgggaaaagacaaaaaagaagtagatatggatgtgtgcataatgaaaccagaatatacgtgacgctgtttgtttcttagctctaaattgcacaatctttcaagatcaaggagcccttagatcctatcccagcattgtgcaatgtctccacacaggaattttattgggcagagatagcaacataaatccttgaaaagatgagatttggagaccaatttcctgaaggaagggtcttgaagctcacaatatatatattcccgtcgacgctgatgctgatttatttttaacctttgcatctgggacaacaggtgtataggggcagagcccctggttgcagcacattttccactgaagaaaaagtcagcaagctcctgtagatttgtaggcactctaagaaacgcccagagatcacctcacctgctctcctgctcaccccactcagagaggtggacctgaaagcaagctggttaagagaagggccttatctctggtggctttgcagatacacacatcttacagcaatggttattactcactgacatcacctaggcatgatggaaggaaactgggtcaaaagtattgaggaagttcctatgtcttgatgacagaggccgacaatagtttatgattcaggatggctccacacgatgcacattgtatttgcatctcaggaaaatccattgagaaactctgtggcctaggtcaagttggaggttttaaagttcccagtggactactgagatctagaaggagcaatggagaggctagtaagggaagggacctggccctaatggagcacttcagatggcttaagatttgaaattgttcgttattcctttaaccggcttcccttggctctgggttctacaaaatgaatcagcaatcgccggtcaaaactcaattatcaattaatgtatctctattgaatagctggtacatcccagttaactgctactcctcagaataatctataatactttagtgaagaaaggcttctaattaaatagtgagctagtgctttttatacatcaaaataagtgtccagaactgaaccattttcttaattacgagatacaatagatttagtctctcctaaggctctctcagtttgctaattgattgccaattaaaatgaagaaatcaccaatgcacaaaaatagaatattttaggtggctttaaaccacagaggcaaaacataagaactttacaattccatgcaatggatggtcagccttaaggaatgaagccactacacagtaatataactgaatttttgttattcttaacaataagttagagggcaggtgatgagggtaaggaatgcatgcttgcctagtatgcacaaagccctgagttcaatcataagtaccacaaaagattaagtttctgagttttataatagatgatagtaacaaaggatttctaacatctcaatccttgtcccaaacgagtagctatacataaagaagtcctgccgggcagtggtggcgcacacctttaatccgtacattcatgaggcagaggcaggtggatctgtgagttcaaggccagcatggtctacagagtaaattccaggccagtcaggactacagggaggaaccctgtcttgaaaaacaaaaaccaaacaaacgaaatgtccaagcataaaccttcatttcttttcttctaagttagccttcattttccttactatgttccccctacccccttcaactggcccagatttaccgactcccagctgccatcagcaacacagaggagccagccattctttgttgctcatgaactcctaactgccctatacctgaaaatggtagtttccaaactactagttcccagcttcctactcaagccacgtctgcctggcttatcctatcgttctgttattatttgctagctctctgtttggtgtgatgttcagtctgccacaggcaggatagttttgaaagagcaactacagttgactgaagcctgacgtatacaagggaatgttgagttgccgcataaatagctaccactatacttgatgcgcgagcaaaagctaacatgagaatctacaataggagcaccggaccttgatatgagcatcatggcaagtctcgtgggagactggtgctaaactcacgaatagaggatatttaggagctaactaggtgagtggaggcggagggcagaccctggaagagcaaaccacttatgtcagacttgttattgggaagatgcttgcaacactcgcacagctgaaagcaggcctgaacactgagacacagagaacacagagccagaagatgggtagaagccacataatatgaaacctagtaggccacgttaaaaaggtttaccctaagagcagggggatgaattatatcgtctaaatagaaaggaggaggtattggatcatataaaaaaaataataataaagacgtactgcaatatgggcagctaacctgacagtggcaccggatgaaaagctattgccccagcacagcagaaggatggatggcgagggcaggtatcacagtgatgaagacagaaataacagggatagatctgggaagtagtctgtcgatgaaaaccagcccaaactagaggcccttgggagcagtgaaacctgaagtgaggacgtacctccatcagaacggcctacagacagttctgtgtggccttgtcttgatgggtggttgaagtgggaaggccctgcccaatgtgggtattagagtcatccctgtgcagctagtcctgggagggccaagcaagatagctggaggcaagccagcgtggagctttccaccatggctcctacctccgcttgagatcctgccctgacttctgttgatgatggactgtgatttggacttgtaaaccttgaagcaaacctgtcctctccaagccgcctttggtcaaggatggaaagtaactaggacagttaggaaatgtaacggatggagtttcaaggtaggttacacgggagggatgaaggagaagggaaccgcgaagactcttatacagctagagcgatggaagagtcattctgtgatgtgtataatataaggtcaggaagggacaaagggtcaggctaactgaggtctctcagttctgtggatggagatcacatgtagagtcactaaaataagagatcacaggagaaacggattgcccaggaaagtatggtacgtgtatgggccaggcatgtgtggtaccaggggtgaccctcgaagctttggggaatctgatgtggatgctcaggcgtgactggtcctgcacaggaagcagagaagtaagagagacaccagaggctggatctcggcatagaggacaggatcctcagggcttcaggctcatttcccggcgttgttgaacagtatttcttgtcacccttccactacaatctgaacattaccagattggtgcttgtctttcaagaaggtgcttactgagatatttgatgtacactttaaaaaaaaaatctttctcccaacgatgacagggaagttccgtatgcttgttccattgccagagattcatatgagctagttaacttaatctttgcaaaaattctgggttgtggagactttttttttcctgtagcaatctgttttacagatggagagaataaaacacagatcacctcaatttctgaatgcagaaagattatagaaattgtacaaaatgcacgtgtactcaggaccgagacttgatgaaagcagttggtataacgctcggttacctccccatgaattctctataaaactacttccctcaacttctgtgccccccaaaacatgcacatatacatggattttaagatatatcatagagtgacttttaacgtcatcatcaccaccatcaacatcaccatcaccatcgtcatcatcgtacctgaaattcacttcataagacttgctaaggcactatacactaatgtcaagaaatgagacatttaaagttttgcttttcttcttaatggcatgcaggttcccccatcttcatgagtgtgcattcgaaccacaatgtaacattgagattacaagctgtgcctcccatttttgagagtctgtacacacaacagtgcctggagccccaacagtcactacagacgttcatgcactgtttgtctgttcatgtgactatccttgatattctgagaaaactctttaatgacacacagcaaagtttcctaccagcttgtttgtccccagaatctaacttttggtggccatgttttactccagaccctgctgagaaactcttcgggctgtgaagcgcgcagtgacgagtatcggacagagtttaccacggctttgcagcgcgtcgacttattcatgggccggcttaaccaagtgctcctgacatccatctccaccttcatcaaaggtgacctcaccattgctaatctagggacgtcagaaggtcgcttcatgcaggtaagagcgttcttagggtagctggctttgtacagttatcgctgaaccatgtttaccaacaggctacaaagtgcaagtcaggtcgaagctagagacagaacccaaaggggtaacaacgaggcatgacctactttttatgaagtgggttgcttgtttttgtaaaggttttgaatctttcagcccaaatgtgactgctttaatcttcttgtctagaatcaggatttttttcccccattcataacttttatcacatgattggaaagtaaaaaaaaaaaaaaaaaaaaaggaacaattaagcacttccaggcaatgttttcctgtttcaggggaaaactgggcataaaggagagctattgtgtggcccatgcctgtccatgagaagagacagccacatcattcacatccctgagagacactggcaggaatcagaaagggacgctatcaaaatcccactgtacctcgggctcccctccttctgcaaaggagtggagtctcacaaagaagttcagatagttattttttttttcagagcaggatccattaagaaatgcttctaatggctagtgacagtatttccatacaataaaagttcacgtttcagacttgatggaattagggtttcctagatacaagaatcagagcactttgcagaaattaacaaccccctcatgttggctatattttattgctttaatagttattggtgcttctcaccatgagttcgtgagtaaattctcaattaatgtggagggacggtgacatctgtggaacttctatgaatagtatacgggaaaatgtttacttcattgtctaatatagtaattaattgtataatgtagttgatatcctgattatttaagggcatctagtaagccactcgagagtgatgagattttcctcttaatttatccatcccatccctacatacagtatctatattattttacaaagcagagttttgcaaattctcatcatcttgggagtaatttggatgttggtcatcgccataatttaagaactacaaatcgtggttctctcatgctcgtcggcatgggaggacctctctccagagccatgaagcatgtcactcaacctcctgtctctaaaatgttagcaaacaccccatgacatgaatgtccccacactgtcttcaccctcacagctgacctctcctctctgccccctttcccagtctagtgtgctgtctgcctgcatcgccagtcttggtcacttaaatctattcttgcctgtgaaggtggggcacatattccttccacatacatgcaagctttaacgtatgactgttacctgttatctctgaaatggaatcctatcgcgtgtgcttgtaggcattcttcagttacactgatcactgctataaaagtccaaagagtctgaaggagaagggggcatctggtaaactacttactcaagtgtgccaatggcttgcttccctcatctttatttgtccatttctgttttcttagttccccattacctcaccaatccaggtctacactaatacaatttaacaatcagttacaatttgaaaggtatttttttgagattataaaataattgtatttctcccttcctttccccccttccaactcctcccatatagccctcaccacgttccttcaaatacgtggcctctttttttcactgttagtgcatgaatatatgtaaatttatttgtatatatgcatatgtgtatatagagatataacctgttacatctggagagcagtgttttcttaatcatgaaaagggtcatagtctatttccacatgttaaaatgataataaaatcctatttttaagtaagttagtttaataaaagagtttgtaccatccaaggaatagatcacatgtctgtaacccgataccccttgtaactaaaattctgtagatgatgcataattcttatatcttagtgtgcttgggtggtggggggagctaccttctgctatggtccaaacggtgaaaatgagaacttatttcatgacaggtactggcgtcactgcctgatagatgtgttatccaggtcatcttaacgtcatcaagcatatattaagattctactgatttgctttttaaaaacaaaaacaaaaactgggcaagtgagtgaagccaaggaaacttggaacctgcttttgggggaataaaattttgatagaggagagtaaaatgttttccgggcagcagtggtactgataggagaaccccccccccctcccccacccccacccccccggagcacaaaggactatgtctgtgatagttgcgttccatcaagttttatataaataaacctaaagcatttgaccggcaacagagtcaggtggccaaccacactgaaatccactttgtttacatcaaacacagtagtggggggaggagggtaaagagggtggagaagacgtgagacctggagctgcctttgccagcctgacttactaccaggttctgtcagtgttttgattggacttctctgaatcttgtagccaggctaagtctctacaactctcgtgttagtaaatactgtggcatttctgttacaaaatagaatcaacatatttttttcccctcccaaggcagctgctacacatgagaaacacagagaaatgattttacttccttcctacccacaagcctaatggcaaagttgcttagcagattttttttttttttttttttttttaccccaagagtttgcagctgtttctgcccttcctattgtgctgctggtcagcttaggctgggaacacaagctatagccccagctgttgggtgcaaagtgaatcaggtatttcacagtggttatttgattagaaagaattatattgtttagctaacaatagtctgtgcatggcagaggagacatcttgggcatgttgctaacttttaaacaagtgtattacgtgtcccatgcaggtgcccgggagtctgaatagactggtgtgcatgtgcacccagagctgagcctagatccctggaaacagcgcagtaatagaattcaaaagcggttttggtttgcgcgatcactctcttgggatgctttgaagtagatcacgaagcagtctttttagatagcagaagtaaacacggggagtttgtgtccttccagggaaacctagcccagtgagcagggccatgtgggagaacagcggattctcgtgaagatcataggactaatcacagggattgccagcgtctccccttctgagctcctcatctaatctacatctaaacaatgcttgcttgatttttttttcttacagcacttgtataaggcctttaatctctaaatgcaaagcattgctattaaaatatttgtgcatgactgtcaggctggacagagtcgatatggatcagggatgggggtggggaccagaggcctttccaaggcctgcttcaaactcaactcacagacaattgctatgtagcaaatagtacacggttagcagtgtctaccgcctgggcacaatcacagctaccaccaagctctttggtaccactctggtctttcggcatcatccaatcctttcctgttctggtaccttcattgatgttaaagctcattattttcccttctggtcttatcgggactagttgagtctagcaagaaactaaagaggaaagatgtcgtttggtcatgattattctttatggccatcacttaaaggatcacgttggtaaggtgagagtaatcactccctttccgtaaaccccgttcatttcctcacctcctaccattcgattgcatggggcttctagaccctcatctggcgtgccatatcagggccttccatctgtgggcaatgacatgcgcatgttgagaattactgttgttttctaataggtagatgcaaccatattactccaaaaagggagcattaaattgagatgcatcggaatgaagattaaactcaaacattgtttctctttagggattattaattgacacatctcttataaaatattcacaaaagcatcattaaaaaatgtcatttaaaatgaaaaatacagcactgacctagatatagacctacctaatgaatgttagcactagaatctttttctttttttgaagaaaacatgtgtattgagttcagaagcttccttctttgtgctaagcaagaacttactgtaaataagaatctcaaggtcatgcccacagctaaactttttaagctgggttcttaaaattaacatatacatgctcttgaaaggcatatattttgttcgctatcaaatcacagaaatttaaagcatcataaatatttgaaagcctgggaagatgtggaattttgtttgttttgcttgtggataacaaagagaaagtaaaatttatttcaatggatgctttgtagaaaataaaaataaacccaaaaaccagagagacacataaactaggaaacagatatcattaatttatgaacctttattaatcttaaatattagtagtagatgaactctgttcatagatgaattgtcctatggtcaatgggttttactatgaatttggaagttgcattggttatttatctcatcactgtaacgaaatgctgacagaaccaacttaatggaggaaggattgatttggccttgaggatgaagttctttagtgccttgaatatgggatgtgatcagcagcgactgcaggctgtggcagaggtagctgaggggtagctgagggggcagagacagacagaaagtgaggtctggatagaaacctcagggccccttctccagcagccggcttccttcagccagactccacttcccaaaagtcccccaacctctcagagcagtgccaccagctgagaaccaaatgttcaagcataagcctgcaggaaacatattcacacccaaactctgacaaatgtattggctctttccatttctttttacagtgtcactagcttattaggggtttagatgcttaaatttcgttttgactcttttcaaataattgaaacacagacacaggaagagttgctattttaaaagatttactcatttgtttattttatacgagtgcactgtagctgtcttcagacacaccagtagaggacatcggatcccattatagatggttggagaattgagctcaggacctctggaagaatagtcggtgctcttaaccgctgagccatcatcttctcagccccaggccttgctttttgaatatgcctgtccctataatgtctgcttgatatggaagcactcatatccatctagcaaaaataaccaagcaaagtacagaagaaagctccccagaactagatttttaatgaacttcatgcctttattctgcaacacagagggccctatctttcctctcctgctctatttacctcactaacttttgtatctggtctcccacctctttgagttctgagcttccaatcctaatcagcaattcccactattattttttttctatttcattaaactagtttccttgattgaagcagcagctcttcatgttatggcttctttctaataaacatcgttttgtagatgctaagaaatctcaagctgtccggaagcataaggcctcagagtcattccttgaaaattacacattaaactcaaaggtacagtcggaaacatttgaaacacttgggccttcaccaaggcataagtgggcttcacatttaaatctgcaaatgtattaaaacaacagacatgagttggagacatactatgtccatactatggaccaagagtctgatctatactggaactacagaaaagcaaattaaactctaaatctgtagcactatatctagttataacttggtctgtctatcaatagtgtcaccttactcatatttttcttcttgagtccgaaattccaataatttgagtctttcatggataattggtttgtccttactacttaacagaaatcctggccttcttaacatttaaaataaatcaatatcatagatggtgccaaaactcaagaggagttttgattacctttaaacaggactgtagattttcagttcttattcaagggaaattcactttggtcgtccaacaacttcatacaggtctctctacctccgagagatctgccacgcagacaactgtgtttcatctctcattctgtttctccagtgagagtctaccctgccagctaccagcttctctagaaccctgcactccagaggccactctgaccctgaggaaacactcttccaagccttgactatgggtgctgagcaggggtagctaagcaagggtctccagtgagtcgtagactttcctcttacaacaaagcaaaacaaacaaaacaaaacaaaacaaaacaaaacaaaacaaaacaaaaacacttggtaacaaacacaaacacaaaccacagaaaagtattacttcacacctaaggaaatgtccataataaagaagtggaaaatggggtcagtctcggtggcactcacctttcctctcatcactccagcatttgagaggcagagacaggcagatctttgtgagttcgaggccagcctggtctagtgagttccaagacagccagagatatgtagagagacacgctgtcaagaaatgggaatgtggaatagtacaaacactaggaaataatttagcaatacctcaaaagcataaagataaggttaccataaggttttaaaaagaaaaaaaaagccttatcctagatgcaacccacaagagaaataaaagtatatgatcacacagatggtttcacatcaatatccacagtagcattattcagaggcaaaacatagaagcaaccaaactgctccccaagtgatgtatacgtgcacagaatgtggcctggatatacagcacagtattgcttggcaataaaaaaggaacagggatgaatcttaaaaacatatactaagtagaaaatgccataaacaaaattccagacagtgtcagattccatttatatacaatgtccagaataggaaaatggagagatagaaagtaaattagtacttgtcagaggctcgagagattgggcaataattgttaagggatgttgatgggtgctttttgttttgttttgtttgttttttgagcaactaaaagtatttcaaagttgagtgtagtaatgattgcacaaatctgcatatactctaaaagctaggcctctataagacaggccagaagctgtgggaatggcagggagagcaggggattctcagaaacagtcagagtgggagatggagcacactcccagcctcgtgtgtgccaagtcttgtgggaaggctgtgggacagaggaggtggagtggccttgtggtcatattagtacagcacgggtgacagtgggttccctgaaggattggggaagcccctggaagtcagctgacgatcagtctgctgatgagtctgctgtagattaaggacatttccttctcgagtgagcactgaaattcctattggccctacaaacatcaccatcactccagctcttcttcctccttctccccttcctcctcctttccttcctcccttcctcctcctccccctcatcccctttatacatgaaactattgaattgtctaaaaagagagacagagcatttgaagaaatagatagctacctagatttattttttgttaaaattatcttcatctaggagcctgatgtagctgtctcctgagaggccttgccagagccttacacatacagaggtggatgctcgaagccaaccattggtctgagcacggggtccccaatggaggagttagagagaggactgaaggagctgaaggggtttgaaacccataggaagaacaacaataccaaccaaacagacccccggagctcccagggactaaaccaccaaccaaggagtacacatggctccagctgcatatgtagcagaggatggccttgtcaggcatcaatgggaggagagatttttagacctatgaaggttctatagatgcctgagtgtaggggaatcaagggctgggaggcgaaagtgggtgggtcagtggaggaacaccctcatagaagtaggggctgggtttccaggaggggggcaaaccaggaaaggggataacatttgaagtgtaaataaagaaaatatcatacacacatacatatatatgtgtatgtatatataaaatcttcatctgttttaaacaaaattaacttgtaaggatgtctagttgaaaataaaatctatatatggtagggaatttggtctttatgaatcataataaatcacaaaaagtattttcttcacattttaatttttccaggtgaaaccacagttttatttttctgttcatgtattgatctaccacatcttttctcagacaccttactgagagagtttatgtggcctcataacagcaatgagcaagtaaatttggatttttccctctctccaccctccaaacagtgcattaggcctatattttcggaatcattaaagaaaaagggtttgtgacctaaatactaagaattagtcatggacacagtagaaattcaaaagataattgccagtcttctatttcatactaattgttctcagattgccaagtgatttatcataagaattaaacttacatgccaaattttgttctgtccctagaaatatctccatgacaacaaaaagcaactcctaattcttgtaagcattgcttcgggagtattttgaggattttagtggttactcaattatttaggattctggcaatgagagaaagggagggattaatgatagaaaaagtattcttggcatttccttacagtggatgctcctgcagagaaaaggctaatgatcaacggaaagggtatttgcatctgtggtaaggtctctgctcatcactataaaggctaagattcgcccccctctttccctggtctcccttccttctcctgcggtctgtccactttccatagcggacagcacccattctagtccagcagctttttcatgtgggccttcagtacttacttaaacagagaggccttcgccttaggcacacttaactcctgccgccaaggttactgaaacaaggagtcactggcaaggaaatgcattgtgaaagctgttctagcttcaactccccagtgctctttgactttatattggtactcactccagggccccgagagccaagcagctgggtgcttaagaaggaatcaaatgctcagatttgggcattaaataaagtcactgggaaacctgactctttcactctccagctcaattctccctctgattttattgagagtaaaagcagcatctatcttccagaataactgtgacctcttcttgaagcactgagcatagtgtctggctcggttacctatgatgaaagtgtctatctgtatggtgtctcccgctgaaaaatcatgagaaggcaaaaaacaaatcaacccacccaagcccagggatgcaacgagcttctttttaaaaacaaaaggaagggttaatcattcctaggaagcacatataatcagatatatgataaagtcagagataacagtctagtaattaagaagggattgcttattatagattcgagaaattctaaaccgagcaagaaggttatatatagaattgccataaggctcagcaaccagtcctgacatatcacgtgacagcagtttaaggaaaaggaaacatagcctttcagagggttctgggagatgatcactgtcatgtaataggtctgaggagatgagaagaaaccagaaagacaggtgcagcatgcaaatatgcaagagttgatccataatcatcaaagaggtgaaagtcacagaaaactgagtattaagataagctgatatgtcttagtttgggttttattactgcaacgaaacaccatgaccaaaaagcaagcaggggtgggaagggtttatttggcttacacttccatatctgttcatcatctaaggaagtcaggacaggaactcaaatagggcaggaacctggaggctttagctgatggagaggccatggaggaatgctgcttattggcttgct

SEQ ID NO: 320 - DNA, 1396 bp, Mus musculus
atgaaggctcccaccgtgctggcacctggcattctggtgctgctgttgtccttggtgcagaggagccatggggagtgcaaggaggccctagtgaagtctgagatgaacgtgaacatgaagtatcagctccccaacttcacggcagaaacccccatccagaatgtcgtcctacacggccatcatatttatctcggagccacaaactacatttatgttttaaatgacaaagaccttcagaaggtatccgaattcaagaccgggcccgtgttggaacacccagattgtttaccttgtcgggactgcagcagcaaagccaattcatcaggaggggtttggaaagacaacatcaacatggctctgcttgttgacacatactatgatgatcaactcattagctgtggcagtgtcaacagagggacttgccagcggcatgtccttcctcctgacaattctgctgacatccagtctgaggtccactgcatgttctccccagaagaggagtcagggcagtgtcctgactgtgtagtgagtgccctcggagccaaagtcctcctgtcggaaaaggaccggttcatcaatttctttgtggggaatacgatcaattcctcctatcctcctggttattcactgcattcgatatcggtgagacggctgaaggaaacccaagatggttttaagtttttgacagaccagtcctatattgatgtcttaccagaattccaagattcctaccccataaagtacatacatgccttcgaaagcaaccattttatttactttctgactgtccaaaaggaaactctagatgctcagacttttcatacaagaataatcaggttctgttccgtagactctgggttgcactcctacatggaaatgcccctggaatgcatcctgacagaaaaaagaaggaagagatccacaagggaagaagtgtttaatatcctccaagccgcgtatgtcagtaaaccaggggccaatcttgctaagcaaataggagctagcccttctgatgacattctcttcggggtgtttgcacaaagcaagccagattctgctgaacctgtgaatcgatcagcagtctgtgcattccccatcaaatatgtcaatgacttcttcaacaagattgtcaacaaaaacaacgtgagatgtctccagcatttttacggacccaaccatgagcactgtttcaataggaccctgctgagaaactcttcgggctgtgaagcgcgcagtgacgagtatcggacagagtttaccacggctttgcagcgcgtcgacttattcatgggccggcttaaccaagtgctcctgacatccatctccaccttcatcaaaggtgacctcaccattgctaatctagggacgtcagaaggtcgcttcatgcaggtaagag

SEQ ID NO: 321 - protein, 466 aa, Mus musculus
  VARIANT (1)...(466): Xaa = Any Amino Acid
MKAPTVLAPGILVLLLSLVQRSHGECKEALVKSEMNVNMKYQLPNFTAETPIQNVVLHGHHIYLGATNYIYVLNDKDLQKVSEFKTGPVLEHPDCLPCRDCSSKANSSGGVWKDNINMALLVDTYYDDQLISCGSVNRGTCQRHVLPPDNSADIQSEVHCMFSPEEESGQCPDCVVSALGAKVLLSEKDRFINFFVGNTINSSYPPGYSLHSISVRRLKETQDGFKFLTDQSYIDVLPEFQDSYPIKYIHAFESNHFIYFLTVQKETLDAQTFHTRIIRFCSVDSGLHSYMEMPLECILTEKRRKRSTREEVFNILQAAYVSKPGANLAKQIGASPSDDILFGVFAQSKPDSAEPVNRSAVCAFPIKYVNDFFNKIVNKNNVRCLQHFYGPNHEHCFNRTLLRNSSGCEARSDEYRTEFTTALQRVDLFMGRLNQVLLTSISTFIKGDLTIANLGTSEGRFMQVRX

SEQ ID NO: 322 - DNA, 144035 bp, Homo sapiens
aggagatgggagacctcctacttcaccctgccttcagtgacagcgcttctcattttctttgccttctgctttctgatccacgaagtagaagtgagaaaaaaaaaacttcacaaattaatatactattggattatgctgccacttaaatggctaattgtaatacactgtgagataggctaaattaggaatatgaagtgccagtgggaaaacagatgaggcaacctgtcagcctccccagggagaggaccagtggtggaagctttccagggttaggcttggaccctgaaggaggaatcagggtgtgccatgcaaatatttaagaaggaaggccatctccacggaagagactgacaaggccgatgcctttgcctttgcctgcaaagctgcaacactgcctctcttcttgggctaggaaacacccagcttctccttcactggttttggaaggcaggcaaaaagcaaaacaaaaacaagaaagaaccaccagagcacacacctttctaggtcaaatctcatttcctaataccaacaacaagtttgacaccttttcattaccagccttggacttaaactccaccctctctccagagtgggagtggacccagatgagcaacccaatcgcttattctagggtctgggcagtatcccctactcagttccatgtttgatttggttacggagggatcgtcattgagccagtagcatcaggacctctgttccacagccgctctttctacaagagtctatgcactcctcccctagaaggacaccatctgccagcaggaggaaacctcttttcctgccactgtctgccctggtcctccttccctatctctgaggcatctgcaatctttcatgcctggctctctagcctagatagttctagaacactggaatatattaaaacattcatacacacacacaacttctttcaacagcataagaacctaatgttgaattttcttgaggtttttttttttttttagctctcctgataattgctcatgtgtggacatattaagatcatcattctgcactagtgatcactatccgaaagtcagggaaaaaatcagactgtcaaaatcaaaacagtttcaagtaatgaaggttttgggtataaaatatgtgtttaagggattttgtttaaaaatacactttggctgtcactttaaaaagattcgaccagggaagaaaaaccactatgcatgatatggaagtagaaatttattataggaattggaacttgcacaattgtgggaagagcagggaaggtaaaattctgaaaagtggagttaaaacggtagagaaaagccacagacgactcagaacttacagtgattcctgggagccagcacgtcctgctgccggagtgggacctcaaagcctatggaaggttgttggttcttcaggtctacggcctctgtgaattctcagcaaggcatctggtagaaggcctggtagaagacctgggacaaggtcaccatcaggagggaggggggtgcgaggacaaacaggaacctgctaacacctctgtgtctgtttctatcaccaacaggtgctgataaccttcagaacatggcagctgctttccttctgcctcccagaactcacaacttccctttggaccaactccaatctgaaattatgtagaaagggagagtctgaaaaacatagtcccaaacataaccaagtagacaatagaacaatctggcacattgattggtattttgacttaaccgccagatcaccagcagctcattgtaggcaggcgcaagtaaatatctcacctcaaatgcaacaagtacaaaatgaatgcatcatagtgtcccaggcttccattaaacaaaaacaaataaataaaacaaacaaaaagcaatcttttatccctcagctttattaatgcataactaacaaataaaaatggtatatatatttatggtgtacatcatgacatttctttccgtgtatacaaaaagcaatctttctgagtactgctcagttaccactacctctaagtgatcctgtgtattccacaccctaagtgtccatctgaccttcctcactgtcctgtgtcccagaagtctctgccttctatcaagctttcctctttgctttcccgcattaatgaagtgctcctctctcttgccaccctgcctccaatctcgccctgctccaaaccttccattaaaccacatgaatctttctaaaatgtaaaattctgcttattttacttaaattattttagtgactccgtatcacctatcatatacatctttcttggtgtgatatgaaagacccctcatatatattctgacccccacctacatttttagcccctctcctgtcctaatcccaaatgcactgtgccccaactattttaaactatttgtaaaaccctgattataggattatgtcaacacaggagtctgtgtgccttcctccccttgcaaatacagttgcctgacaaactccttctcatcccataggatttgactcaaacatgaccttctttgtggtgtcctccttgtctcctcaccttctcccaatccccaaagtcagtccataacattctcctaacagtggatagcatgtgccatgctgtaccaggtctgctgatttacatgtctgtcttctgtgctagttgtgagctcctcaatgttaaggaccacatctcattcatctttgtagtcccagacactaacacttcccaggtgcatggtaggggctcaataaacatttggttaagaaattaattgatgaatcacaagatctgacatgtttaaatattttattccatatttatagctgcttccatacaaattatgattcccataaaacataggtttacatttaccaaaaaaaaaaattaatttgggggtaatccaatacatgtacatggccaaataatgaaattcagtttaaatcttgaaatggccctaaatcatatgacctcattgatcagattaataagattatttctaaatctcaatttcaccagtgatgtttaaacatatttttgacctgccattggaatacagaacaacaaaggaaacatctggttgttcttaactttggggagacaaatccatttgttaacagtagcaataggagagctgacagaacctgataacagctccaacacagggagctcagcccacaacagatggaccagacacttcagggaaagctttaaaaagatgtcttttctaattcaggttatacactccttgaaagttccttcaacataagcatgaaagtttgcagatgattttatcaggtctgacagcttttttctagaggttagtttgcaattggctctcgggaatagtttggttgaatttcactggattttgtaagtaaaggcaggaatgtttctaataagtcaacaaactgaaagtcctaagcagtttgcatcactgccaactttctgagtgcgacccttggctggtcagagtttgtctgtgttcttttttttttttttttaataactcttcatcagctaaccaaggttaacccagagttattgctatttcttctacatgttttggacatagtttaatagtaattatgtttaggctctaatgatgtaaaaaaaaaaaaaaaaagaaagaaagaaagctcaaaccctggccagtgcaaaattattggaaagcattttaatacaactatcttaatcatatttctaaatatgttagtcatgtataatagttacattgattctaatcaaactctccaaacattctatcccttttcaatgccataagacctatatattccctcttaaactgttaaattttgtagccatttttaaatggtctaatttacttttggactcaccaaataaaagatgcctaagttgattattaaatcattcctattggaatagaataaagtacttaatcatatttggacaaggcagtagttaataagaaccacacactgaagtactttctaatataatgtccccttacatacactacaattagtaaattgtttggtatattggctttaaatggactggcttcagtaaaattttggttgatacttaatattttttaattattttcaccagactttggaactgttttcatagctggagaaactgatccacaggggttaaataccaaagcacacatcaagttagccataaaacctagaattgcagtaattacacaaactcacacactcacagacacatttttaaactccatccttaatgaaatgctgatcgatgaaaaaaaatcactttatttttcttggcacattattttccaagataggttattttagtgtcaaagtttaaattaacagatggactggataagttcatttggaaatgatgctatagtatgctgcataaaaatgaaaattttctttcccaaaatttaccagaaggtaaaagacagagaaagaaaagaaaaataaatgaacatgactttggagatagaggcatcgataggtcaaagagttatggaagcagccttccaggactttttggaagtcttggccttaatttctcatcttccaagaggacagagattctccaaaatatcctctcttaggacttctcactgcctgtcatctggtttttcctttatttctcacattccctaggttcccaaaggagagatcagaaattgagaaaacagaggcactagagaaggaacattccagtccctcttcacatcccacaggtctgagtcctaggcacctacagcccaccacttaggccagcttgactgcctaggaccttggctccgacctgtgcagtgttctacagatggacagcatagcacctttggcctgcactgcaacatcagtccccaatgatcaagccagcagagaagtggccatgccttaggttgtggctgactttgcagacagagaaggaaaatgaaagagtgccttaagttctacttctcaaaaaaaaaaaaaacttttgggtactaggcttaatagctgggtgatggaataatctgtacaacaaacccccatgacacgagtttacctgtataacaaacctgcacatgtaaccctaagcctaaaataaaagcttaaaaaaaataggtctactgctcccagttaaacgactgcatcattcactacagaaccggagacaatttaaaataattataacagaggccgggcacagtggctcacacctgtaatcccagcactttgggaggttgaggtgggtggatcacttcagatcaggagttcaagaccaccctggccaacatggtgaaaccccgtctctaataaaaatacaaaaactagcatggtggcgggagcccgtaatcctagctactcaggaggctgaggcaggagaatcacctgaacctgggaggcagaggttgcagtgagctgagatcacaccttcgcactccagtctgggccacaaagcaagactccatctcaattaaaataaataaataaataattataatggaagtgcagtcattctggaaagacacagacttaagacagctgtgtgactttggataggttacatgatctctctgagcctcatttccctcaatgtaaaccgagaagggtgatacctattctggagttcttttaatgaggatgtaagcagagctccagactcatgatgaatacatggtacacatttaataagtgacagctaaatacattatacctttgcctgattttaggagagaggtcataagctggatgtgaaaatgaaccaaatcactaacaaaattgcagcaccctgttggagacggtaattttttcttaatttttctgcctacaatttcctaggtcttctaattaacattgtgatactttagcttgtagcctagcagtcttgttcttgtcctcaatattaagtatgctcagtcatatttttagataacttaacattgcatatttatttttagacagcccagccacacataaatgaccaatacaaatcaacataaaagcagttcatatccaaagtgcccagttttaaccctctgtagctggcagttccatttttaacgcgaagtttcctaaaatgtataatctataaaactaattttatagaaaattgacactgaagatattaagaaaaatcaaagcattttgtggtcaattaaattggggagatggtagggtaagcaaagttaagaagggtttttttggtttttggttcggttttgctgttttgttttatcacatgaattttcaaaaccttcaacattcgaacatacatgacatagctctaaaaaggtaataggagtcctacatttccaaattttatctgtgctcagaaatgacattaggtgacattacctgaattcttctattgtctttttgtagagacatttgccataggcacaataataggggtgatggggcaggaggaagggaaaaacagagtgaaagaaggagttccagagtaactactctttaaggcagggatcacagatcctaatgcctacaggagaaagtgaaatcaagatcagaggtgggccagacacaacccaagagaagatggtaggtcaatggcaaacagcagatcatatggtctttctacctcaattcacacttttaaaaacattctgtgcacctgtatatgtctgtgggccctattcaccatacattgcaagcatgaagcccctattcttaggagactgctttcatttttatttcaaaaacagcaccaacttcaagagtgccttcaaagacccaaattttaatgtgttaaagggagggaaaaaaagatagagcatattagagcaggaggtggctgttcctctgtctctttgtcacagctatcactagacccatctcaaagttaagagatgggatcctgtttgtagttcaacattatgttatccacaggtggatggataagacctgcttatgcctttggatcatttatattttaccagacactgttccatgtgctctacttgtagctcctcattttatcctcacaataaccctatcatgatccccatttcacagatgagacacgagagagtttaatccactggcctgtagctacacagctagcaagagacatagctgggattgaaatccaggttgtttggttctaaaactcttaactattatgctcaactcagtcttggagatgttgttcccaatttgaggggtctatcagttttaattgctttcagctgcaggtgacagaagtcccagctaccagtgtctagaacaagttttgtttttgttttttttccacaaaacaagaaatctggaagcaggtgtctactggcagtagggctgtacctcagcaatgtcagcaccaacttctgcatgctggtcacaagatggttagttcttcactgggcatcatatatgaaatcaagaagcaagaaaggaaaaggggtggcaccagccttaaaccctttcccacaaggccccatcagacttcaacttatacctcattaccagaatgacatcacatggccatgtctagctgcaaaggagtctgggaaagcaaatatttctcttttcaagccccaagagtggaggcaggaacaggaaaatctcgttgggaacagatgctggcttagccagccaacagtgtggaccacaagagatttggtttggttaagaaaataccaacagaacttcatcatacagtgtatcacccatgacatgaacccaaggaaagttaaatagcaacaattaaaagtttgctgcaaaaccaaaattgaattatagaactcctattaccttttaaaatatctgtttccattcatttccaaaaatctgaaattatctgtaaacattttcccaatcaaatctgtctaggtagtgtgtaaaaattacttgaccttcacacacccagatacttttagttatgctattgttagttatgttatttcataaaatgttatctccttatttacagttgataaatgaaatgatgattttcaatacagtttcaaaactggattgaaattttgttagttattagaaactagaaagtttcagtgctgaaaatacacaacgggttgtttgtatttatcatctattttattttccagtttgcattggcttttctgggtctttctacaactttaattgtaaattttttcttttatatttttatcatggcactcaaactcagaaaacctgttaaggcaactacataatgtgatctaaaaatccagttaacatattgctatggaaaccaggaaatagaaacagcactctaatcattcctttagacaactatggctctgtgtgtgtgtgtgtgtgtgtgtgtgtgtgtgtgtaaaactttttaaattcattaatttattcatcttttattgaaagctgttactgaacccaaaatctgtaattgatctgtccataaataggcccagtgccttattaccagtaaattagtgttttttaatgagctatagtcattgataaattatgccatgccgtatcaggaaatctccagtcaggccgcgttgtttatttagcctgctgaggcctcttggtatggtgtgaaggacacctgactgggctgaaagctaagttctaactttgcccctcttactaaccagctatgtgactctcctgggaacttttagggactcagtttctttacctgcaaaatggttcaatgcaagactttagtaacgtaatgggaactttccttttccataaaactggggaatcaagaggtaatctcttttgaggactgaaatcactcttatgtaacctctggttacattatcatttccaagtgcctggcacttgggaaatgataactattcttactacatttttctatgtttcattctgtagtaaataagaactgaacctgcatagtaactgttattttaacccatgactttcaataacgaagatatctatgtctcattatctattgccatgattgaacaagttggtatgagagccggaacgaactcaagttctaaccggcaatgcccgttccttagatcctattacctttgagtgttcatttactcttgtaggtgccaatttttatagcgaaatacaaagttatcccaacacaattactcctaatagagttcaccgaggccccaaaagctcttttttaaaaatcatcataagatttcaacattcaagaattaaacttttgttctgttgtgcttattcatcgctatttgcccagttatttaatcagcctgcttccggctatggaaaaaaaaaaaaagaaaaaaagaaatggaagtctcctcagggttaaactcctctgttgttcttccttgcagaaatttgagttattatagtagaggataatcgttgcataatgaaatcattgggacaattcgtccatccacttctacctccgcctctaacaatgaactccttgtttctgcggtgcccaaatctctctaaacccgggtgggcgcggggcggttagcggagacgtgggagaggccgagagcaaagctcgcgcccttcccggggtcagcgagcggggtgccaggagggtgcgcgccctgcctctgagcccggggtgacactcgcctcccaagcgccaggagggggagactcggtcccgcttatctccggctgtgctaacttcagactgcctgagctgggggaggagagcgcgcagccagggcgagaaaacttctccacctagaaagtttcaccttgtcgtgggcggggcagaggcgggaggaaacgcgacccccgcggggccaggcgcggcgcggacggcaggaagggcgggggccgatttccctctgggtggtgccagtccccacctcagcggtcctcggaacccgcggactaggggacggacagcacgcgaggcagacagacacgtgctggggcgggcaggcgagcgcctcagtctggtcgcctggcggtgcctccggccccaacgcgcccgggccgccgcgggccgcgcgcgccgatgcccggctgagtcactggcagggcagcgcgcgtgtgggaaggggcggagggagtgcggccggcgggcgggcggggcgctgggctcagcccggccgcaggtgacccggaggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaaggtaaaattgcagcccctttcagatccagtacccaatccctcgcctcaggggttctgctttctttgttcccctaagagacctgactgctgttccagggggcaaaaccacgtaggtgggctagagtttaggggcttcggaaactgaagagacgtggccacggcgaggacgaaactagaatggggcttgtctttttagggggttgcttctgatggccacctgtatgacttaggagggagaggggcgctgggacagtgggtgatgtgtgactgttacggcccagcaagttttaaagctgggatctgactcagcccttacaaaagggatccggtcatcctcgtcccaccgtgatgcagctggcaaggtttgagccgagctgtttccttgttcccagccttgctttatctgtgttatgttggggtccttccaaggggcaggtgtttctgtgaaagtctgaattcatttctggcaatcacgcggggcttgtgatccatcaattttccatcgtaccttatctctttctggggcttgtggtggacatctatcttattaggtgaaatagattataaccagaggctgagcgatgtggccagtcgtagtgctgacccgataattaaagcaccagtgaaagtactttccctgactattgtcaatgcagaatttactccgaagtacggtttcccattcatatctttcatgttttaaaagagccatttgctaatttggcagttggagagggctccaatggctcacgcatgaatagttgcccagtgtattttaccttatcacagttttatgttcaaaggagccctcgggcagaatgaaatattgtcaactctcttaggcaaaataatcaagatactttaattgctatgttaagatggtccatgaatgtgagaggattgtaagaactgacgttggaggcaatatagactatctggaccctctcttgaattttaagaagactgttcacattctgtagctttgggtgggggtttattctgtcgctttcatcagccagacacatgcacattgccatgcaaatggattcagaaaaacattatattcccttacagctaaactattatagctgactaatgaattttttctgcatgaagatgatctgaaaatgatgtacatcatgtttctctgtgctacagggacataaattgcatttttatgtaaacagtgtaagtggtgcttggattatttacaggtacatagctttccttccttgatctaagctaattgagctttgttttgaacgtgtaaacttccataatggaacataagtgaggtactttggttcctatcatttgcaagtctgtggtgtattcaatgttcattctttttgaactgctgaataacagagggaaaatttacatcattcataagaaattttggtagtacaaaaatgtgtctgatagcctataaaatgtactgctgttttaaaaattctattccgttttcaaacttaatggtgtataagctatagttattaacttaaatatattttgcttttaacatgatggaatttgtggcatatagaagacagtctgccgactactgctttttcaaaattgctttgttcttgatacatggcagtaggggtttacattagatgtatactacatgctttcaaaattagttgatggagtttatcttcatgataaaaaatgtaccagattaatcatagccagtcaatacgaaagctcataactaatattttcactacttttaaacctataatagagaaaaatgaccctttgctaagcaggagaaatacccatattttataaattccttttaagactatgtaagtatatgccttgcattaatcttgaaatctttaaaaaaaaattgtcttaatgagggctagactaagaaatacatttcaaaaatcaatttccttagctgtttttaaaatagtgtttgaagtagcattagtcatattatccttctgcagatctacataatagtctcaaattaactttttctcaaatgtggtcatctcaaaacaacgtgaataactcagaggagctaacatcctctaactggcttattttctccaagtggctgcaccaaagacatggcaacacccccatggtgagcacagttcctcacacattcagattacctcccatttctctgtcctcttcctcctcaaccctttcccttggtttggtcagagctgctttcaaggccttccgtgcccccatttctccagcccagtttgctcgtttcttctttaggcattaggcttagtgattctcgccagagccatctacgctttcttttccgtggtctaaatccctaagatttccttggtctgctgtgtttattcataggatactcaatttcctcattgtgccctcttaaggggagaaaatgtatgtagaaactcaagtgtccggaagtgagccttcttttcctggctggtgtatgctgaaactagtgtttttgacaccaagcccttagggcagagtttcttcatgggttttgctcagtgcaaaataaatagtcacttctcagtaataaatgatagatacactgactaatgttagttcagaatcactttgatgatgtgttctcaactgacactgagttgctgctagatccacatttgcctgaccaaaaatagctaggacctataggtagagtatcatatgtgctaggtactacagcattttctttaaaagaaagaaatggaatctgcccttgagaagtttatgatctagatacacagacaaatatcacatattaaatgaacacaaattcataattattaagaggacatcacatgagaaacgctttcaaaatcatcctatttgctatgaaataatagaatttttttttaaaaatcaaagtttggaacttaaaaaccttaacattttcaagctgtttctgcatacatcacctttctgataccaaaacgaccttacaagataggcaagtctgataacatcttaacattcttatgttatagacaaggaaactgagcttgagactagctccatgctatttcaatagcaccataccacctttcctcagccatcaactattggaaacattttccatggaggcatcattagggatgcttaagatagtggtaaatgatgaatataacatatctagtccctggagtttttgtcaccttctctttctccagttctctctctcttttttttttttaatttcttttcttttctttttttcttttctttgtagtgagacataccgagaaaaggtttcattcatatgtgtggggcattctgctcctgttatcagattaagagccgtgaataattttgtaatctatccttctatcagaaagcccattctcagatatcttttcagctgtgttaaacaggttagtatattccgcttgggatttgtttcaataaaaacatccagtaaaatctgactactttgcttttcatgggacaaaatgaaaaaagtgcttttataagctgtaaaacttaattgagagaaaaaatcacgtgtggcatttgtagcaggaggtatgagctcagtgaaataaaaaagttaactttgtaatcacatacccaggtacacatatttctctctgtgattgcataaatgtgtgcaagtatgtttatgtaggttactcccattgattttaatttctataataaattatgtagctatagggcccacaggcgattatataatgggcaatagaatttgaaaatgtatctctcctaatataattaaggatagcaattatgaaatgtgcttagagaatcacaagttatcgtgaaagccaggttcctgtactccaagaatgtgaatgaggatttagtcattcattcaggacaattttttgacaacctacgaggcatagttctaaaatctggcatttccacagagtataaaacagatgaaaacctctaacctcatgacactctgttctattgagttggcaaacaataaagaaatacataactgaaatgtgttgtatgtcaggtgatgataatagcttcaaggtagaataaaatggaaaagagaatagtgactgtcaaggataagagagagtgggatggtgattgaaaaactcaatagtgaggtcagggaaggcttgtcttcaaaggtgggctttgggctagaatctgaaggagataaggaagtgagccaggcgcatatgaggagcacttctcaggagtgctattctcatcttgtttttcctgaaattgtgcagttcacagcttgcacaactgtccatagactccctgattttggagggagatacctgaatagtgcccctgtttttgtagggaaatacctggacagtgcctgccatcattagctaccatgttaaagatgaagatacaggagtggcccacatctcttggtttatgagacatggaagaagaagacccagagtgttgttttgtttttttttttgtttttttgttttgttttgttttgttttgttttgcatccgcctggtcccatcccatactccatcctctatcagagatattgctccattcagacaattttccttcttattttccacactgtgagcctgtcacagtgggatttgttgagaaggatacccatggcttttttcactgatcccttccatagtataaatctaaagacagcaagaggcagttgctgatggtgtgcagcttctgtctgctatgcacttctttctttccccctcgctctccttccttttcctttccagtattaagtcactgcattggattttcttcctcttttcttccttttcccttattcccctatttatatcctgtatcaagatttgcaaacaggtaacttaaatgaggaaaactaaccatttcactagggattgacaaactgcttaggaaaagcagaggggcagtcactgcttggcgtgattagagctgttgtgaggctcagtgtatggcatgggcccatgtggtagtatctttcagattttcaagagaagctaggactctcccaattttaaaatgttgactcagtgtctttaaaacaccatacagcttacagtggcagaaagtctgcaagccagattgggctcctgatggtcccaattgcagcagcatgcatggcccgagagccccaggactgcttctacaaaatattttattttctaaaattctcagaaaattaactaaacaaattttttaaaaccaatattttatgtcagttcctattggcacgtggttatttttctaaactcatcagcccacatactttacatcaaactatgtacatttctaaactaaagggtaatctagttatttcattcttaaactgaagtagtagttttctgaaacctgaatccatcatggctttatgcatcaatttcatttccaagttctctgattcaggataaactccccctttggaatattgtctttctctctctctctctctctgtctctgtctctggaaatgactgaacttcacccgttgttattaccctgccattgaaattcaaaacatgcactgccctcctggtttccagtgccctttaaaagcaatcagatcagtgttaaaatctatttttccaaaggaataaaagctcacaggttgtgcactaatttgtttcctttaatcctaaaatctcagtgaaatgcccaagctagcagccctccagaaggccactgtgttagaaagggagattatgtactgtatttcttcctactattttaaatgcaaatataataatatatcatgaaacagtgcacatacagtatacatattaagatcagtggtctattcctgttttgaaatggtctcctactccttaatagttggaattctgaggcagcacctagactctcaggtccaatttgaaaatgtatgtttttttttaaaaaagaatgacttggggaataactgtttgataagaccgtggaagatttctaatttttaatattttattaaaaatgtaaagaaagacattcaaagctgagacctttgaaataatatggtctttgcaagtcagagaaaaagagaagtggtaaatttattagagataggttgcctcctttgaggcctaatcatgtgggaaaggaaaacccagccaaggtttgggtccataagacaattcaacctagctttaaaaataggttttggctttgcttgggaccagcattgggaccagagtgtatctagaccagcattttagctattaaattttaaacctaggggtcttttaagggaaatttaatccatgtgtctttgattcactaaatcttaaatcattactcacaaactgtatgtccctctaagctctttgatgtccaagagatctctaaaattgtgtaaggcctttttgttccagaaaaaaataggaagttggtttttgctaagcgtcaataaacagcatcctcaaaaatctgattaggtctaaaatcttgcaaccatgacagtatggatgtttgaatgatgcaatgtgaaaattttaagcactttttaaagtccttgtttaccagtaatactcagttgtaatccttactaaccccaaggaaattattttgacacatttcctctctgttttgtaatataaatacaaagcccaaatatttattattttattctggcacatagtaggtactcagtaagtattttgtagagtgttgaatgactctttcttctgcccagaaacttctagctaatgtcagttcttctattcaatattgatatccatctgtcataccttggaataagatctattctaagtcagtgaccttgttcgacaaatttttaaaataagccatctaactaaatatatgacatttattgaaattcattttgcaccatgaagcaactgccttgcaaagagtgctgaaaataggaaggaatttctagactaatttgattaaatattcagttgttgccatatgctttctgaaaattgattttcccccttttactattcctgtcatccttcctcccaccttgacatgcttactgattgaaagctatgcacagaaaaagggcaggtcgcttgtatgtataagcaagagcagcaagtccaaacaggcttagaaaacgtaatgctataatcacgagttgtcataatataggagaggggagagaggaatactcagcaataagagtggtgttgggtattgctccaaattacatggatgacacatctttgaactctattgtgtcgggggaaaacaccttcttgctgtagttagatttcctgtttgtgaatgtgtattttctggtaaccagacttcctatatgaatttgacatagctttaagtgcatttcaaatgacatgattaaaggatggctgctttggagacagcagctccttctctcttaaagaaataaactatcatgctaaaatataggcattgagatctttcttgataccatattgtgaatttctaatggctcatcacatttttatcctcagaaaacctttcctggtgaaaagcatgctgttttagtatcacatttggggtgatggaattggcaatttcttatatcttgagggggcgggggggtaaaaggaaaattgtgttaatagggtcttaaaatagagattctcttaggttaacctgaagatttactaaatacattatcattacagcttgttttgacatttaattgtagatggcactgtatcagcactgacttatttatacagctttgtttagacatgcctaatttttatttcattggtggaaccaaaccatcagtaataaatcatatatcagtgtttttgtacacattcgtatttacatgacttttaaaattccaaagtaaaggtctcacaacttgaaaaatgaatgaatgcctgagtatttgaacagttgggaaaatgtagttcaatttaagaaagattttttatgacaattcttatgccatatatagaaaatagataataaaggagaaggcctggaggtttagatgggatattggatcaatgagcaaaggaaggggaaaggtgggcgggatatgctgaagggtcatgggcttgagtgcaccctaagtcataaagagggtgtcccattaagaatcaggctgcctgaattctaagtaggaaagaggcaggtcaaaatggtgtataggccaggcacagtggctcacgcttgtaatcccagcactttaggaggccaaggtgggtggatggcttgagctcaggagtttgagaccagcctgggcaacatagcaaaacccccctcttaaaaaaattacaaaaagtagctggacatggtggcgcacacttgcagtcccagctactcaggaggctgaggtgggaggatcacctgagcctgggaggccaaggctgtagtgagccgagatcataccactgcactccagcatgggtgacaaagagagaccctgtctcagaaaaagtgggggagggagggtatggaataaagtaaagctcatgggaaaatggtacctttaccattttcccaccttgggaaatggtgggaaaatttagacattgctttacaaagtctaaatttctgccaacttgtgttacatgtggtttgattctggagaaagatagactatcatctatccagtcctaaattgggcctcttagtctgtcctcccctcagttaccaggaagaatagcaggaatatgtcacagaagcagagaaagcttttattctgagtgtcagaggcatgttctaagcactctgttatctactcccaggcactctaaatgaaattccattttctctgaggaaatcaaaatataaaaagaaaactcaggcaaatttataaaggttttacaccattttcatgactgaaatattctagcatatctagctcattataatctataaattcctgttgggaccaaaagttatggccctaaaacctgttatctgtaatccttttccactgggatattgtctctggggatatatattagctttccttgaggatactaccttgaaaccatttctttggtccttgactatacaaagttcatactagcatggatgtaggaattgtatttttctattctaaatacgaatttagacagtgatataaagattcaaggaaagcttctatcaaggcctgccttcactacttgtcttttggctcctctgagggtcttaggtgagccactttcatctgattctgccctcacttcaggcagaattcatatggctccagccaatggctacactgtccaaagtgagactgtggtctcacaaccatctggttaatacaaagacagcaagccaatatgatcacttaggacctaggcaaacctttgggcttaaaatattaccttagctattgttgtttttaatgagtatcaaatagtatgatatttgtaatttgtattatgtaaagaagtaaccaaagcagagattgttgacaaaaaaaaaaacttcctcctaacataaatgaatatgcattttggacttttcaaaaattccctttctgtcttgtcaaaattaagatatttctaaattttatttcggtctcactaacacatacttggattattgttcattgaaatctgtacgtcaaggcccagtgattttaaacattcttttggtcttcaaagaacttaccaaaaaaaaattgttctttaaatcaccagaaaagtgcagataaaatcccagacagtttcattaatgacaatgaaaggtgacagcccttgaatctatgtcataagttgattaattactttccaaacattattaaagatattagacgaataacttagactggtatccaggatcaaggttccttcataatccctaaatgggttttaattttcagagttagatgatcattatatgtgatttatttctttaacatctttagactgttggctttattgaaaagagaggagagtatctgtttcaatgtgttttcttttccctgaagttattccttgcagaattcaataaaaccggttttgaaataaaaataattaaatgctggcattttctgttaataagggcccatagacctgatgaattatataaacattacaaggaatttaccactgagttcataattatgtaaccatttaatgcccaaacctgcctactgacagtgaagacgttcaatgagaatggacattgtgcattaggataaggatgacctggagtgaactttcattcttgttttggttctttcccattttgcccaattcatagcacctgattctcttaaccagcaagtctgtttgcatgtctccagtccaatttttcgccatgcccactgcagtgattccaaactctcaccatttcttaagctcttgcatcttttgggctctccttattctcagtataagatctttccttatagtttagagagtaaacacaagcccagttgtttccatgtcacccattattacctctttctgtctcaaaggatgaaacagtcttttctacctaagtcttgaccctgttgttccccacacctgtgagcacctcctccctctatcctacccaccttacaactcttcccgtgtttaaaatctccctcaccatttttcttttttaaaaaaattatattttaggctcagtggtacatgcgcagatttgttacataggtaaactcgtgccacagggtttatttcatcacccaggtattaagcctagtacccaatagttatcttttctgctcctctccctcctctgccccctcaagtagaccccaatgtctgttgttcctttctttgtgttcataggttctcatcgtttagctcccacttataagtgagaacatgcagtatttggttttctgttcctttgttagtttgctaaggataacagcctccaattccatccatgtttctgcaaaagacagaatctcattcttttttatgtctgcatagtattccatggcttctctatttttcattcacctcttactcaacttactgattcttctagaaagaaataaaacacacacatcaggcatcctgataggatcttgaatacacaatttccttaagtagtcactcctgttttcattttagcctttaaataatgaattcttgaaaataaatgtctaactcagtttctctactttcttcattcccattcattcttaagtcattcaactcaagcagtctgtaccacatgcccaagaaagtgtcctcattctaatcaccagtgccctcctcatggccagatctgatggacactggtttttatcccttttgacccgtctgtagaatttgacaccatacattttatttctcccttctcgaaagttctccttagcttatctctccacattttctttgcctacaattgttctttttaccctttaaaacataaaggttagattctagtcttctgtaaggctccatctgaattcctcctttctacttacaaaacacattcacaagtgatctcacttcagtgacttccaatacaccgatggacgagtggttcacaaaccgctctctctcacttcctcttttctctagaccaccactttcatgttgtcagctaccttacagactccaccacttagatgaccagaagctacatcagggttattaactcaactaattacttttaccctcaaagtctcctctccctattttccttaccttggtttatgatacccagatagacaattttttagccattcttggcttttcagtctcctctacaatcaaaatccatattgaataattcccacataatttttctcactttaatatgtgtataatctagtccttcctttctttccataatgctagaaactttgttcaggaacattcttttgtatattgattgattctgttgtccattcattcaataaatgcttactaagtgccatgtaatgacactatgctaagggctaaaagtggagcttacactctgatgggagacacagataaataagttactatatagtgtggtaaaggctagataaggggaagacaggtttgatgtttgagcacataggagagttcctaattccttactagaaggtaagagatgcatcagagaaggcttcccagaactgttccctaagatgaggcttgaagagagaggacaacttatccatgtgaagttgagggcaagaatatccataaagagggatccacatgtgctgaaacccagagtggctgagcacatggcttgcttcaagaactggaagagggcagagtggccagagcctagatttctaatggtgtgatggcaagaggcaagactggagagtggggcagaaaaaaatggtatgtggtttgtaagctctgccaaggggttgacattttttttcagcaaagaagtgacatagtcaaattgtcagtttagaaagatatctctggtatgctagggggcagatgatcagggtgagaatggagagggaagaccagcgaggaagctgttgtagtaatccaggtatgaagtgacactgccctgaccatgggcatggaagccaataaggagatggacatgtttaaaatatttgtaggtgggtgtcaaagatgatgtcctagaaatatgggacatgttcagcactgaggtaggatacagagagggagaccaggttttgtgggagtagatggagataacagaaggatatccaactgctccttcttggtctcttgtcccatctgtctttgtctcctgacctattagctttggtggcgccatcactcagtcctcctctcttcattctctacagtccctctcctcggagatcccatccactctcatggcttttcatgacgtctacatgctgacaacttcttaatttaaatctctagcccagacctttctccttaaccccgggactcaaacatccaactgcatgcccggcatctccacttagatgcctaaaaaatgtatgtcaggctgagtgcagtggctcatgcctgtaatcccagcactttgggaggctgaggcgggtggatagtgaggcgggtggtggtcaggagttcaagaccagcctggccaacatggtgaaaccccgtctctactaaaaatacaaaatttagccaggtgtggtgatgtgtgcctgtaatcccaactactcaggaggctgaggcaggagaatcgcttgaacttgggaggcggaggttgcagttagccaacaccacatcactgcactccagcctgggcaacagagcaagactccatgtcaaaaaaataaaaataaaaaaacctccattgtgggcaaaactacattcctggtctcctcatatcctacaaacatgcttcaccaaccagagtctgcatgtcggtaactggcaaagccattctctctgttaaaaaagtcaaaatccttggcatattctcctttttttctcacatgcctcagatctgactccatcagtaaatccggatggagttcgatctgaggcatgtgacaaaatagctctgtcttcaaaatagaaccagaattcggccacatctccccactctccccttccttcctggcccaggccaccagggtccccctcctggaacaccactggagcctcccagctggcctcaccactccacctttgccctgaactgccccccagccactagcagtcttctctcccatatgatcgaggtgaatacattccaacataatccccccttgttcaacaccctgcaatgactccccatttcactccaataaaaacctgaatctcccaggggcctacaaggccttacatgctctgcttctttgtccttttgatctcagctcccggtcaacaaagtccaggcttactggcccccttgctgtgcttcagacacaccaggcacatttagttcttccttcttgcctctgcccagaaatctcttttcccatctcagacatctgggtccacaaaagccaccttcccaatttccgagctacaaacctatccccatacctctcctccaggcagttctgatgccccagccctactttttgtttttccctgtaacacacatcaacttctgaaacactacatcatcagcttgttatgggtattaattgttgtccccagctaaaaagtaagttccacaagagcaggggtgttgggttttgtttactgatgtatcccaagcatctgatgcatagtaggaccccagtaaatacttgtcaaatttggtcttaaatagctgttgcatagacaaaagtgatattggagagatggatttcgggattctctggagatccttcaacaaaacatatcagactttctttaatgtggccacagcctaatcttatacctttttccactgtcaacccagcccacctggcctctatgccaattgcagcttcctggacaaccctgcatcttctccccaggtgcccgtgtgtgagtccactccacccaaagtgtctgtcccctacctcagctgcacctgagcagctccaacttatcctgcaagacacagctcaagtagtatcccctctgaaatactccttggccccgctttctgtctgcatagttagctcttctcccccgtgctgctccactgacatgcgcacacctttacagcacagcctgggcgtgttgcaggtggaaggtggagattcccagtcaaggggcaacacctgtatggttggaaaagttgtttgttttaatttcttgccctctcttctctcttctatttctttcctctcccataaatacacataccgcctatatacacacaacctgccctgaattgttttccttgaattgatgagttacgtaaatgcaatcctaagcacagttgttttcaggttgtcctaaccttttgctttattgatttttcaaggatccagagtgtttactgagtttcagaaattggattctgtacttatttttctgtactatcctagttttatgagaatctatttgctcagcattctctattcttttaaaagtgtttaagatttttgtaaacagttttgtttggttctttattttctggtgacatattgatctcaacataatgctattcatatacttttaattcttcttccaacactgttaggattgcattatgttcacccaaggaatccacatctgtacaaaatgtggccaggtttggctattccttcacattcacagtattctcatgatttctaacaattcttgtctactttgcctaaataagaaaatgtcatatactgacaattttgatcgtgaaaaagagaccttagttcataccagtgtcagagtctacttgcaaacattgatttccaagaaaatttctcaggtgtgagcaaataagcaaaataaattcagacctaagagaaaatagcactacaaggaacgcccagctcattcaaacgctctgcattttgagactagagggggcttggcctttggcaccctcacacctctcccctttgtctctctgtccctgggtgctgatttctctttctttgtgtgacagccactgtgaaaagaatggggttcactcaccacctgcattcctccacagccatttgatatctgctttcgataacagcagaggaaactgatcagtcatataaatccaatcctgagcatagttcctcgtttggaattgtaccatgctttatgccgaggacattttcaaacacggagggaggggatgtctgattcattcgtgagtaatgtaccagcttcctctccaacttgtctcccttcagtggttcacattctgactattcagtcggtttatcctttccaaacccagtatttgaatgcaactggcaaaggttgattgcctctttttttttttaatatatagacttggaaagatgtttctcaaatgtgatttgcggatttatgttattcagtcttcctggattaattgaacaaaaactggtaacactgctacacagtctgaatcacaaaattatgtccatccatttggctgaaaaatacgaaaacaaatacttgtataagttttcatgcattttagcactttctttacattggggaagttcaaccttcacactttcaagggcaatgaaacatttttgtctgacctacaatttattaatgggacaaaagcccatctgtcaatcagggctctgagagttcaatgtattttctgaacaatattttttacattatgtacaatggtaaaaacaaatgtccatttattcttctttccaagaagttgagtactttcaaccattcttaaaaggacaaagatgtttgctgacagaatatgaatttataaaggataatcttgaggatataatggcattctattctttttatctttactcttgccatatcagagttggataatagtctcaatcatatgttacaactagaaaatgcacaattggctttttcttatgctaacaggcagccattttcaactttttaaatgattataggactaagaggggatgcaaaaacagataagaatctgaataaaagcactatctgtcaaagaaacaacatttgtgtaataatcaagaaaccgtttagagcaccccctggaaacattaattataacacatgcaaatcattcctgtacaaagcttaacttgtttatctcctatagccacctgtatttgaattttttaataagctcatttattataaataaagcatgtaaatcaatctgggaataccttttctgtttcagaaatttcatgtaaatgacaggctgccacatacagtacaactatagaggggaaaaagtttctttactccctttcatatagttataccttcatatgacacttaaaaccacctgccaggaacttttaaaacatgttttagatgcacagaagcaaacccaaatgaaaaaatgctatgcagttttgcaatacatatataccacagaaagctttaaaaacattctaccccaacagataaatagatttggcccaaatctttttaatgtgagttttgtgggtaaaaaagattattgttcccttatttttccccatttgctgacgactaggattgtcatataaaatacattcctgggacatgcttatactaaacaaattatccactgtttatctgaaattcaaatttaactcagcatcctatatctttacttgctaaatctcagttgggatatgggcttactcttttttttttttttttttttttttttgagacagagtctggctctgtcatccaggctggagtgcaatggtgtgatcacggttcactgcagcctcaacctccctagctcaagtgattctcccacctcagcttccacagtagctgggactataggcacatgccaccatgcctggctaatttttttattttttgtagagatggggtttgcccaggctggtctcaaactcctgaactcaagcaatcgtctggcctcagcctcctgaagtgctgggattgctggcgtgagtcacagtgcctggcctgagctaactcttttttaaagagttaaaatactggttcctatttgtttttacttctctagtatgggaggctgttactgtggcttctgtcttggggggcaattttcgaagggcttcaagaacttgaaccgaggttagaggaaaaccacaagatggctaaagggtgggaaaagaagaaataacactatttaaactttagatgagaggactaaagtgatgaaacagtcaccaggtatttggagtggtctcacccaagggactgtgccaacttcctcattttttatgagggcaggcaaaaactggccaaaacacaagttaggataataagcatagtagctattattaaatgctagggtgtgctgcataactgaaggacagtgtttctcacagtttatctccaactctcatggccaacccatgagatgtatatcattatccccacgttttgaatataagaaactgacactcaaatcagaaggcatgtcagtgaaaaaggccatattcacatcccatctaagtctgtctgacactaaagcccacactctctccactacactccaccttgtctccagaatgttttgggctgtttaaatgtgattataccaaagagcagttgaatgcactgaaaaattctgaagattcctcctgtcccttcgattcactgttggaaaccattgtcaaggtagtgtctggctacgatagaagggatttttgacatggcctattgttttatctttttaaagtaaatgtaggtgcttttgatgatcataacactaactgttaagtctttaggcataagaatcaagcattcaactaagcatgtttacaaatttgctttcagcccagtggatctatccacttttccatttaggttgcacatttagatttcggagtttatcctgttatcttcaaatccacggactgtacactctttgagggaagaaactcttagtatctagtcaagtacgtggcatgcaatgggtgctcccaaatacttgattaatatcatatgatataatgtaatatgattcttcataaacagtgagtgtttataaatacagtattttaaatgtcattaggaatcttctattggaatcttaactttattttaatagacctacttttaaagttaataaacataatataaatgtggacagggctaagatttttccctaagatttcactctggcaagtcttcctggagatttagccatggctatttttatgactgtaatttccttaatatggggcctcagccatattccatcatcataaatccctttcttgcacttaaaagcaatgttgaaatattttccagtttctatatcttaactctttacttagatccattatttccattttgagattatcttatgtaaatattgtagaagattttagaattatataataagaaaatactagtataccacctcagaaatcttaactaatagatatgttttcaaatgcaaagtgaaatatttaaagtaattattcaagtaaataaagagaccatctttgtcccaattacttgaatattttacgtaaagttggttttatgcacttgactttgtgtttaaactcaagtttgtagtattgtctactggacattgttagctcaggaccttttcaggagcaaggaatgaaagaatcatttttaaacttatttaaaaaaagaaataaggaagaaaagaagaaattttactggctcgccttagcttaagacatggctggatacagatgctcagacaatcacatcaggagcctgcctccctccgtgtctgggctctctggcctcttgggtcagtttcatgctcaggctggctttctccacatagtggcaaagatgggcatcagacatcccaagttaacatcatctttagtgctcatgctgtcagaatgaaagaggccctctcccagcatccatattaaatctccaaagagattctgtttggccttgctttggccacatactcaaccctgaccaagctccgtgtcaagagaacagagttcgttgaaaggccagcctggtttgcacactcattctgtgttgaaagatgtagaccatgtgattgacagtcccaggagataggagagggagaattttcaaaagagttgccggtataagagacagtggattctgggaaggtaaaaagaggtatttattaaaatactgtgcctttggaataaaaatcttttccaggaaatgcaaataatttaaaacaattcaaataaggatcatacattttaaaacaattagaaatacactcagaagaactgaattgctcatttagtagatttcagataatattttctcctctttgaacctcagttttgtcatctggaaacacaggataatgcttaccttataaggtaatcatgattagaagagatgatggagctgaccatatctatttactataaagtgctatctacatagttataaattatgacagctaagaaaattaatccctaaagaaagcaaaattacctatgtcacggtttagaaagtctctctcttaagaagaaacttattctattgcctctgttgggttttttcctgaggaatcggtgtttgaatgcaatatacatttttgtaggctctgcaatgtttttatgatgaggacagtcatagtgttgacaattactcaatgaatacttagagatttgaatgtatcgctagatttctgggaaatgaaaagaccaatgtaagctagttgaatgagaaaaccagaggtgggcagatggtggacagattaagtcgctggttttaaaggtaggctgaactggtatttgtaactattaataacagccatcttctttaaaggaagtactcctaaatatcaatagtttagtggccaaggtgccattgagatgatcactcccaggaaatgttttgccagtgatattaccttaactttcatctgaaaagaaataaagaaatgttttatggatgattcactttcacctgatatgtgcacaacattttaagagaatgaattagtcagtctgtttgaatcatctttacgtgttccttttagcagggaactcaaagttggttaaatggctagctctatttcagaaagcaaaaataacagaaacagtgaaaagacagtctatattgaaagcctgatccagacacatcatgggggaataaatatatcaggacaaaaatatatgaaaagtgaaagtatttctggagtatttcactaccaatataaatattaaaatgctcacacagccagatctggcaagttacatagatgaggaagtgaaagcaataatatgccaagtcaatggcattggtgtaaaatgtaatcatagaggaacaatctcagagttgaaaattattagaattggaaaacactttgaagttctttagttccacccaggagtatgccattaaatatttaataaccatccctctgcgggctttaataacaagccctgatttgtagtgtttgccaatttctatggtgtcaatacagccaccatggctgattttaggctaccaagatgaggtcactgaaacacaagttgggaagagatgcacatagtaggctgtcatgagccagcacacagctggttcagcattataattttcaaataagaaagcagttgacctcagaggagttgggtgacttgcctgggtcatacaaataattagctgcactgccacaactaaacctaggccctctccagtgtttgacctcagaattgtgaatgcattatgaggaaagcaccatgattgattgattggtaagcccacgtgactttctgtcctagttaagttcccctttaagggcctccatagacatttctacattgagtttaaactatagtctgcctatctccactactggcctgagatctcactgacatttggaaagcgttttatttatctttgtatcttcagcactctgtacagtatctgacacttagatgcttataagtgtttgttgggggccatgtacgaacaatagagaacatgcattgacctgctatgtgccaggcagtgttcttagtgatttacatgcattaacttattgaatccttagaataactctcacaagtgaggtaggtactataatcctgcccatattttagatgagaaaatacaggcttagacttacttgcctaaggtaacatagacagtgattggatttaaaccctaaaatctggccagtgcctgtgcacttggcctctcagttgtcactcatttaactagcagttatcatcatagtgcccagctcagcgccaaatacttctaaaaggtctccctcctttccttaggaaggacacaaaacgtttcccagaaaagatctgatctgaccaacacacacctttgttaatggggaagggcctttattaatgggaatgatcaaggaaatggggcgtttttggtgattacattttctcattatctgaggtttaaacagaaacctctagtttaattaaaatttctgttgctgacaataggccctagtcccatttttttctttaattaaaaaagttaacctttttttgatgtattcacttgaaaaatggcatcaccatatggtaacagataatgtaaagaaggtgtaggagattaaggtactaactccaactgtgttctgtgagggtttttctttaaatagaaaatatattcttcttccccactgattttccatttcatcaaatgaagtaacaaaaagcctatttctacatgtgtacattttcttggattcttgtccactgagatttagtacagtgtgtgacttatgtgcgaaccttaagatatgaatcttattttaaaaacataatttaatataatatctctaatttttttgtttttgtttttattttttttagatggagtctcgctctgtcatcaggctggagtgcagtggcgcaatctcaactcactgcaacctccaattccctggttcaagagattctcctgcctcagcctcccaagtagctgggattacaggcatgcgccaccacacccagctaatttttgtacttttagtagagacggggtttcaccatattggccaggatggttgtgatctcctgaccacgtgatccacccacctctgcctcccaaagtgctaggattacagattattttgaaggctccttcaaaaagcctagaagaaaaaatgtcattcacacttcacactgcattaatggacatcaactaacatgcaaattggttacaatatttttctcccttttggcaataataattcgtttcctttctttcattataatttctacagaaaatacagcaataaattatatattaagctcaattttgttagatacactgataccatattgataagtgcagttaacttttcacataatatttatttttcccattgtgctctagatggtttagatacatatttgcagtttggtttacagtttgtatttgccctctagtacaacaaattgtccctaatccttttcttctatcccttgttattccctctaccagcaccaaaaatttgctagtacattgcaaaacaatgagaattacagataaaatagcaagcatttatatatactctatattgatcaaagtgctttcagagatgagatctctttttgatccttaaaatggtcacgtgagaatatctgaccctgggactcagaggtgggtgattgcctggagtcacacagctagagagggaaagggctagaatcagagggctgattgtctgacttctgttctagtgcatgctcccacctcgctttggaagctgcttcggcatagtgaagcacttaagagcatggatgggttcttgttagccagacgtggaattgaatcttggttctaactgtgtgattttagcaagtttgcttatctagaagagaaggataataatacttccttcttcacagggtggtgatgaagagtaaatcaaagagtttagcagaatgcttcccatatggtaagcactcaatacatgttcttgttatttttattattacatggctttgccttactgaggcttcatcttgtcctctggtccaactacagttctctagcttggcttatcccttcataacctgtacccccagtggcacgatcttggctcactacaacctccgcttcccaagttcaagcaattctcctgcctcagcctcccaagtagctaggattacaggcacctgtcaccacacccagctaatttttttgtagtagagatgggggttcacagtgttggtcagcctgggttcaaactcctgacctcaagtgatctgcccacctcagcctcccaaagtgctaggattacaggcatgaaccaccgcgctcagccaggaattttcattctttatcctcctttgagactcggctctagcatcatttccagtcgagttggtctcccttcctctgcattctgataactgttaaccatcaagtgacttgagcttcccagggaagggcatcatgtctttgtagacatccaataaatgttagtagaagaaaggggggtcctgccaataatcatatgtctttcccacaatttaaactccttttcaccctgttactactttttgcttgtcttccctttgataaacattctacttcttcatcacccattccctcaatttaacatctgatactactatagaaactactgccttgaagatcaacaaacgggttccatgtggaccaacgtcctccttgagaccctcacttggcttttgtgacacagtgcaatatttgctctcttgatgcctcactgaccttaaccttccttgactcctgcatagatttctcaactgtgggtatcccctaagatttaggccatttgccttctcttctttcatctagtccattcatgaacacacccattcctggttttaaccatcacctctgtgcagataatgtgcaaagtttatttctagtcggagtggagtctctgttactctgccaatcaagttctaaatttttattccttctagtgcagcagtggcaaatacctgacactcatgtgtctcactcaagacagatactgtttcacccaagactgatcatgccgctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacgtggttaaaaccaatctaccattcccatatattcagcctaacttcccagtgcagtctaccctagttttataacttgttctactttttccagataactgctaatcatctttgtttgtctttgctttcttttttgcactgtgtttgatatattagggtatcaaatcctacttattcaaatatgtcccttattcattccttctatccttggtgctaccatatttgttctggctcttgttacctcattatgggatataaaaatagcctgtcaactggtctttccattgccaggatctctctgttctaagccaccctgcctccagatcaatcttcctagagtaaaaccttcattgtatgacggtctagctcaaaattccttaatgattattaatcacctcttaaagtccccaattcttagactattagtagggtaaaattatttttgatttggagtcaaaaaattttggacgcaaattttggctactacacttaaccattatgtaacttcgaatttcggcttaatttttattcatcatttattcagtatctatttgtttaacaccttctgcatctcaggctctgtactaggtacttgggatacaatgatgagccaagcagaccttgtccttgctctcctggacctcacaacatggtgaacttgtctctattgctcatgatcataataatcctaagtacaggctgtgcttttttcccttgatacttgtagcttttggtttgtgctatgcagggtattgtaataccatttgcagtgccacaataatcagcatatatgtgttatcactcagccacattgcagcttcactgaagggcaggggctatgtcccatttctcatagcgcaagcacagtgccctgcacataccagctgctcagtgatttctgatgtggtttttgtagatccagggttagtctttggcagtcatgatgcctagtatgtttttagaggctccctttgtcctatcagaattatgctatttaaaaaaaagtcatacctatttagtttatattcattctaaggcctctcctttccaacctactaccctgcctataactattataaggagaactcacaatgtttataacttgtgcaccttaagttttaaatactgaataacaggcccattcatgtttcctcatagaaatactgtctatatgcatacaatgaaatgttaaaataatgttctttttactaaatagctttttgacttggtaatgaacaatatgttgtttttccctgagaagtagttctaggactttagttctgaagattatgttgtattttatacattttcagcctcctgtttttcagttcccagtgatcttacattaaacatttgtctgtctaaaacaataggttaactatagccaaattataaccataccattcctctccacacaaaatcctataaacagcatgtgatcatattgcttctagaatttatgattgttttcttccaaaaggaagctaaatttagcctagtaattctacatgcgctcaagaaaacaatgcctgctgtgatttctagaataaatgaatgtgaaccacagttcctttacttgactaacagagaaagtttaaatatcaacctagtcattaaccacagttattaaaccacgttaaacaaccagcaaggggttaagaaagaaagttgctatgttttttctttcattgctgaatgagtctaacttagttactgtatcaaccttaatacagaacattgtttgcatctcaatggttctctaaaattattcgttcatggcttgagttctaaaattaaactatgtggagtcatgtccaaccgcacaatgcatctttatgtgaaacttgctagagtttttgttttccttctatgtaaaagtccagttgggaagctttatttctgatagattaaatggtataggtctttcagttttctcttcatttctgacaactgaactgctctcgccttgaacctgttttggcagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaatagggtaagtcacatcagttccccacttataaactgtgaggtataaattagaaataagtatcagtctcaaaaagaatatccagggcttcttttgtgctttgtaaatggtgtttatccaaaatagttgcagattttttccaagaaaattgaggaattgaatcttcatttacacctaaaattatatctttaaaatgtaaatggtaactaaaagaaaaatgtttttacaattcagatttgcatgttcgtgacatttcagattatattaaagttatttcccatataagcttttttatatttacacagattttatcagatttacacagattttatcagatttacacagatttttatcacagcagcaattcccataaaacataattattgacatttctatataatctctgcaacatttacaagatgttcaagctaatttgtatgccttaaagaattgttccttatgagattatattctctcactgatacacaactgattaatctatattcttgacattacttaaaggaacttaactttaaaaaacctcttctgaaatgctggtaaataaaacatttttaaatgagctcgtatacttctctaaataacctgtaagagtagagaggaaatgtttgttcccaagtccttcctttagagcttgactttaatcatggacttccttctggaaaagacttgtgtctaccaagttctagcttggcactttacctggttggtatttgttatttataagcataaatattttggttgatgattatttatacttatatgaaatggtattttcttaggagctgttagagatattcttggtgctgtgatttaaatatagtaacagctaccagctatacctggagatttatcctgctagtcagttgatcacctggtctgagtgtttattgtggctttgagtttcttgatctgggccagatttggaatacggacctgactatgaccatcattgaatgaacaaatagtatagcttttctaaagacagtttgactttggcatggtatgtttcacttactttaacaggtttcagtctaagatataaaggttataattgcaatcaggtagaacattaaacatgtcctcagtagcataaagtatataatttgctgaggggtaaaggcatatgaattcagaaacatttggttgacttttgctgaaatgtctgggacacttctctagatggaaactatagttaactttttatgatgctaggaaaatacttccaagaaagtcagttcatcttttggtgaactaaaaacaaaacttccttcctctctcttccaaagtctatgaatatacataacataaatgcacatacattccaactaagacttatttccccctacatacatttaatatatgttgcaaagaagcaatagaattccttatgaagctcccccgtttctttactagaaactacaaaagaatgaaaggaaacaaaatgattttcagaaacctgggattaggaaataaaaatataatattaatagcattacagagaagatatttttctgcatccagtaagttgattctgagacacaagttttaaaagagtctattaggaattcctccagggctcctagagcacatggatttgctatttaaatctttctttgttaaaaattaaaaagaagggtagggcaagaaaaaaattaaaaagagaattcataaaggtatattgatatctcattttttaaattttgtacatttcaatccttagatgtaaaaatacttatcaattctagaaattctcaaaacacatctgaattttatcctacccttttgacttttttagtgttccaagggagacaaacagacaggattagccaatgaaattcaggtcagttttatcgcccaggaaaaattcccaaaatgcactagccacacctgaaaccattatcactcccatcacaaaaattcttgcgggaaacaagatggaacttgccaacatagtcttcttacaaaggaagccaacttttacactggccaaattccatagacaaataccttcaaacctcctctatttatttgcctgtttatcttctctggttacaaagatcaaaattcttctgagactgagactacacatattctctctctccatataccccatccagacctcagattgttccaataatgagcatataatcatttcctagcttaatgccaaaatgaaggcacctagagccattcatcacacacaaaaaaaacaaaatgattacaagatcaaagctgtttagcaggactctcaagcaataagatgactccattttgtcttggcagatttacttggccagaaatcaagtgacccttttaataatttcttggaactgagtttttactttggcatcaagtttggtgaaaagacacacatattgtagttttgttattaacatctctaatacatttataaagggactcttgtggacaaggttaagaaagctgagctgcagcagtaactttctacttatgcttctgcccagtcctcagtgttgacacattgctgaaagagggatttcctggcactccaagagctctccaccatgtgcaaaaagtgtttctatcacaagatcagataatgggagtgccagggacgggccttttacattttaggggtccagcaggtgtaccaggcctgacttgcttgtttaggatcacatattttgttgcttttcccagtctcacatttcatgaaatatgtctatgcaaactcttcacatgcatcttctcatattgatgacatcacaaaagccctcttttgagtcatttgataattcccagtactcgtcatcttcacccataagctatttgtgcttcagaactctttgtctccacatatgatgctgtttctggaaacttatcccaagccacaaatgcccacttatagaataccagtgttgttgactatgtcagttgttctataagaatatattcttgatcctcacaatgtgtccattttttatgttgcttttgaaagtgattctaaagaatttgtttacagtgacttccaatattgagtactatgagattatacacccacaaataattactaaatctgtttaatatctttacctcctcctttacccattcatcaatcaacctctataagcatcctaaattagtattgattgaagttgttttaggctaatgcatattctctaaatagcatattattattcaaaataaaataattgagaaaattgtcccataatatggatggaacctttgtaaaggcccatatgtagggagaaaaaaccctcatctctatttgaggataagcagtagcaaaaatttcattaacttgtttaaaattaagtggaatttaattttaagactgtggaatctctaacagtcttttacatataagggattgattaatgtgacaatttcaggaaaaaaaggagaatcagtacacattggcccaatctcctacaaatgagaatcaatacagaataagagaattttttaaatccccaaatcagcaaagatcctgttccctaagttatagaatatttattaaaacaagtgaaatcgtacattttagaaaaaattttaatcaaagttgaaattagaaaagcattcttgaaatagctctcgcctctcagaaaatacaattagcacacaacactgtttttcttgaagttctattatcaaagttttgctctatagataagcatttgaaagacctgtagcaagtattttcgccaacatcttgatgaccttaatgaccaaagttggatcaagtgaaggggaaaagcatttggtgccagacacacctgggtggaagtcctggtttactgcataccaaccatgtgacttctgccacattacctgacttcttggaggctgagtctcattggtatcatgcagataacaatacctacttcacaggtttttgtgaaaatttgggataatatatatgaggtacctggcacaagatgactataaatttagcccgttgggagacagcatggactaatggaaagagactaaaatcagagatgttggttcaaatctgaaccccaccgtcttctacctggatggccatgaaagcattatttaaactctgaacccatcgtcctgcgtgcaggactatagtgtggacaagtatattaataacatctgtaaaaggtcccaacttggtccttggcacaaaataaatagcagctattattgtaaggaatacttgcgtaaagaaagacaaattcaaatgattggattattctctggaagaggcacattctggttctattgtttacaagtctttcacttccctctctaactgttatgagtgacctacctccataatggttaatttgtgttatgttgttcttaagattataatagttccaaaaaagagatggggtgaggagtggtggtagtttgagggggcagaggatggggagaaagacaattgaatcaaaactgtactatagtcaagttagaaggtataaattgttctccttcctctcactttcaatcctaactatccatgacctaagatattactcttatgtactttgtcatatcttgcattcaagaatttgcagataatgcagttttagaaaaagtcaacctcataggttgtttgtattgggcttccttgtttttaaatatcatttatactcaaattcaaagagtagccaactgcttcccaaaataaaggaaacttaaggtagtaattttccatctccgtttcacagaatgccaaagttaaagagtcactactcagagccatcaaaggaagaaagcaaagtgattagaacaattttaaaggaggacaaaaatcaaaacaagatgcaaacaaggaataataggaataggcagaaaaataaacatacagtgatgtttctttattatgattataaagatgatagatgagtaaaatcgagttacatttaagttgtaatggaagaaaataattgcagccttccatcaggaaaccacaaggaccgttattgatctgtcatcctcagggcatgtctcgtaatatttaataaaataaacaaagatttataacttttataggccatatatctataatctcccacaccacttgaactgtgaatgtggagtcaatgttacaaataacatccatgtgattatactggtttggcatgccttattccaacaatctagcactctcaagagaatgtattttgtattagggatgaaaaatgtgaagccagattatagagttttttacttattgtgctcaaaaatgagaaaatgttatccaatatgaaaaatgttgttaaggattcttcattcttaatattagacagcctttcaaacctaaatattaaatatcttggccatatgccaaatgtaatagctaccaaagcaaaatcttgcaagaaagaaaatccttgaggtataaagattcaatgtactttttaaaaaatgtaagtaaaaggttattaattttacatttcatttctttttctttcctagacactacttcatcctctcataggctcagggagtcactgcttcctaacttctttattttaattatccatgctactcattccacgaaaagtggcatattgcattattttattaaaagaaatttaaaattagtttctttccagaattttgtaacgccccctgagatcactgggcacacccttggggtgttagaaaacatgttacaaaatgaacctttaattccttttgctttttcccttcctcttgctgactgctctttaaaccattacatggctcattcacaagtctctctaccccaggaaagatgaaaaagcaaaggcatgatgtttttataacctaatagcaagagaacacagtgctgaagctgtcaccaaaactgtgggtaggttttacccgtgggttatattaattcatgatatgattgataatatctctcacttgtgtggggaatgaagcgttaactatgccgcatgcattttaaattaatttgacattattcttaatgtcctttcaagcaggtggcattataacctgtgtcttatttaggtagttgatttctacacggagattcatctgataaaactgatatcgcaaacgggaaggagtttgtacaaaatgaaataaatcttaaagttgatttttgtaaagcccaaatgttaattaaaatctttgaatccacaactctgatacatgatattttcattgacataaacatgattagcgatttctggaagcatgtgggatgctgcattgataaggatatgaacctccttgagtaataatgtatatttttactccaaatactgtttcacattttgggtgttacatccttacttcagacttctgccttatcagtggccatcccaccctatgttcttatctcctcagtctaaaaagaaaaatggggacccatcagaatttggatagaagaccctccaggaatttctgccactgcttattcatgggttggcacagacactgattcagtgggcacacagagttcagaatgattcagagcccagatatgtgccctaagtcacatctccagcgtccagggaggactgtaaagtgctcgttatcaggaaaatgaaaccaagggctcagctactcctgaagtcattaaaactccttcccttgatttttttttttttttttttaaatagtatatgtggtaaccgaatctaggatcctggatacattccagtctgctaattacatatttttttctaactaaaatgttccaggcaggttcatttgcatgtgaattacttgctgagccatgttgacttcctattctaaaagcctcactctgccttgggaagcagtttactgcacttcaccctagacctagtctaatgttggagcagacaaagtgtagctacccatatatacttcaaaaatattttccagtctccccacaagaggaaagaaaaatgtctagcaattgcatgctaatttagaccaaagctttgttttaaccattcttggtgatcacaaatggggaaaaatgatttatgaacagtataactataaaacaaacaaaaaaaaaccattgtgaattcagagtgaagtctgacttcatttgtcttatttgggtaaatcagcaaaatgttcatcagtcagaggacattaaaatggtagatgatacttcaaatcgtgccctagataaaaggagagaattaaggttagttttgatttgtaaaccattctcttcgaaggctgattttataaaaattaagtttgctgagtcatcatctcaaaatatatagttattcatgattagttaaaatttgtgtctgtgtatcaaagaagtaaatttgtatgatattaaattttctaacaatgttttaaattttaaaatgtccgattaacacttgcatctagcaaccagtctactaactaaactataggtgaagtcatgctcaggaaatggggaaaatgcacagattaaattggtctgttagctctgagtgaatcaatagtatttagtgctaatgcactaaggagattacaagcactaatgcagtagcagtcaatagcgaaaactaatatctctaaaaaatatcttgacaataaaatgtgcaatattttccatttatcttaagctaattacattacctgcttgttctttcatcttattagtttaagccaagtgctagaagcctaaccattttatttagtgcataaaagggccaaaaccttgtaatcattgttttcagcaggagacagaggaaaggattaattcatgtaaccaagattcaaccagaaattcaacagatatttatttagtctctaaacctgatagtattacaatggagaatgagctagactgtacctgtcttcaacaagcagatagactagtgaagatgacagtaaacattcagtcacaccagtgaacaaatacatcatgataatttatgaaatgtgctgtgagggaaataaacatctgtgaatgcaaatgagagggaatatctaaatttggtagttgagtcacaaaaggctgtcctgaggaggtgaaagctaacctttatataaagcttaaaactttaaaaaagcaatacgtctttagtacacaggcaaatatataaactaaatatataaactaatagtcattacttatttcacaagctttacatcttaactacaagctgctacattaaatcagctttcttaagtggtttgtggtcattagtgcatactatcttacacttagaaaaacattgcaagaagtagtacaatgctggagaatttaactttttaaaacatttcctgccttaaaataaacagcagtaaatgtgtttaaacattcttttgatttctaaatgaattaagttactttttattatgtggttcttcttcatatgaagaaaataatatgtagattactagaagctaagaacatactttagatcctgctcacactcactgcctttcctggcctgtcaccttaatcagcttctttgaaaatcactgtttcttacataggccaggttgtttcttccttgtttccctcttcttccttctatggccaacccttgggaccccgtttgtcagaagaacatgttcctctttggggaggaggggattgtccttttaccaataagttttatgaccaagagaaacataagaatctgagaacacacaaaataagctcttttgaaactatcaaaattataaacattaatagaattcaagggaatgtgatgctgaagtgatcccaagtcacattgtctttctgcctctgtgcactgtactctgcacaattgcatccatttttagaccatttccttctcatgagaatcatgtgcatggagggccaaaggagagacaagtgctcacaaggatatcatgagcacttatgaatgtacaaatgagtgctctccagtcagtgccatctttatattgttccggtttataggcaatgccttcatctttacctacagacacatgttgcctttctgtttcattttaatcctgttcatctatacatatttaatcacacaaatatctaaataagtttatgtcttgtagggaaggcactttgtcatgcttctttgtacctaagcatatgctttgcaaatcataaacaatagtgttgattttatttgatataaaaacttggattctcaaaagaaatctatgtgttcacacgataaacagagaccatctgaattgccaaagtatgactgaatcataagcagtattgttttagtcatctttacagaccaggaagatttgaaatacaggtgtaaaaagatgtgtgaggcatcaaaagaaatattcacctttctttgtgttcattttttttatttttgcttggccgagaaagaaggggtgttttccaagggaataggaggcttcagggcttattcctgtgcctacaagtcagagaggtcactggcttgccccttcctgaaggctgtaattacaggcagaggactatttattttcccgtaaggcgaccagaatcttgagtgtaaaaaactgtttacaagagtacactgtgtataggggttacacacaacctcaggaaaaataataggaaagtgagactatttttcttcatgtattcaataatatgagaaggtccaagactctggaaatgttctaaagtacaataatagagatgaatatgaggtcaaattaggtgatcctggggcttaaggaactgaattaaatgaataaagaagaggaatttctaatagggcataatctaactgataatttgttaaatgtaaacttatttgtggctccaacatcatggtaaacaagaatgaataaatgtattagtaagagtaattgagaagtatttctaatgtgaaaaacaccaattacattgggtttatctggcgccaatgtggaaataaatgagcaatatttcttactctcaactaaacttactctcactttcagaactgttataggaaaggtattgattcaagtagagttgggcatgcaaagcacaagatcaattctgttactggcctgatattaaggatattagtcagtgtttgaaaaaatgatttgtaatatataagtagtagtttaacaaagtaggtaaaacttgtaattaatttcaaaaggtcaaagcagagattattgacatgtacaaagaggacccgctttatatgtgcctgctttgaaaagtaataccgtagtatggtaaattgtgactaattctgagattttctgtctagattctttttaaaaccaaatgcttaagaaaaaaacatgagacatgagtagcaattacattttttaggctgagtaggtagcataattgcctcatgcctgcctcctgtctccatttgtttttagtagattttgcacagaaaaacatgttgacctcggtactgaaattttggagttcactatttgcggcacagttacagatcacagaaaaaaatgtacaacaggacttcaccacacctaacaaaagaaagttttcttattaaaaaaaaaaccctccaaattattgtgagatctagggtaaccatggtgttaactatatgctatttgatatcttataaccctggtgataagataacaatccaattgaatgcagatgaactcatgaaaaaagaaggattatgaaatatttggaaagtaaacacctaaattttcataagtaaatattaattatttgtgtgatctttagatatgaaagcttcccctgcatgcacttggctcttggaaccagctgttaaaactcccagcaccttagttaataccctgtatgctggtggttcaagaactagttaagaaacagtcacattttctattttcactgccaatgtataataaaatctctgttccagtgaatggctggccaattattttaataacgatgttggcatggcttcattttacctttcttgctattagcaaagctttccttttgtactctgaagtacgggtaaatcacaaattaaactgagctgttgtttgtttaatgctgtgtttcctgctaaccttattcttgtctatcaacctgaacgtagttccccagtggctcagaaaaccctcaattgggattaagtaatagtttacacaaccttgctcagtcattaacctgtgttgactttctcattcttgtgttccagcctcatttaagagtttcttaagcactctatccagttgctggtttggtgacaactaacaatacctatttaatcaagaaatttaatatttccaaggaatcatttatcgtatctcagacttcttcattaacataatctaattcagtcttgtattccttcttcaaaataaagcctggtttcattcatagtaaatatgaagcttaaaaatttttacttcttttcttctctatacacacaaagcagaaagagaaaattgtatattatcattccagacaggtttttttttttgtttagtgtattgacattgatgccaataagataaaactagacctcagtggctcctcctcaactccacccaatctatttgtctccaaagtgctgttggagtaagtaatctttgttaagagcaaacctatttgtatatctgatgataatctgagggataataatatgatatttaaggagtttctgtccttggccctgactatttcctggtcctccttcacgcccagtgatgtgctggtaaatgttaaactctggggggaggggcagcagaagcccctaatttgtagcatttgccaatttctatggtgtaaatatcccactgagccagtttcaaggtaccactgaaacagcgttagtcactgaacaacaatgaggaagagatgtacacacttggctctgtgaactgttatgagatggttcaagcacagcactgccaccctgtcctacacgcaacctgtcattcttgtagttcccagaatccatcagcctccctcacaaccctgccttaacacgtgtagcttggtccacttcagattccctttaacactcattttgtcaagtgaacactttttccctattctttaaaacttccatgctggcattttccttccccaggacatttttccctagccttcaactcatcccctgccccccatattctggatttgttgcgtttcctgagcacaccagtagcactctgcttatttctaccatgtctcttatcacactccgtggtaatgtgtccaacagttccatcgttagccccctgaggggatgaactatgccatttatctccacagtcccagcacctaatacaatagcttgaacaatatatacatttatcggatgagcaaagaagtatgacagagccctgtatgtaaaatatattactataaatagaatgctgattcataaaaataattatttagataaaacagtttttccgtctctcccctaaatccctaaaaactaatttatagaattggggagttttcaagagctaaattagcactggagaaaaactggggagttttactcactattacctatgcccctcccgtcccccccacacacaccctccttcattcaccagtctgcaatgaagattgatcaaagaacaaagaagaagaaaaatgaaagaaaaaggaaagattaagatagggagggtgaatagataggaattccagagttttgtaatcgaaatttggaactcagaattaaagtcattaaaaggagaaagagggaatactttctctgctcccgtaaggttttctcaagcctttcaacagcactcaccctttgagcgggtgataccatctgtaagagggactttacgcaatgctttagtgggcgtggcttgagcagtgacaccagtagagatacccccttgaaactttcatttgaagtccacagattttcactattggtcaccaatccatgatttcaagttgaaaatgatatatgggttaaggaaaagaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggggtaatggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaggaaaagaagttaagggcaaaggtctttatcaacaccatccttcctgtggccacaggatcgtaatcccagtggcaacattcaaaggcaccaagtacgtgcttggtacagagagaagctttcctgagcttggccttggtgtagatgcagtgagaactgagtaagggcctctggcagggaccttggctgctgagaaggggagcccacagatggaggtttctgatcaacaggtcctatcagaaacaaggggagcagataagtaaagagtctcactccacggtggcaagatggaaaggagggataagaggtcatgacagttggattaatggcaggctagaatatagtcatgggcttgaacgatatattgggacacaattgaaggactcttgtttcatccatcgttcatctctcctggccctctgtgaagacatttatcacctgtttctattgaatgtgacactgttaggcacataaacagaccatggctcttaccacctccaagaagaactacttctgttttatttgttagtgcagggtaattggtgttgtgtcttctgaaaatctcttatacttctatgagtaagtgcattgaaattgtttctgttaactaagtagaggaaagcagaaaacctctttgcactaagcattaaaaccttcctaacttggaacaattttctttatgaatcactctgtcactcctggctatgattgaagtgcagtatgaaggctgctaaccaaaaacacatggacacagtctgtttcagatctgattcaccttaggaaatgatgataaagaagcaaaagttttaacacttagaattccaaggtccatatcattgtagaattgattcttttgaattgtggtggtacctcaagagaaaggatttatttatttcatttatatttaaatgcgtttgtatacatatgtatataaacccatatacacatatacataaaatatattctgctccaagtatttatctctcttttctctttactaatccagcttccattaagaactggctcaacttcgacctctgccatgagccttctccagctgtttaagcccacacagatcttatttttttcctagtcttagaggatttactgccagtacagtgttttcagaatgtaactatcaactgagttcttatactttgcatcagttagctattgtacgtgtcaatcttttgtctccctatgtagaggctagacccaaggtagaagcatttgccaggattgacaaacgatagcctgtttttatattctcaacaagtgaaaacttattttgtttatatttttttccctttttatacagttaaacactcacatgcacgcacacacacacacacacacacacacacacacacaggccacagggaccctatggccctcaaagactagcatatattctatctagccctttcccaaaaaacatgtgccaacccctgcattagagaatagtgtaaaataatagtggacagataacaggtccacaaattttggagagccatggatgaccttacttatgaacttaagtaattctcttcaataggtgtgagtgtttccattttacagatgatgaaattgaggctcattgatctaaacaattggattttgtcttcataggcattatgagggcttactagaccaacaatagtgataataataactgtttagttgcacaaggcagggatttatgtcttttttatttgctgccatatccttcagcacctagaacagtctgtcacatggtatggtattatattcattttccagagctcccataacaaattaccacaaactgggtggctgaaaacaacagaaatttatcctcacatggttctggaggccagatgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttccaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagttgtagaagtcggcttaaggaagaagattctaaaatcaaaggaatcagattgtaggaggccatgtaggcaatttcctttaattcaatagaagagagtataagaatcagccaggcatggtggctcatgcctgtaatcctaacactttgggaggtcgaggtcgaaggattgctagagcctgtgaattcaagaccagcctgggcaacatggcaaaatcccatctctacaaagaaatacaaaaattagccaggtattgtggcacatgcctgtagtcccagctactctggatgctgaggagggaggatctcttgagcccagaagggaagaggttgcagtgagccaagattgtgccactgcactgccgcctgggtgacagagccagagcctttcaagcaagcaagcaagagggaaggagggagagagggagagagagagagagagagagagagagagagagagagagagagagagagagagagagaaaagaaacggagagagagggagggagggaaggaaggagggaaaaagagagaaagaaagagaaatatgaaagaaagaaagagtaaggaaggaaagaaagaaggaaagaaagaaaaagaaaagaaagaaagagaaagaaagaaagaaagaaagaaagaaagaaagaaagaaagaaagaaagaaagaaagaaagaaagaaagaagatatgaacaataaaggaaagactcaaagatggttcagatctcaaacttacggagagggtagctattgatgcattgagaaataggaagctggaagaggaaatcagtttggagagaaaagtgatggctttgaacatcatcaatggcgtattcaaacatagcttgaaggcatttgcagagacagggctggtcctcggaagagatggcaacggggtgtgtagagttaggtcatcaccacgaggctgtgagggcagagccacagtagcttccatcaccttgtgaatcaccagtgctcagcccgtggctggctggccggatgcctgcttatgctgtgctcccggctgtctggctgcacacacaaccgcagagcatgccctctctggctagggcagaaagaaattgaagcctcttaaattttgccccccccagctttgctcccttgctaggacttccaggccatgactattgaagccatagggcaggattacttcctcaagaggcgttagtggaaacagatgtgttgaggaagcctctttcttttcaactgtgccctgagcacatcagatggagtcctcttcatagcacaaaacaacttggtcagattcttagggtttgaccacagcaccctaacagcctggccgtgcattaaggaccccaaagagaaggatctgctttgccagagagctgactcttctgtattttacagacaattctgaattcaatgtcaacatcttagacatctcagtacagacagtaaagagttaaaatatgtctataagaaacagcgccagaccctgaaattgaaagctctgtgcctccctgcgtgcagtcagttccacactgtcctctctcccagttctatttaataaaaaaaacacatgagtgaaatttagggaaataagaattcctgaaattaaagcaattaagttttcagtcaactgtatgaaaagctctagacaaagaggtactttctatttcaaaatatgtatttcccagaaaaccattaccatatctagctagaatttctacaaagaatgattatgaataaagtatatattcaaatgcttctggtaatttagtcatggtcaaagaggagagaaaggtgatacaagtgaactggcaaagattttacaagatagtacatttttaaaaattttatttgcaagactgatttaaattatctatagatgagctaaatctgtcctatagatcaattaaatgaatcactattttaaatatatcacattcttaattacactgaattaaatataattacatattcactgcatacatcataatgttaattaggggaaacattttgaatcaaatatattgagatatatagcacttcaattttctttttataaaaaaagctatatgactaagtcaggtaaaaagaatctggcaagtactcatagaaagctaaaggaagactagattaattgatgtatcacatcaaggcttacaaattgtagaggaattcctattctttaactctatgacagtatataagactttgggctaaggaagcaagtttgcaacaagtttttaaaaaataataaaacaggaggcagggcacggtggctcacacctgtaatcccagcactttgggaagccgagacaggtggatcacaaggtcaggggttcaagaccaacctggccaaaatggtgaaacccagtctctaataaaaatacaaaaaagttagccagatatggtggcgggcacctgtagtctcagctattcaggaggctgaagcagggaattgcttgaacccaggaggcggaggttgtagtgagccgagatcacgccactgcactccagcctcggcgacagagctagactccatctcaaaataaataaataaataaaaattttaaaaaataaataaaataaaaaataaaacacattgtttaccattgtttctcagagacatacgattattttagaagtggataagccttttttttttatactttaagttttaggatacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgttcatgtgatctcattgttcaattcccacctatgagtgagaatatgcggtgtttggttttttgttcttgcaatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgtcgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttttttcttgtaaatttgtttgagttcattgtagattctggatattagccctttgtcagatgagtaggttgcaaaaattttctcccattttgtaggttgcctattcactctgatgatagtttcttttgctgtgcagaagctctttagtttaattagatcccatttgtcaattttggcttttgttgccattgcttttggtgttttggacatgaagtccttgcccatgcctatgtcctgaatggtaatacctaggttttcttctagggtttttatggttttaggtctaacgtttaagtctttaatccatcttgaataaatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtagttttttccaattctgtgaagaaagtcattggtagctttatggggatggcattgaatctataaattaccttgggcagtatggccattttcacgatatggattcttcctacccatgagcatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttaacatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattctctctttttctattgattggaatagtttcagaaggaatggtaccagttcctccttgcacctctgatagaattcggctgtgaatccatctggtcctggactctttttggttggtaaactattgattattgccacaatttcagctcctgttattggtctattcacagattctacttcttcctggtttagtcttgggagagtgtatgtgtcgaggaatttatccatttcttctagattttctagtttatttgcgtagaagtgtttgtagtattctctgatggtagtttgtatttctgtgggattggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttcctcagttctgctctgatttagttatttcttgccttctgctagcttttgaatgtgtttgctcttgcttttctagttcttttaattgtgatgttagggtgtcaattttggaactttcctgctttctcttgtgggcatttagtgctataaatttccctctccacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttctagtttgattgtgctgtggtctgagagatagtttgttataatctctgttctcttacatttgctgaggagagctttacttccaagtatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagctcttcctccatccttttattttgagcctatgtgtgtctctgcacgtgagatgggtttcctgaatacagcacactgatgggtcttgactctttatccaatttgccagtctgtgtgttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatatggaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctctcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttcttttcctttggtttgaatgtcctcccgtagctcagagtaatttgatcatctgaagccttcttctctcagctcgccaaagtcattctccatccagctttgttccgttgctggtgaggaactgcgttcctttggaggaggagaggcgctctgcgttttagagtttccagtttttctgttctgtttttttccccatctttgtggttttatctacttttggtctttgatgatggtgatgtacagatgggtttttggtgtggatgtcctttctgtttgttagttttccttctaacagacaggaccctcagctgcaagtctgttggagtaccctgccgtgtgaggtgtcagtgtgcccctgctggggggtgcctcccagttaggctgctcgggggtcaggggtcagggacccacttgaggaggcagtctgcccattctcagatctccagctgcatgctgggagaaccactgctctcttcaaagctgtcagacagggacatttaagtctgcagaggttactgctgtctttttgtttgtctgtgccctgccccgagaggtggagcctacagaggcaggcaggcctccttgagctctggtgggctccacccagttctagcttccaggctgctttgtttacctaagcaagcctgggcaatggcgggtgcccctcccccagcctcgctgccgccttgcggtttgatctcagactgctgtgctagcaatcagcgggactccgtgggcgtaggaccctccgagccaggtgagggatataatctcgtggtgcgccgttttttaagccggtccgaaaagcgcaatattcgggtgggagtgacccgattttccaggtgcgtctgtcacccctttctttgatcccctgaccccttgtgcttcccaagtgaggcaatgcctcgccctgcttcggctcgcgcacggtgcacgcacccactgacctgcgcccactgtctggcactccctagtgagatgaacccagtacctcagatggaaatgcagaaatcacccgtcttctgcgtcgctcacgctgggagctgtagaccggagctgttcctattcggccatcttggctccgtggataagccttaaaaggctcaatactttttaaaaatttcctataaaatccagaatctatctagatttttgagcagcctgtagtggttggaggaccatgattgtttactcatttggtcacctaaacatcccaagcaatgatttgttctgacagcagactgataacagttttttttactccttggaatcggaaaaaaaatcagcaagggaagcttttggaagccacccggtagagctggaagagaatttcgaaatcaattcgctcaacctctccctttacaggcagaaaatgtgctagattggaggtgaagaccctggagccagagagcctaggcttagtcctagccctgcactgaaggtaatgtgaacactcagtgcctcagtttccttctaggcttcttgttctgagattccatgaattaatatttgtaaaatgcttagaactgtgtctaacacattgtaaacactaggaacaaatgctaaggtcatgcaactcatcaatgcctccctggggtagaaccagccttggcccatgggcatgctcattcttcttttagacaaggctcttaggcatccctagagtgtgggttggccttcctatgcctgtacgtaagaagtatgatgtaatgtaaggaatataggattcaaaatcaacaattaggattcaaatgctaatatttattgactcaactctctgaatcttagtttcttcatctgtaaaattataatgatcataacaaacccaagtcacagacttgttcagaggagcaaatgagataatgtactttgaaaaccataatctactctgcaaatgttatgtaacattataattgtgagttcagcaaagccatgagaatgtttcaaaactgtttaggacatcaagaagttggggtggggaaaattcttaataggttttctccatatcctcattttccatttattcattgttttaaaatttatttttcttatgatatacatatatatatatatatatatacacacacacaaaagaattatgtacggtcctgcattgcttgcattctgagaaatgcatgaataggcaattttgtcattgtacaaacatcatagagtgtacttatactaacctaggtgatatagcctactacacacctaggctgtatggtatgaccttttgctcctaggcaacaaacctgtacagcatgttactctgctgaatactgtaggcaattgtaacacaatggtaagtatttgtgtatctaaatatatctaaagatataaatatgtctttataagtatacaaatatatctttaaatatactagtatatatttatagatacaaatgtataaatatatctatagatgtactagtatatatatttatagactagaaaaggcacagtacaaatatgatattattagcggggtgtggtaattcatgcctgtaatcccagcactttgggaggctaaggtgggagaattgcttgagccctggagtttgaggttacagtgagctacgaacacatcactgcactccagcatgggtgacagggggataccctgtctctcaaaaaagaaactaaaacaataagatagaatcttatgggaccaccataatatattcagtctatcactgattgaaatgtcattatgcagcacatgactatatatatgtatatatatatatatatatatatatatatatatatgggatataaaacaaatactcatatctctaccaccaggctcaaaaagggaatattacctttgaagtcccctgaatatcccatcctagcaatattcctccccctcctggaaaagtgggtaaacaacaattgtaagtcatgtgtttgtctttcctttgcctgtagttgcgctacacaggtgtgtgcccagaaaatattctttattggatgcatggggtttccttcttgactcagagatctcaagctatacggtatcttcctgcagccttatagtgtccaccttattctttgtcactatttccctttcccagccaataaagcacattacctctgtcattcaaatgaactcgtaaagagagattttagaaaagagctggttcacctcaggttcacctgagcaaggaatgggtgtcagtgactgtggaaagtggagcacagctgccagagcagtgcaaggacccaagaaatgggagggtcttgactcgggataaccactctgagattcattggatgtcctagattgtcaccttgccttacaccttaagggagaaaaggataaaaagataaggcagatgtgaaagctatactaaggagcttagacttttcctgcaggcctttgggaagcaactgaagctttgaagaagggaatgacagcttgagactgcttcaaggcagaagagataggagaccagaaggccagtgaggaagcacttaggctgggccaggggtacaggtgtggctggaagggctgcccagaagcaccactgtggaccaggctgagcaggactgagtgactggttagatataggaaatgccagagaaagagaaggtggtgatgactgaaatttcagagttacctaaatgcaagcatggtatgttcataaccaaaataggtagcaaggagagctaggtttgagagccaagctgattagtacagaatgcgagtggttatctctgctgtttccagaaaataaagattaatttcagccttaaagtcagggacttaaatgagatgatctcgaaagccctttccatttttgtaattgtgcaatcctcagaacgttgcccagaatagtaagcagaagcaaaagaaattcaggagtttgaacataagagagagctgttctctgatgcctgctccaatgggaactgggcactgtgactgagccctcggctcactgagtctcctcctgaggagtgtgataaaacctcacagggctgctgtgggtcttattatacatgaaaatacccacctcagtgcctggcacattctgggtgcaggaaaaagtttgatttcctccctcccttccttccttccttcctttttcctccctttgttaccataggagagagtcaggctggttccctgcgggtgctggtgtgaaacctgctctttagactcttctgcagttccccaaagcagctactgtcccagagaactgctttctgccagcaatgctcagttttaccctaagacacgataactcctggctttgagggaagcacaggtagcaaggggacccctgacagcaaatgtgtagttgttcttccagctaggccccagccccaccttaaatgccacatccaggcactgtgtctacagtgctgagataaagcaaccccgtcttttccacacaaatgagcagcaaacatatttgctgattatctttgagggacataatgaatcagactgagatttagtcatatttgcacaatgctttacatctgagatactgaaagcttaatccaaggtttccctgttagttgaagtcctactgttagggctcaaagacagggtgcagctctgtaagccagtccctgatgccttgatcccaatcattgagtttatcaggattctccataggaagacacaaggagcacctctgctgcagcaaatgctggagtgttagtttttcctagaggctagtgcctcaacacctcttctgcagatctcagctatggagaaaatgaaaaagaaaaaggttagagtctcctggcttatgaaatttgaatgccacttgaacctgacatatttattttttagctctaaatcacacaagatcaagaagttctgcagatcctattccaacattgtgcaatgtctctatatttacaaattttatttgatggggggggcaatagagacataatttaatcctattagttcttgaggagatactatttagagatctcactaattcctgtcctgaaggagaagacttgaagtgtgcaatataaatattgcattaactctaatacagagttctacatttacgccttacatgtgtgcaaacaggtgcacagaggctaaagttctggttgtattgctctccctccatttacaaaagatcagtgagttcctgcttgcagattctctgaggagacccttagtttcatctcctcttcattcttctgctggcctgattcagcaagaccaaccacaaagcaaactgagtaggcaaatgggctttatctctggtgactttgcagatgcactaatttttcagcaggctgtcattaaatgcctactgggtgctaggcataatacagggtcctggggataaaagatgataagacaattcctgtcctcttgttgatagaaggcaggtagtttgtggtcaaagactctcattcacacccaccagattgtttttatatcccagtgaatccattatgtctctggcagcaccacacaccaggtcaagtttgaggctttaaagttcccaggatgtcacctagacttagagatgaagaaacactaacaaaagaagaaacaagacaaccacaaaaacctgagcctgaagagctgccacctctataatggaatatttcaaatggccttagatttaaaattggtctttgctcctttaagcagattcccttagctctggctatctctgcaaaatggatgattgatcaccaatagaaacttaattatcaattaatcggttgctatcgaattgctggtacatctcagttatctgctactcctcagagtaatccatagtactttagtgaagaaatacttctaattaaacagggaaatagcacttgctaatatatcaaagtaaatgactagacctaaaacattagtattaattacaagagtcagtgggtttagcatctctaagtttctatttgctaatttattgccactgaaaatgaagaaatcgttgttgatatataaaatagagcattttaggtggtttttaatcataaaagtcagtagatgtaaaaactctggattgcatgtggcagacatttgaccttaaggaataaggtcgctatacagaaggataactaaacttttatttgtttgttcttaaacaataaaatgatttgaaatatactttgatcattttgtgattattatcatatgggatgataatagagaatttcttacttcctaatcattttcctacacttatagttacatacaaagatgtaatgaaatttgctctccttttcttccaaggtatacatcattttccttaatactttctcccgtccccatcgtctaccccagatttaccaattcccagctatctccttaggacagtcaagaaccaaatactcccatttgtcccttataaactcttttaacttccccaatttctggaaaaacaaaaagctttaataatatagttttatatctccatactcatcccccatctacttataattgattcacttgttcattcattcaattaatatttactaaacatctactatgcatgatagttaatcaactactggcaataccatggtgaacgagtagggtccctgatcgcagcgagctgcttgggagaagtttcacattatcttataaatcacgcaagcaaatgttatgttgcagcttgtaactatgttacagctatgctatgggtacacaggtaaatgatattatgagaatctacactagaagcatttgacttagatagtggggtcagggcaggcctcctgaagaaatggtgataagctaagatctgaaggagatgtaggagttaacaaggtgaatgaaggtggaaggagcatttcaagccgggaaatagcatctgcagaggcccttaatgggagaacacgtgacatatttggagcgctgaaagaaggcctgctcgctggagcactaagaacacagatctggagaagttgggcaggggccggatgatgggaagggagccatacagtccatgttaaaaaaatgttgttctttatcctaacagcaatggggaagcattgagtgttttaaatagagagggatatggtcagatttgtgtttgaaaaagaaaatcctgctgcagtgtgaagaacagatcacctggcaagggtaacagtggatgtggtgggtctagttaagaagccgccgcagtagtccaggaaggaatgaggtggctaggatgaaaattgggaggaagggcatgaaggagaagactggatgggtctaggaggcatttagaaatgaaattgttgggaattggtgatggactgtatatgggggcggagggagagggaggaattggagatgacacttagatttctgacttgtgcacctggaggaatggtagagccattcactgaggtgtgtagtgtcctaaggtcaggcaggaggaagattgtggtttctaggatgggcatgttgttgaatctgaggtctctgagacatgtgaatggagatacttgagtgatgttatctacaagtgctgggctctttgtttgtttgttttgtttttattgcgtgggaggtcttccagaaaacctgctagacaaattctaaaagaaatataacactcatgctgggttctattgtgagagatttatataaactagcttgtttaatagttacacaagctctataaggtaagtactatttttttagttctctctactttacagattagggggaataaaacacagaaattacatgattttctgaatacagaaagattattacataaagcaagtaagcattaggggccaggatttgatgccagcacttgggtcagtgctctgtggcctcccagtgagttatccgttaaccaccactccctaccatctctctgcacaagaatgcacaaaggcacacatttaaaaatataatgtcagaacatgcctctaacatttattattattccagttgaaattcatctcatcagacttgcctgctagaagcattacctttgtgtcaagggctgagacatttaaaagttttgtttttcttataatagcagcagctaagttccatttttaggcgtgcacatattgaaccatggtgtgaattgcgatagtaaggttttagagtctataaataatgcctagtgaaattggagccattcagtccctagaaatatttatgcctatctgtggctatttgtctatttgcatgattatccttgccattatcctccaggctctgaaaatacacactgaaaggtttcttaccagcttgttcatgtctggattcacattaactctatgaccatattttattccagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggtaagtgctttctgagagtagctgtgtctgttctatctggtattgtgcaattaatttgttttcgtttttgcagtaaggtatttgcaaatactgtaaagtccaaatcatagtagaaactggaacacagactgaaagccaaacaatgaagcctggtctactttctgttaaatgtgtggtctctttttattaagttcttgaagctttcagtttgaatctgtttgctttaattttctcgtccagaatggtgtggcattttttttccatttataatttctgtcacgtgattggaaaataaaatgaaacaaagcacttctaggcaatttttttttatttcaagggaagctacagatcaaaggagagctattgtgtgaaccatgcatcttcatgagaagaaacattcacatcattgagaaatattggcaggagttaggaagggacaacattatcatcaaaatcccattgtaactcaagctctcctgattctgtaaaatggtagggttggatgcaaataagttcagatacaaaaaaaatccagattttattaagaaatggttttaatggatagcaacagtatttctgtacaacaaaagtttccatttcaacttactgtgtttcctagatacaagaaccatagcactttgcagaaattaaaagactctcttgttgggttggtttttgctgttttgtagttattggtgcctttaacatgagttgttagtagattcttgatgaggaaagaatgacaatagcatctatggaaatcttgaacttctgtgaatactagaaatttcttttaaagggagatttcgtaattgtctgatgtagttagtaccctcatcagacaataacctctagtaaaccaactgagaatgataagcttttcctataacttgcctgtctatacatcctatatgtgtattcttctacaaaacatttttttaattaccactctctttatagcagcctggatattgatcattgccatattttaaaacctgtaagttatgtttttcttgtactaaagggcatggtggaattttttcaaggtcaaaaaccatgtaaataaaaccttcctagctcaaaactaatcatacaggtcctgttatctaattattcccctagtaatctcccttctattgcttcacattgaactacgccttttctccccctttcctctgtccattccactgtgcttgtttatccaactcatccatcttgaccatttaattctatccttaacttctcaaacctgaaggagggaagccccgcccctcccacagagacatgcactctaatggatttgaaatatgctcatatctattatgtgtaaaatgtgtagtattgttctgtgtttatacatgtttttaatttacatcaatggcattctatacaattgcaaaaatacaaagaaggactagaaaagctggcatctattgatttcctaatgtgttcattatgttgatttgcccccttttatctttatttctgcttttttttttttcaaaatcgtccattacctcaccaatccagttttgtatgaataagctttttatgattactttagctccgactttttttaacatcaaaagttccctggcctatttccacattctaaagttgtaatacaattccttatttaaatatgttgctttattaactgagtaaattctgctgtgtgacagagtcaatcgcctgagggatatgtcacgcatcagtctcattatagaaacgctgtagcaaatgttttattcttgtctcctagcctttgtgtaaaagaaactatattttgcctattaactatgcatccaaaacaaaaggtaaaaaaaatgcttattttatgaaaagtactggtatcactgattttttttaaaagtggcttttaatttatcaaataagtatcaagaactacctaactttgctttactatacaaacgaatgaagcaaaggaaacagtgacacagaacttacctttaagaaattaaattttagtaggaaagatacctgataataatagtacctacagacaaagggctattcgaaaccacagagaatctatttctctgacgcttgcctaagagaatttcattccattaaattttataaagaaacctaaagcatttgaaggatcaaacaatcaacatcactgaagtccatatatttacagtaaataatagtgggggaggagtcaggagtggagcacagatatggcaacctcccactttaatctgtcagagcagtgacttcctacaaagttctgtaaatgttttgactgcaccacagtgttaaatgtatggctaggcctgagtttctacaactcgtgttttagtaaatacgatgaagtttctgttacaaaatagaatggacattttttttccccccaaagacagctgccctacacaaaagggaacagaaagatgattttacttccttcctaccctgaagcctaatggcaaagttgctttgcaaatttttttctcccaagagtttgcagctgtttctgtctttcctattgtgcttatgttcagctctggctgggaacacaagctacagccccagctgttgggtgcaaagtgaatcaggtatttcacagtggtcatttgattagaaagaattatattgtttagctaacaacattttgtgtatggcagggaagacatttttgacatgttcctaacatttaatgatgtgtaacttatcttgtacaggtgcagctatatctgaaaatactgatgcatacatatatttaagtctcaatatctgcagagccatgtcaatgtagatgaagatttaaaaataatttttatttgcatgatcactctcttgggatacttcgaagtaaaatagtaggataagcaatgtttgagatagtgtaagtgaacaatgagaacgtgccttcttacagactggggaaggagatgtagaacagagtcagacttgggaacattaacacagtgtacacagctacgtgggagagggaagagggattctcatgaagatcacaggactaatcacagggattgtccacgtctcccttctgagcgcctcgtctaatctacatccagaacaatgcttccttgattttttttaacagcacttgtataaggcttttaatctctaaatgcaaagcattgctattaaaatatttgtgcatgactgtcaggccagggagagtgagtggatcagggatgcgagagggggtggggaggccctttcaagaattgtttcaagttcagctccacaaatactcactgggcaactactatgtgcactacactgtgcctgctcccaatggccacagcctgggcactgtcactgctgctactgggctccgtggttccatcctagctcttcccgcatgcccctttcgcctctccaagttcctaaatgttgttaccacccactcatcactcctgttctcttctgcctcttaactggactagttggatcttaagtaagaaacccaaggaggtagagatcacctaaaaagatgtcccatgttcaagatcattacttatgaccactacttaaaggactgtgttagtaatcagtgaacctaagaataattactcacttccaataagaaaaatttgtttatctgttgacctcctgtcttcaaattccttcagttcccgtgcccccatcgtggcatgtcagtgctttctgtgagaagcctgtagtatgcatcatgtttggaattactgccattttagagtatgtagatgcagatccccaattcgtcaatgttgtgaacatctggcagagacacagctgaaggaagcttcaacttgaacaatgattctctttagggatttctaacttacccatctcttttataaaataatcagataaaaatattatctgcctttttgtgtgtgtacatcattaacttagttttaaccctaaagaatgttagctttggcttttttttttttttttcacagtgtctcgctctgttgcccaggctggagtgcagtggtgcaatcttggctcactgtaacccccacctccagtattcaagcaattcttgtgccttagcctcctgagtagctgggattacaggcacgtaccaccatgcccagctaatttttgtacttttagtagagacgggtttttcgccatgttggccaggctggtctagaaatcctggcctcaagtgatctgcccgccttggcctcccaaagtgctgggattacaggtatgagtcaccgtgcccacaagatttggtatatttctttagaggaaaatacactcaagggttctgaaatttcttttgtgtaagaaagaactttttataaataataatttcagttatgtccataactaaaaatcaaggattccatttatatgaaatatctagaataggaaaacctatagagatagaaagtagattagtggtagtcaagggctaagaggatatggggagactgggaatgacagctaagggatgtggggcttctttttgagataatgaaagcattctacaaccctgtctcaaaaaaaaaaaaaattaaaaccgttcaattgtccactttaaaaacaatgggggaggtatacagaaactgcatacaaacatcttatcttaaattgtattcatcattcttaaaatttaattctattaataaaacggtttaattaaagataaaactgtatatgggaggtaaggagatatggcctttacatatttgtggatatctcacacaaagttactttgttcaggtttacagatttgggggcctagccacaacagttttatttgtacatgtatttcttccccatgtcctatctacaaggggctatgtgagatcaaaaccacaaccatttggtaaattcagattctgccctgccccaaatgtattagtcctgtattttcaaggccattaaagaaaaaatatcctgtgacctaattactaaagattagttgttgaatagtaggaactcaaagataattgttggtcttctattttatgcgaattcttctaagattcccaggttatttatcataagaattacatttacatggcaaatttagttctgttcctagaaatatctccatgacaaccaaaaggaactcctaatttctggcacacattacttcaggggtattttgagagttaaagtggttaatcgattatttagaatcctagcaataagagaaagaaaagaattaagggtagaaaaacatttatagcagtaggtatccctgcagagaacgggctaatgatcaactaaaaaggcatttgcatctgtggtacagcctctgcgcaaaattccaaatggcattctcacttccaagtcacctcacttctccatgtgccttcctgtcttctcatcttcatcccattttctatagcaagcaacactcatgctaactcgtgatcaaaagtagagcttggcggagtgtgctagtaacattttctctatgccctcaaaaactagttagatgcagagactttctccttaggcacacttaacttgtgcagcaaaaattactgaaacacggagtaactggcgaggcaaatatattgtgaaatttgttttagtacttttactcacgagtggctcttgggagctcagagttgaagctttttcaatggtatttactctggtgctccaagagcctagcagttgagtgtttaagaggtcaagcacatggattctggcctcagataaagctctgtggaaatctgactcatgtactttctagctgaaattctatgttgtattttttttaaggaaaataatagtacctaccttataggagtattgtgaggagtaaataaaatctccatttaaagcacttggcacaatatgtgactcagtttcctgttatgaaagtacaaacatttggtgcttttcagacaaagctttttaacagaggatacacatatcaatcaatccaagtccagaggtgcaaagagcttccgaaaagaaagagaaaggttaattctttctgggaaaggactatttggatgggcttcagatatttcataaagtcaaagatgatgacctagtaattaagaagggattgcttattatagatttgggaaatggtattaaaaagagcaagaaggtaggagaaaaaaagggctctaggaggtgattgttatgtagccggtctaagtagaacggaggaaaccagggagacagacacaaaatgcaggtgtccattgcaaggttcatagtgatgaataatcttcagtgaagtgcaaagcatagaatgagctggaaaacaaagtcagggtattaagacagactggtgttctgtgttgcttttgacctgtgtgtgagaaaaggagtttttttgcttttgtgtttttgtttttgttttgttttttgttttacctttgcagtttgaagtgattggcaacagccaaagaaatatggggggtattgggcaggagtataggaaaaatgagatgtgatgagcccagaagggagttaagattgcaaaattgggtaaccaaaatctggagaatttgtaatagaagctttagaagtctaacatctgatattctgcttgtaaccagtacccaaagggaggtgggactggtaattgaatttctgttcactttgcctgcaaaggtcaccaatacctattgggccctaactttaggaaataacaatagtttccaacctttcccatcctgaccaagtgacccttcatccatcacttaacttctgtgcaaatataaccaccctttttaatggagatgttttgaaagcgttgagtgtttagagtagaacaaacattagagcacaaatgtcatgatgtttaacttttacagctgtatgtgagcttggttagtttctctatcaacaatccactctctgagaacaaattaggtactttgagaatcttcccaaattgcttcaggatacttggctcctttgttatgctgaagaaaaaatttacaattgttccccagaacatttatatgttgtatgtgtttgttagagtacaaagcagttaattattgctgtaattttcattcccattatacgaatgagaaagctgaggtagagggagtgactatgtaatcgtaatctcacagatgtccatgtttgtcctgtgatttcatacccatcgcgagtaaatgcatgttcaatgcaatgtaaaaggctattagagatgttgggcaatttcacaaagtagatttcaagtctagggctgtgctgagcctcctccaccttcatgtatatgcaacccagtggcctacttaagagtgaaagtttctctgagaactccaacaccctcctaaaaatctaagtgttcatgtaagataatcatttggattttatcccaattgttgtcaattatgctctgaactttattattactgggttctaggaacaggacagatggaaattagatagctgggaaacatcccaaattttaaaaacctgaaagcaaaaatgacatcaatcatcaaacctcatttcccgggcattgttaaaaccatcaggccttattttaaagccagaccaagaagcagagttttataatccaagtaataatatattgtgggacagtggtttataaaaaaatacaacacatcatttcaaagtagctgggggcctgttttgacctgaaaagatctataaatgtggcttaagagtagcacagctggaactagctccagtattccagactccgcgtccactactcttaaccattacatcaagggaaactgcctggcagggaggattaagaggatatatttaaaaaataatccagattcattgtagcatgtgtggtgtcttctttctggagagagttttggttcctccattttccaatacaattgcagggatttgtctgtatgtgctgccaattgattgaaagatctctttcccttgaaaccattaaaagatcataggcaaagtctgtcttgggggttcagataatttggcttcaaggcaagagattagaagatgacatattgatttacaatgaggggaactgttgggtcttcagttcaaacacccacaagccctgctaatctgttattaccattatcatctacattttccacttatatttaaactgagcttgttggaataaggatgttataacttttttgctgtttaggttgtggtttctcgatcaggaccatcaacccctcatgtgaattttctcctggactcccatccagtgtctccagaagtgattgtggagcatacattaaaccaaaatggctacacactggttatcactgggaagaaggtaagctgttcccacagggaatttccatagacgtggtttttcccaaatgcatatttacaaccagtgtcacttggccctttataatgtctctcttcatcttaaatttacccctcctccattaagttctttagtgagtattccagagatcttctgaaatctagttaatttgttctccaagaaagactagacctaagggaggtctttttcaaaacttctccttttgtcctatatttctcaacaagaaaaataaacacacagaatgagaattacagtcctaatgacagagctctagtgcaggcagataaatcctggaaatgtacattggaatccgactccaaccaataatcccttttctcctagagaagaaagtgcatcttgatgccagaatgacatgcaactttacttagaattttccagagattcaagtgtgttttcccaccacttaaattatactctcttgttattttaaaatcatctcagacagggcacaatgtccctactatgtagaacctctaacattgtgtggcaatgctatgctcactggacaataatgttactttttcacatacctgctaacaataaaggaaaggaaggaatcagatttttaaaattttaatcaccgttatgacaggatttgcacacatagttgctaagtctagaaaattccatcaaatgatatttacatgtaccttttgtgtacttactttataattaattaacaaactagatacccctctggaagctctttccaccccttctcttcacagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggtaggaatctctaacagctggcatacatgtttttgtttggtgttttttttttttttttggtttggtttggtttgttttttgtttttttagatacaaatcccactaatgaaaaaaatttaaaaatcaatttactcatttagctgtgagtcatcagctaaagcaccatctctctcttggctttatccctcgggcagggagggggtggtgtttgggcatccccccaagtcctgcacctgaagtgcttgcttcacattgtctaggttctatcgctgggcagctgctcacctttagtgccgtgtgaataaaagagtggtggtgaataagcaacagtgctccccattttctcacactggggcctgttccctcctgactcacccactctctgattcctcgccacttcctatataggccaagtgcccagacatgagcctccatcacagaaacagatctgttcatggcatatcctggaaccctgagctgaatcctgcaaactggtgatccctgccatgctggggcacacaggacagttttcttcctgtccgatgcatagatggtggccttgtctgttcacagatgagactgaagattatttcccggggtgaggtgggcaaggcaagtggagggtcaacacccatgggtggctgtgagtcttccttcagtgttcccagaaaaaaaagcaaaggctcaacggatgactatactaacatctatacttctgtaagccatgccactctttaattcattccaaaaatatttattgagtgcataccatttagcaggctgccctctagtccctgaggagatatagtccagaacaagatgagcacatctcttgctgatagagaactcagtttctggcaatggacattggctctaacatcgcagccatgctaactgtgttgccttatttgcttaagcatatattcggcactatgaaaatctccacgcaatttttaaaaatttcttagtccaaaacatcttgcttaaaaacacttccctggtgagaacccagtgtgtatttttctctgtgtgcatgtagaaaagttggactttagtaaatagttcttatgaaagattcaagttaaaggtctcggtcacctggttcatgcccaagtaaacaaaatgtgcgagtcagaacaagaaccacccccaagtgcatggctgttttcatttagttacggtttggagcaagatttgtagtgggtgactgggttttaaaccaagttattttctgttaggtgtgacacagttattaagacttagcttgattgaccagagaataaactaaagacagtgacaaaacaaatttaaatctatactgtagtatttgtgtacttttttgttgttcagtatacttttggaaccgtatgcaattttatacttttataaacaaacaacttcagcaatttgagacactaggaatctgaactctgctattccatgaaatagatatggaaaatatatgtgtgtgtgcccatgcaattaaatcacaacaatttcatttcaaaaataaccaagctggtattttaagtaaagaaaatggtttgataacctgtacaaatgaaacatttaatttttactaatgtgcttccttttactaagcataaaagctatactaaaatgcttaaaaataaagtaaatatttcagaattttctggaaccagagaatctcttgcaatatttaaatgtccctcctctctcacccttcttaactctagcattctatagttgatgattctcaaaggttgcgtgctaccatgcacaagtcagtgaggcttaagctgcagttaggaaggcagggcagctgagtccataaatccctctaggttcatagttgttaggaagatttcatgctgcaccagactgtgacagttagcattcttcctgcaaaacataagacagactcgaggtgggtgttaagatggccgagtaggaacagctccggtctgcagctcgcagcaagatcagtgcagaaggcaggtgatttctgcatgtccaacagaggtacacggctcatctcattgggactggttagacagtgggtgcagcccacagaggttgagctgaagcaaggtgggatgttgcctcacctgggaagggcaagggattggggaactccctcccctagcaaaaggaatccttgagggactgtgttgtgaggaacaatgcattccggcccagatactacacttccctatggttttggcaactaacagaccaggagattccctcatttgcctacaccaccaggaccctgggtttgaagcacaaaactgggcggccatttgggcagacaccgagcaggagttttttttcataccccagtggtgcctggaatgccagcaagacagaaccattcactcccctggaaagggggctgaagccagggagccaagtggtctagctcagtggatcccacccctacagaacccagcaagctaagatgcactggcttcaaattctcactgccagcacagcagtctgaagttgacctgggatgctggagcttggtgcagggaggggtgtccaccattactgaggcttgaataggctattttcccctcacactgtaaagggtacagcttcagcagacttaaacattcctgcctgctggctctgaagagagcagcaaatcccccagcacagtgctctagctctgctaagggacagattgcctcttcaagtgggcccctgacccctgtgcctcctgactgggagacacctcccagcaggggtcgacagacacctcacacaggagagctctggctggcatctggtgggtgcccctctaggatgaagcttccagaggaaggaataggcagcaatctttgctgttctacagcctctgctagtgataccctggcaaacagggtctggagtggacctccagcaaactccagaagacctgcagcagtgaggcctgactgttagaagaaaaactaacaaacagaaagcaatagcattaacataaacaaaaagaacgtccacacaaaaaccctattcaaaggtcaccaacatcaaagaccaaaggttgataaatccatgaagatgaggaaaaaccagcgcagaaaggctgaaaattccaaaaaccagaacacctcttctcctccaaaggatcacaactccttgccagcaaggaaacagaattggacagagaatgagtttaacaaattgacagcagcaggcctcagaatttgggtaataacaaactcctccaagctaaaggagcatgttctaacccaatgcaaggaagctaagaaccttgaaaaaaaagctagaggaattgctaactagaataaccgtttagagaaaaacataaatgacctgatggagctgaaaaacacagcatgagaacttcatgaagcatacacaagtatcaatagccaaatcaatcaagtggaagaaagaatgtcagagattgaatatcaacttaatgaaataaagtgtggagacaagattagagaaaaaagaatgaaaaggaatgaacaaaacctccaagaaatatgcgactatgtgaaaagaccaaacctacatttgattggtgtacctgaaagttacagggagaatggaaccaagttggaaaacactcttcagaatattatccaggagaacttccccaacctagcaagacagcccaacattcaaattcaggaaatacagagaacaccacaaagatactcctctagaagagcaacaccaagacacataatagtcagattcaccaaggttgcaatgaaggaaaaaatgttaagggcagccggagagaaaagtcgggttacccacaaagggaagcccatcagactaacagtggatctctctgcagaaaccctacaagacagacacaagacagggatgccctctctcaccactcctattcaacatagtgttggaatttctggccaggacaaacaggcaggagaaagaaataaagggtattcaattaggaaaagaggaagtcaaattgtccctgtttgcagatgacatgattgtatatttagaaaactccatcgtctcagcccaaagtctccttaagctgataagcaactttagcaaagtctcaggatacaaattcaatgtgcaaaaatcacaagcatttttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatggataggaagaatcaatatcatgaaaatggccatactgcccaaggtaatttatagattcaatgccatccccatcaagctaccaatgactttcttcacagaattggaaaaaactactttaacgttcatatggacccaaaaaagagcctgcattgtcaagtcaatactaagccaaaagaacaaagctggaggcatcatgctacctgacttcaaactatactacaaggctacagtaaccaaaacagcatggtactggcaccaaaacagagatatagatcaatggaacagaacagagccctcagaaataataccacacatctacaactatctgatctttgacaaacctgacaaaaacaaggtatggggaaaggattctctatttaacaaatggtgctgggaaaactggctagccatatggagaaagctgaaactggatcccttccttacaccttatacaaaaatttattcaagatggattaaagatgtaaatgttagacctaaaactataaaaaccttagaagaaaacctaggcaataccattcaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaaccaatttacaagaaaaatctaacaaccccatcaacaagtaggcaaaggatatgaacagacacttctcaaaagaagacatttatgcagtcaaaagacacatgaaaaaatgctcattatcactggccatcagagaaatgcaaatcaaaaccgcaatgagataccatctcacaccagttagaatggcaatcattaaaaagtcaggaaacaatatgtgctggagaggatgtggagaaataggaacacttttacactgttgatgggactgtaaactagttcaaccattgtggaagacagtgtggtgattccttagggatctagaactagaaataccatttgacccagctgtcccattactgggtatatacccaaaggattataaagcatgctgctgtaaagacacatgcacatgtatgtttattgcagcactattcagaatagcaaagacttggaaccaacccaaatgtccaacaatgatagactggattaagaaaatgtggcacatatatgccatggaatactatgcagccataaaaaaggatgagttcatgtcctttgtagggacatggatgaagctggaaaccatcattctgagcaaactatcgcaagaacaaaaaaccaaacaccgcatgttctcactcataggtgggaattgaacaatgagaacacgtggacacaggaaggggaatatcacacaccggggcctgttgtggggtcgggggaggggggagagttagcattaggagatatacctaagtaaatgacaagttaatgggtgcagcacaccaacatgcacatgtatacatatgtaacaaacccgcacattgtgcacatgtaccctagaacttaaagtataataaaaaatatatataaaaaaagaaaccctacaagccagaagacagtgggggccaatattcaacattcttaaagaaaataatttccttcccagaatttcatatccagccaaactaagcttcataagtgaaggagaaataaaatcctttacagtcaagcaaatgctgagagattttgtcaccatcaggcctgtcttacaagagctcctgaaggaagcacaaaatatagaaaggaaaaaccggtaccacctactgcagaaacataccaaattgtaaagaccattgacactgtgaagaaactacatcaaccaatgggcaaaataaccagctaggatcaaattcacacataacactattaaccttaaatgtaaataggctaaatgccccaattaaaagacacagactggcaaattggataaagagtcaagacccattggtgtgctgtattcaggagacccatctcacgtgcaaagacacacataggctcaaaataaaggggcggaggaagatttaccaagcaaatggaaagcaaaaaaagcaggggttgcaatcctagtctctgataaaacagacttcaaaccaacaaagatcaaaaaagacaaagaagggcattacataatggtaaagggatcaacacaaccagaagagctaactatcctaaatatatatgctcccaatacaggaacacccagattcgtaaagcaagtccttagagacctacaaggagacttagactcccacacaataataataggagactttaacaccccactatcaacatcagacagatcaaggagacagaaagttaacaagggtatccaggacttgaactcggctctggaccaagcagacctaatagacatctacagaactctccattccaaatcagtagaatatacattcttctcagcaccacatagcacttattctaaaattggccacataattggcagtaaaacactcctcagcaaatgcaaacaaacagtctctcagatgacactacaatcaaattagaactcgagtttaagaaactcacttaaggccgggtgcagtggcttacgcctgtaatcccagcactttgggaggctgaggcgggcggatcacaaggtcaggagatccagacatcctgactaacatggtgaaaccccatctccactaaaaatactaaaaattagctgggcatggtggcgggcgcctgtagtcccagctactcgggaggctgaggcaggagaatggtgtgaacccaggaggcggagcttgtagtgagccgcgaaggcgccactgcactccagcctgggcaacagagcaagactccatgtcaaaaacaaaaacaacaacaacaaaaaagaagctcactcaaaaccacacaactacctggaaactgaataacctgctcctgaatgactactgactactcggtaaacaactggtacatttgttatttttcaagttaaataatgaaattaaggcagaaataaataagttctttgaaaccaataagaacaaagacaaagacacaacatatcagaatctctgggacacagctaaagcagtgtttagagggaaatttgtagcactaaatgcccacaggagaaagtgggaaagacctaaaatcaacccctaacatcacaattgaaagaactagagaagcaagagcaaacaaattcaaaagctaacagaagacaagaaataactaagatcagagcagaactgaaggacatagagacacgaaaaaccccaggagctggttttttgaaaagatcaacaaaattgatagactgctagccagaatcatcaagaagaaaagagagaagaatcaaatagacacagtacaaaatgataaaggggatatcaccactgatcccacagaaatacaaactaccatcagagaatactataaatatctccatgcaaataactagaaaatctagaagaaatggataaattcctggacacatacagcctcccaagactaaactaggaagaagttgaatccctgaatagaccaataacaagttctgcaattgagacagtaattaacagcctaccaaccaaaaaaagcccaggaccagacggattcacagccgaattctaccagaggtacaaagaggagctggtaccattccttctgaaactattccaaacaatagaaaaacaagggactcctccctaactcattttatgaggccagcatcatcctgataccaaaaccagacagagacacaacacaaaaaaagaaaatttcaggccaatatccctgatgaacatcgatgtgaacatcctcaatacaatactggcaaaccaaatccagcaacacatcaaaaagcttatccaccacaatcaagttggcttcatccctggaatgtaaggctggttcaacacaggcaaatcaataaacataatccatcacataaacagaaccaatgacaaaaaccacacgattattgcaatagatgcagaaaaggccttcgataaaattcaacaccccttcgtgctaaaaactctcaacaaactaggtgttgatggaacatatctcaaaataataagagctatttatgataaacccacagccaatatcattttgaatgggcaaaagctggaagcattccctttgaaaaccagcacaagacaaggatgccctctctcaccgctcctattcaacataacattggaagttctggccagggcaatcaggcaggggaaacaaataaagggtattcagataggaagagaggaagtcaaattgtctctgtttgcagatgacatgattgcatatttagaaaaccccatcgtctcagcccaaaatctccttaagctgataagcaacttcggcaaattctcaggatacaaaatcaatgtgcaaaaatcacaggcattcccatacaccaataatagacaaacagagagccaaatcatgagtgaagtctcattcacaattgctacaaagagaataaaatacctaggaatacaacttacaagggatgaaaaggacctcttcaagaactacaaaccacaagcaaatggagaaacattccatgctcatggataggaagactcaatattgtgaaaatggccatattgcccaaagtaatttatacattcaatgctatccccataaagctaccattgactttcttcacagaattagaaaaagctactttaaatttcatatggaaccaaaaaagagcccgcatagccaagacaatcctaagcaaaaagaacacagctggtggcatcacgctacctgacttcaaactatactacaaggttgcagtaaccaaaacagcatggtactggtaccaaaacagagatatagaccaatggaacagaacagaggcctcagaaataacaccacgcatttacaaccatctgatcttttacaaacctgacaaaaacaagcaatggggaaaggattccctatttaataaatgatgttgggaaaactggctatccatatgcagaaaactgaaactggaccccttccttacaccttatacaaaaattaactcaagatagattaaagacttaaacgcaagacctaaaaaccataaaaaccctagaagaaaacctaggcaataccattcaggacatatgcatgggcaaagacttcatgactaaaacaccaaaagcaatggcaacaaaagtctaaattgacaaatgggatctaattaaagagcttctgcacagcaaaagaaactatcatcagagtgaacaggcaacctacagaacaggattaaattgttgcaatctattcatctgactaagggctaatatccagaatctacaaggaacttaaacaaatttacaaggaaaaaaaccatcaaaaagtgggccaaggatataaacagacacttctcaaaagaagacatttaggtggccaaaaaacatatgaaaaaaagctcatcatcactggttattagagaaatgcaaatcaaaaccacaatgagatcccatctcacaccagttagaatggtgatcattaaaaagtcaggaaacaatatgtgctggagaggatgtggagaaatagggaatgcttttacactgttggtgggagtgtaaattagttcaaccattgtggaagacagtatggcgattcctcaaggatctagaatcagaaataccatttgacccagcaatcccattactgggtatatacccaaaggattataagtcattctaatataaagatacatgcacacgtatgtttattgcagcactactcacaatagcaaagacttggaaccaacccaaatgcccatcaaagatagactggataaagaaaatgtggcacatatatgccatggaatactatgcagccataaaaaaggatgagttcatgtcctttgcagggacatggatgaagctggaaaccgtaattcccagcaagctaacacaggaacagaaaaccagacactgcatgttctcactcataagtgggagttgaaccatgagaacacatggacacaaggagggaaacatcacacataggggcctgtcgggtggcgggggtctaggggagggatagcattaggagaaatacctaatgtagatgacagataatcttatgtgtcttaaactttgcaggcacaaaatccagctaatgtatggagtttcactttctaatacatgcaagttaacctgcttttcaaggtacatgatgttcagtggctaaaattctttacagttctagatatgagagatttcaggactgtaagcccattattttgcttcaaacatggtatctgatctcatacttaaagagcaatgagaaatgcttcagaaaagggagagcactttttaatatattctgaatgtattaggatgcagttatcatatcttgtaaggttgaaaattcaggccgggcgtggtggctcatgtctgtaatcccagcactttgggaggccgaggtgggcagatcacgaggtcaggagatcgagaccatcctggctaacacggtgaaaccctgtctccactaaaaataggaaaaattagctaggcatggtggcaggtgcctgtagtaccagctactcgggaggctgaggcaggagaatggcgtgaacctgggtggcggagcttgcagtgagccaagattgctccactgcactccagcctggatgacagaacgagactctgtctcaataaaaaaaaagaaagaaagaaagaaaattcaaccccagtgagacaacagaactattcattgatcagaatactcagaaaagcagtattatatagggataggagggtaggcaggcagtatactgccaccagtaaatatatttgtgagttctactaaagaggaaaggagaccccttttggagtttttttgttctgttttgtttttgttttttagttttctcatgttttatcctaatgggttttgaaagcatgatcatttaaaatactgttggaatgggcccatcagtgatgtgatctttcacctgtgaaaagacaagggctacttttgtggctgtatctcccctatccagacaggtaggagacccagcctctgtggctttatgccggacgctcatttcctgcccacagagtttctctgcccttcaggataactcagagtttgccagccattgttgggtctatccaagggtgtgtagttcacaactgcttccttcctttttccctagaagggtaaaggttaccccataagctaaggggaaaatgcccagcccagagagaaaagctaagcagagcgagcctcttggatcctgagggtctagcagagggcttataatatctcttcctattgccagtgccccagttgcgcagctctctgcgtcttttctcaaatcatcacccaatccgtttgccttttatagaaagtgatggtaatgatgtgtgtagagtgacagacttcagtttttacatagaaagacgggatgtaggcagtgggatcaggccaacatcagccttgggcagcgttttcagtggggaagcctcctcattagaagagccggcagcagctgtgtgactgcctcaggctgaagagagtcctgggagggttggatgtcttgttctctcctactggatttctaccataataataataaacagatttatttttctagtagttctcatttgactagacatggatgaggtaaattttcaggaaaggcacaacagtgtaatggatttttatgggtaaaatggctatcataaaagctttaagctaaaactttaaaggggtttgataacgagggtacattaagactttggtttgcaattatttacttaggaaggatggaaatgtttgcaagtttgaatttggctaaaagcccttcttaattgtaaaagaatcacttttagatgttcacaagctgagctttagcaaatacctttactggttcttgagttgcctctatcttagttttcccaccattgtactttacagcacaatttacaatatgtccccacccccaaaagagcatttcctttctcaattgtcacaaagctgctgagaagaagcttatttttaacttggaaatgtgttttgttttaatagttttagcctgagagcaattatcttacacactttataggtgcctaatgcggtcttaaatcatgactgaccaaggtttatcaataaatccattgataacataccagaaatgagtctgcaataacaaaatgagtctgttatttgcttaacatcaaccatcagggggaaaaatttaatcctaaaaatgagatataaaacaataccaatgaagataattaggaaaaattgttacaatactgattttgggccctctctggttccgtttttatctatttctaaaagaaacaacataacacatgtattaaatattacataatttttaaaaggctgagtgtgtcaactaaccagcctggtatacatcaaatagtgaccatatttaaagaacaaggaaaaatcttcagtcattaataaatgtgaactaataggtaaaaagaagtagattcacttttcatttgttagtgcctggtgcataggaggtgctttattaagaaataattaatgaaacctgggcagcataacaagaccccgtctctacagaaatttaaaaattagctgggtgaggtggcgcacacctgtagtcctgtctactagagaggctgaggcgggaggattgcttgagcccaggagtttgaggctgcagtgagctaggactatgccactgcactgcagactgggcaagagtgagacccccatctctaaaagtaaataagtaaataatgaatgaatgaatgaatgaatgaattattggcagatatgtgttccaaaaccatctatatgtttcatattatgctagctgctgaatgcaactgggcaaacactggataccaaatgaggtatttttactgtgcaacttttgtctctgggtggggaataccatagcaaccagaatgtagtgcacgcagccagtgcacagagcaaggcgtataatggctggaccttggcttatagagcacatgaaggagtttgataagagctcagtccgaaggctgatgaagagttacaatcagagttatgagcaagtaaaagtctgggcccaacgtgtttctactcctaccctaaagagccctagaagatgaattcacttcagaatggcccaaaaagggccaggtccaatggctcatgcttgtaatcctagcactttgggaggccaaggcaggaggatcacttgagcccaggagtttgagaccagctgggcaacgtagtgagaccctgtctctagaaaaaaaaaaaatagccaagcatggtggcccacgcctgtgatcccagctactcaggaggctaatgtgggaggattgcttgagctcaagaggttgaggctgcagtgagccatgatcacgccactgcactccagcctgaacaacagagccagactctgtctgaaaaagaaaagaaaagaaagaaggaagaaaggaagggagggaaagaaaaagaaagaaagagagagagagagaaagagagaaagaaagaaagaaagaaagaaagaaagaaagaaagaaagaaagaaagaaagaaagagaaagaaagagaaggaaggaagcagagaaaggaaagaaagaaagaaagaaagaaagaaagaaagaaagaaagaaagaaagaaagaaagaaagaaagaaagaaaagaaagaaagaacggaaggactcgaaaagcccctttattcctaccaagctgcatctgctctttgtcccatctttggatctcctgaaaacaacttgtttcattaacatgtcatgtagttttaatgtttgttccagatgctctgaaatttgtgaccctttttcctttagtgaaaattaaatttttactaaattgtgggaaaatgaaagaatttcagactatttaaggatatacattttgtttgttcgttttccatatatgtgaaaaattataatatattgggtttttttaaaagttctatgttgtccttgtaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacgtaaggatcttaaaatgctttgctggggtgtgcttggaaaataggttttgtttttgaatgaatatttcttttaaaattgctcaagaagctcatctcttgaattaaaaagggtcttggcctgtcacatgccttgtgggtctgttctgttttgttcttgtaatcccatttactcattggatttgaagagagagaaaggtgacatggcctaggtgaagagaagaggccagaaatgggagtttctcaaccatttatgcgacaagtcttcaggtgttgtctgagtagatttgcaagagtagcactagttgggatcacttcatccttggagtcttcaaatgtagagtctccaaaggctttttctacagaaatcagtaaacagctcagcatggatcctctcttttaaattcactttctaaacctcagaaatgtagtgaggcagctgaatcacgtgtttgagacttttttagatgagttaaaatttatattcagcttatatttactggcactgcaatatatgggctgtatctcactgaaccatccccacggtcctgggagggagcagtatcattcctataatataaaagaggtacctgaagttcagagagatgaagtgtggcttcacagaggtaatccagagagtaagagctgaacaagccttcagctcagctctgatcatcttctgatccaagacccgtgctagttctactgtattctacatgtacccttctacaagctttgaattccataatcatcagagaatccagaaattattcattatcacataataacaacactcaaatatttaaagttttatggttgaatctttatgattgaacccattctatcaggtggttattttatatctaatagaattcatttcagggttacacaaaggtccgaatctatccattttactgagaccaaaacactaatgaaggtaatatttgttagctgaatggcaaaacaaattttttctagaaatctcccttgtaaaatctccaaaactcttaatcattgcatataaatcaggacctgtaaaagtaaagcataattcattctctcctttaaaaagttatttaataaatcaaattgtatttaaattttctcagaactatatgattattcattcagaaataattctatggaaagccatcacaatttcattatcatttaagtaatttaaataagcatgtacaagtataaccacagaaatgtacctgttgacatactttaatgaagagattggcctatttgtagttagcccattgtttcatatgcatctgaagtggaccaaagattatccccaaatattaatattatccaaacttagattattatgcactattcaactggtgaggtctttatggataaggtctgatatttcctgtttgtctgtataagtgctatagtaccattaatgtaaagtttagtataagcagggtgcagtggcttacgcctgtgatcccagcactttggcagaccaaggcaggaggatcacctgagcccaggaattcaagaccagcctgggcaacgtagtgagactccatctctaccaaaaaaaaaaaaaaatttttttttaattaaccagatgccgtggcatgcacctctagttccaactcctgagtccagaggatcccttgagcccaggagttcaaggctgcagtgagctatgactatgccactgccctccagcctgggtgacagagcaagatcctgtctctttttacataaaaataaaagttaagtttatcatagtatagaaataggattatataatttttggccttaatgcttatcttgaaactctgcttgctattcaaagcagtcagctcaccatttagagttaatgtcacttcctataaaacaacctaaccagaaaattccttggatttgtcatgtattaaactttgggttttttttccagattgaaatgcacagttggtcctgccatgaataagcatttcaatatgtccataattatttcaaatggccacgggacaacacaatacagtacattctcctatgtggtaaggaagattctatcctatcatgtttgatttttacttaatctatttaaattataagatgaacaagttactttgttttgtttttatctcccctccaggatcctgtaataacaagtatttcgccgaaatacggtcctatggctggtggcactttacttactttaactggaaattacctaaacagtgggaattctagacacatttcaattggtggaaaaacatgtactttaaaaaggtgttgtaaatttattttttgttgcatctgtcaatttgaattaatatctgtaccttaaaaattaagcagattgttttgtgtgtgtgtgtggagaagaaaaatcaagatgtttatttgtttactctcctactgacaaaacttcctccttccaaaattcatctactccttttgctgatttttcttcctttctcttgttttttagcaatcctacttttcagttttgtcttcccatccaccctctttattgttatagcttaggatcttagctatactatgagctgtgagagtctggtcattgataataatttaaaataaacattttcatcaagatttgtaattagactaagtcactctggggaaggaagaaatggggaaaattgggtctggaagacagttatgtttctgcttcttagagttggaagagctcagtttaatcaagtaccaaaagtactttaaaggtttttttttcaaatctcaaatgttttccagtcaaggatagcttgtccacaacaaaggtaagtttgagatccagtcagattaaacagcctacactagaaaaggcttccactcaggaaattcccacttaggaaccattgagttatatccttttgatttgtggatataattctaaaatatgtgtatctctaatagctaaaattcacttccttaattttttttgttcagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggtaagtagaagcttctgatgggtataagaaaacaatgaatacaaggatgattttgctgtagaatagtcaagaggaattgcagttttatctctggctttgatgctgttatgttgcttttgaaggcttctttccaattcaggagagaaaactatattcaggttctgagtgtagtttgacttatcaatgctagttcattccaagaagtatcttatcctgttctattacatttaaacagagtatagcaaaatagtttaatgtggcattgtagtatacatgcacttacattatgtacatatcaattctatactaaccttagtgcccagaagtggaattaccttttttcttccattctctagatatgtttttgtcctgcctgctttacacacagcttttctttatgccagactctctttgaattgatatctcattggacccagttcaatctgccttgtttccgttaattctatcagtctagcaacaatagttaagttcggttttctttgtatttttttcagaggtgaaatatttattttgtgtaattcggtgaataaaatacaaatgcatttcttaagcttatgaaatatgcattttaaaaatattttcaagttaaataagttgtttccaaagaacagttacccatgaacttccatttgatgttgactgtgcctctgacctgtaatcagtgcaggtgattaaattgaatccctctcttacagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggtaagtcctttgagcaatggttctactcagagctctgcatctttgcctctaaccatgtggctttcatggtacctgagacatctcagtttcgcctttaaggtttgctagttaatttccttgcagtgtagccaagtagtattttttatttaataactgaaattatctagagtcttgggctaaccatgtggaaaaaatacatacacatacacacatgcacatataatgtttagacaagaatgaagattaccaatttgagacagtgtttttttatgtttgttggttggttggttttgagggtttttttgagacagtatctcaccctgtcatccaggctggagtgcaagggcacgatctcagctcactgcaatttccccctcccaggttcaagcgattctccacctcagcctcccaagtagctgagactacaggcacgagccatcatgcctggctaatttttgtattttttggtagagacgaggtttcaccatgttggccaggctggtcttgaactcttgacctcaaatgatctgcccacctcggcctcccaaagtgctgggattacaggcatgagctactgtgcctggcctgaggcagtgtttttacagacagtcagtacaaatggaaatcacagcatttccctagtccctttttaatgtgtcatagaacatggacccttttgctctaataaaatccttggaaaaggttgctgatcttgcagcagtattcttgcatttctaagcagctgacgtatgctttcttacagccccctgttcttcttatcattcttcttgtccctttgttagctctttcttgaaagagctaacaaagaaagagcattagaatatttatgttatgtcctaaagtgtgaatgttatttgctgtttctccacctatccttattttatataggtcacattaaagtggtagttttagtttagaccttagaaagcttggagttatttccaaagattccatacattttgttgatgtttttctctaatataaaataccataatctagtaggacttgagcactcaactcagaatgaaagttctaagtgctcttgctcaagcaaggtcttgattggtcaggtgatagattgaattacagcacttccttttagattctccatccaatatttcttgaagactaaagccacaatgttctttaattacaaaaaccaatttggggctaaaaatgtcaagccaaatcaccaaataataaggtcatttcaaataagatttttcttggccttctcaatcagccacattgcatcacctctagagagtattattagatttttatcatattcctgagagattgtactctagggagtcaccatatgaagcaaagcattttgaaaccaatccccacacatggccacaaacaaagttagagtaccactgctattaatttaaaggacatcagttctccacaactaagcataacaatgtttcattaaccaaataagaataatagtgaccctctttggtgttggtatgagaccttttaaagtagaaatctgagaaattattagtttatctaattaatgctgagcctccattattaagataatgactgaatttcctttcttctccctcattggcattaaagtgacactcagaatgccttagcttcagtcattcatttgtaatcaaatatttattaaaaactttttaggtgtcacacatgagagttacatatcccaaggatgattcaaacaatggtagacgataaaaatcttatttgtttatatatctggaaatataaacttctgttgttttagtgacaaacatgttagtacagtagaactgtacattagaatcggacaagagtgaaaaattcagtggatctattttactatttactatttattttactgtcgtttgtgaaaagtactttataaggagatatgtattcattccatgttccttgccacttatagaatttaaagctgaccatgatgaattgaacccatttattatttaacaaataaaaactcttggtcaggtctgatttagatatataggtccagccacaataactttaagtccaataaacttgaatcctttcaaaacaagaacaatcatcttcataacaaaatgtatattaaattgttaacatgtgcattatgccctaggagcctgcagtttattgtgtagttctcaaatttcttgttatgtaaacaattattgtgatgacagttaaattgttcatgtccatcaggaataaataacttttagcattataatattaattttatataaaactaaatagtataattttatccatattatatctctatcagttttatctgctgcctatatacatttttaatgtaagatcattttttaaatgattttttaaagaaaatagcaaataacaaattctgtttgtcctttttatgtatatcctgagtcctttttctattgtgggcataagtaattgttttatctccaactatacttgtcaaagaaaaggaaatctaagggatgttgttgcttgtttgtcttttccttgggggaaaaatgcaaccgttaaccttagatgtaccactatgtgttgctggtttagtctaagtacaatcaagaggaagctacattttccaaaattccataaatcagaattccaaagaggaagatttgaaatgagacatgaaagggcatgaaataataatagcagaggctttgtaaaatagagagcataggaaaaggtttcagtataaaatatgtcatagacaaaaagatagcatgggagtgaagacactgaattttggagttaatggcctaggatttatattcgctattctgccactccaagctgtgtgacctggcctaatgacataagtttgcaaagctcagtttcttcatttgtaaactgtgggtaatcataatacccacctataggattatcaggagaattaaatgagaccaactttgtaaagtattttgcacagaacctggcattcaataattaatagcttaaaagacactaataagattacctaacaacatagttaattatcatgttcaccatatggtgcttggtgctttacaaagcactttaccatgtggtatccaacatggtaaatagcattttcatcttaattcctaaatgaggaaactgagttattcagtgtgggccctaccttagttcccatagcttgggttaaagctaggagatgagccaaggccttctaaccccacaaagctgagctcccagtctgcctgactgcctcacacaacaaggggcagttcctccaggtgactgtcctgtcttcttaaggaaaataaaatgatgagatgaaggccagcttcagatagatcagcacagtttatgctgggcaggtggagctctgtgtttctttgaagggtgggttgtttggataattttgcatgtatcgtgtttccagaaatgtgtagtctaacattaggaagttaaatacagattttttcaaaaattatatattttcaattgattggggtggtaaattataaagttgctatggatgttgccaagctgtattctgtttacagtggataattgtgtctttctctaggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaaggtaagaaatgctttaaacactgtcttaaatcatcagctcaaacttaattgacttcatagctatgtgaatacaattgttgtacttggccattgtatcttatacaacaccagcaaatatataaactctgaaaaacaaatctttttggcataaaactaaaagataagaataaccgtggactgcattttaatgaagcattaaaaaaccctttcttgtgtatgtattaaaacgtagcaaatgtgggacacaaattatccattaaagaggatccgcgtcatgcattatcttgctgatgttatacatttccccggacatgttacctaaatgtgctcattataagataaaacataagagctgtgaaagtaaatgcatcaattgtatctccgttcttccttgtaatacttggaattttgtatctgggtatggtcatctctaagctaatttgtaaatggaactagatatctgccaccttaggaacatattagcttctaaatgtaatttaatagagaataacagatcatcttttctaaagcaagcctgttgcaaacaaagaacactaagacccagaaaggttaagtgattgacaagtgacaaaatagtggcagaataataaagactagagtgcagcttttttatgtcccttcagtagtttctacttcaaataataacacaggcaaaatgctcaagacttgaattattcatagctccagtcactagaaacagcaaaatatttatccttcaacatgttgttaaaacatttagaattttttttcctgaaagatgatctgaatgcaaatatgaacaaacataaagcaataggatagtctttatttggttgtaatataggctttcatgggtcatctccatctaagtaataatatgtttccattgaaatttttctgactttttcaacaaaaatttaactgcagcccaacttatgcatatgttcacgttcatacaagtttactaacctcattattgtgttttgtacaataattaagcaagcccagcataaaattgaatggaagcccgcttcaatgaacagtgtgtttacaaaagcaaagttctttcatctgcttctttaattagttttagaaagggagaaataagcttttatcacttctttttttttaataaaactaatctagtgtgaccttttgctttcaacaattactgtgtttgccatttgaaagattccatttggtttttcttgatgataacaaaggtttatgtgcaaatagttttacactcacagaaactctatttttctgttcctgtatctatgatgaagggattagagataaacggttctttatctacccttccaagcacagtctttatggaagagaaaacttctctttccataaattaaatacccattattcaacatcctacaaaattgttggaccaagaaaaacataatttggcatcatcctcggcctgtcaatggtattcccaacatggcgaaagggtcttctagagactggcaaaaaacactttattttcttgcctatatatggaataactctttctctaacaagtgtatagcacctgccacgtgacagaatagtaatctagtgggagcagtggcaattcagggagattattttagtatcatggttcaatattttttcatacttcatttttcttatgtatgagaggaaagcaaaggcataagagaatatttgttgtgtcagcaatctaactctttatcaatacgttaagttgatcacattaaaacttctacctctcagccaggcacggtagctcatacctgtaatcccagcactttgggaggccaaggcgggtgaatcacttgagatcaggagttcaagaccagcctggccaaaatggtgaaaccccatctccactaaaaatacaaaaattagctgggcatggtggtgggtgcctgtaatcccagctactcaggaggctgagggacggaggtgacctgagtcctgaaggcggaggttgcagtgagccaagatggcaccactgcactccagcctgggagacagagcaaaaaaaaaaaaaaaaaaaaaaccacgtacttcatcaatgaaagtgctctggagagaatcatgtgtttagaatgagatatgctctttattgccaggaagatttcatgctcctcatgcagccatgcatgcaagagttcctagggtgaaaagagattgtgatcattccctgccctagttgtgagagtccctcaattcatagtaagcccagtgactacaccatgggcaaaagggcgagccaggtttggatgagggaacacaataggggtcaagcataagtcacccctcagaatgaatcctaagccccatggatggagaaggaagtttttggccaaggcttcaagtcccccaagagcagtcgtagacagtggtcatcaaaagtaggtacctctttgtgggtatacatgactccccaaatgcctctatcaacaacagctcatgtttgtatggaattttacagttgacactgtactttggcatattttatttcatttgagtctcatgtggacccatgaggttgggaggtcagtgatgattatccccatttatagataggtaaacaaaggtttaggaagattagctgatttgtcttgggtcacccaggaagcaaagagcagaactggggctcacactcaggcttcttgattccaaatttggtcttctgtcactgcatacactaaattacagtatttcttatattaactctcatttaatgtatactaaaataccattatagagacacttttctatcatatgctatttatatatctatgcagttctttagagggaatagctcttaactttttataaatatctaaaaatttattctgtttaaagaaactctgtatttctccctgagtgtcttatttctgactttttatgcatgagcatatcttatgaaaagtagaaaagtattctgtttcatgctggaacaaggactgcctgacattgccttgggggtttatcttattctgcagcatataggaacatatgagaataaagatgcttcaaatgttcaatctggagaagtcaggtcaaacaggaaaaagaagcacaggaagatgagccagggcagggagcggggacttggtctatgacactgtcatcacaggaacaaatgctgagagctcaggaggaggtgaagcatcagtgtgtgggcattggaaggatcaaaaaggaagcatggttttgaaccatcctaatccacctgctgcccagagccagccagatgttgtccttctccctttgaataatttatgtgcaactctacccctcaatctcagtcaaaaccaccatgaactcagttctgagtccagacaggataaaagtgaagggttcttttttcagaggttatttggcccagtgtcgaaacctgttcttattaatggtgctcaacgcttactctcaaactagtatttctttgtgctgcccaggttaatgggcattctgcaaaatatatatatattctttttccagggcagtttcatagtatctaataataaagatagtaaaaaatatattcctgtggtttcatggtacctagtagtaaaggtccccaactagccagcaaagccaccagtttaattttggtttgcccagcttttcccaaatggccagggaagttttccccaaaatgcctattaacatctggtggaactcagttctgaagctgtctgtgaggttcgttgcttggttcctaagttgagggacttgtgtcctctatgtgaagtgtaaatctcaccccctcaccaccacctcactaatttcctactgctgatctccctggactttggaccctcagcctggctgagtcctgctgccaaactgtactgacttgcccagacccagcctgtggccacctgggtgtatgaaaacttgaaggaccctcctctcatagtgttatttttcagatcctacccacttccactcccatctgctcggttctgtaaccatctcagacatgagtccccgggtgtgaatactcaatagaaacatgtcacacctggccagggttggagaggaaagagacatggtacatcctgatatagcacattgggagtaattagttttcatttttgaaatggatccattttgacattgcagtgagaggaagaaatccttactcatctttatattctcagtgactagaactgtgtctaacacacagtagacggtaagtagattttgtgtcaaatggaatttgatttgcttcatgatctagcccctttctggataatagttctccatatgtaaagcagaaatgacaataatacctacttcagggggagtatctttgcaggataatatgagatgattataactaaattgctctatgtctgttggagattaaagatcagaaagctctctctcttttgttgctttatttttaaacccacatattaccattttagtgactgaaatcaccctgaagcagttgaatgacttttatttaataatagttaatattcaataataaatattaatataattaatagtaaaatttctaaatataagttttttagcatctcaataaagctatgtttactttcttttattttaaatgacaaaaattagcctataccttttaaaatttttccttttttgggccccattgttatatagaagtgagctaccagtatcacttttgtaatatctgggactttacgcttctaatatgcatatatatatatatgtgtgtgtgtgtgtgtgtgtgtgtgtgtgtgtatacatatgtgtgtgtgtgtatatatatatatatataactgatagtagttgcttatataagtcactacttaccatgtgtcctttggtatctacatataaaatgagacacagtggatgtgtgatctgtttttgttttagagaagcctttatgcaacaaccagggagatcctaagcctgaaaccataagtattggaaacacaaatgttgtacattcatcccttcccccaaccttagttattatctaagcaagcaagacacattttagaccttttctcataaatcaaatcctacagctctttaatctcttttctttgtcattccctgaattccctccaatatgtggataagggttttatcccccttcagacctagccaacaagttgtcgtttgaagccctaaagtcatctcttagattgctgagcttctgtgttgtgttggcctgtgtggctgacctggttcaatggactacacatactgcttctagaagtatcataaggatagggtttgtctatatccattttatctgaaactccaacatcaggttataaagaagtattttcttcccacttcttttcctagaataataactgcctgaccaatcaatctattgagatccgtatgagaccatgtatgtgaatggagtttgccgagtattaaagattatataaaacaaaggagcagcattttagctattatgggctgctctttgttagtaagaagaatagtaatatgctttgatatatgtcacctcaaaataatagcttgctcaataaataactgtactcattaagtcttgatatgagaaattatacctaggtttgcacttctttcgcaaggctaattattggtttctcaaacaaaacgttgatatttttaaaatgcctgatggtaacttcagttaactaaatatgccacattaactaatttttaaaaaatttttgtgtaactatgtaattgttcaaaataatggaattgtgctctcaaattataatagtcatacagcatctcacataaatttcttttaaaatgaattcacttatgtataggactcaagtgtgcaagaaggatgaaagtaaactacccaactcaaacaaaaaaagaatgtattaatattaacataacataatacagtgttaatacattaacaactatttaacatcagatctctggagatgagacccggacatcagtattttttaaagttttcacggtgattccaaaagcaaagtcaaggctgagaatctctgcattgggcagtgttagatagtgcaacaactgaatctctacattgcgtcttttttgccaaacattgataccccctgaggacaatggtgaggtgatgataggtaagacatcattccacatttaaggatgtgaagcaagaacctctttccttttctttaaggtccaatttgatgcaaaagctatatgctataattcctaactaacacatgccctgaaatggtcatgctcccctttagccatcccaattcccatgaaaattagtatcatagaatcgtgtgccttggcaaacaacatggcctgtgtttgcagtatatttatattcctttgccattgttagcattcctgcagaactgtgaagtgttaacaacctttttttttttttttcctttcagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagaggtgggattcctgcattcctctcatgatgtaaataaggaagccagtgtaattatgttattctcaggcttaaaataaatcattaaagctcatttatgtgtgggttttggctcatcaactcagcctgcattcctagttgttattttagaaatagtgagctttttgccacattgtctccttccccaagcctgggaggtagatctcaaaagttctttctacccacactgcttctccatcacgccacactcttcccaaaatttgctgtaattctcagaagaaataaggatgcatccaagagtgtccttctactgcctcccaccaccccaggaggccagagccagtgttccactgccaaccactgtgatcactaatgcatagagtcccataaataaaggaagatgcatgcatcaaacaaagtaaaataaagattaaactactttacagtaacttttttcgtgtagacaactgaatcaaacaagctagaaccaaagcgagtgatctttttcattctttttttagcagctttattgtgatgtaattcacataccatgcaattcacccattgaaagtgcacagttcaatgggtttcagtatattatattgtcaatttctttgaattgaggtaaaatatacataatgtaatgtttgccattttgaccatttttaaatgtacaattaagttgcattaatttcattcacagtgttgtataaccatcagcattacctaattccagaactttttcgtcaccccaaacagatactctataaccaataagcagcagctccacatacccttctctcccccggctcctgataacttccaatctactctttctctctagaatttgcctattctagatatttcatgtgagtggaatcatacaatatttgtctttttatgtgtggcctattttacttaacataatgtttatccacgtggatgaacataagattcatccacgttgtagcctgtgtcggtacttcattcctttttgtggatgaataatattccattgtatatatcccacatttatccaagagtaagtgatttttaaagggttcctgaagtcttctgaagttataaaatggaaaaacacacaaaaattagaaaatcaaaggctgaatcatgagatcagagttggaatttcagaaggaccataaatcctaaaaatcataaaatgttagagccagaagggacttcaaagatttctgctgtgtatcaaaactgaagtaaaaatattctgagactttattgttccatcataacagtacaattatttacctcttatgggaagtcttctctgccctccaccccaccgtccaggacagaattaatgtcccattgtctctgttgattactgtttagtcatacttctatggtacataccacactgtactggaatcatttatttatatgtctgtctccccttctatacttcagttcctgttttttgtacatctttttatccctaatacctagttacaaatacaaacagctaagtaccacataagtacttaagggatcagtgtcccctaattatttgaacactggagcataattgaggaatctcttattatcctgaaggcagttatgccatttgtagaatggtaataaccagttggtatttgggacccaaagtgctacaacctgtgtagtacaaatatctatcatggctaaatgctgacttttctttatttgtcatttttagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaaggtgcatttttgttactgttcatttttagaagttaccttaagaacacagtcattacagtttaagattgtcgtcgattcttgtgtgctgtcttatatgtagtccataaaacccatgagttctgggcactgggtcaaagtctcctggggcccatgatagccgtctttaacaagctctttctttctctctgttttaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaaggtatatttcagtttattgttctgagaaatacctatacatatacctcagtgggttgtgacattgttgtttatttttggttttgcatttatatttttataaaaacctaaaggaagtatttacctctgccaagtaagtatttgacacaaaattacatggctcttaattttaaaagaacccatgtatatattacattatgattttagagtccataagctctcatttcacaaaaaggttaatttgagcaaaagtaatttgtttatcatctaagtgcaatagtaagaaattgcgaagctctcttttacaatccaggaagagttaagttacaaaatatacttatttaaatgtaagttggaactgctacattttttacctgttgaagcccaaacattgaaattatactgttagtaattcttcgaagtgttttcaatgaactgttagtacacagcctttttcccaccatattctaggacttgaatgtattttgagacttagccaaggaaaaccttcaattatgccatgaaaaaaaggaggggtcaatatcatcagctttgtaaaacactatgcctagtaatgttcaggttaatcagagttttcatgttgttttatttaaatctcctggtaaaagcaaaaggtctgtattgtatcagctccattatctttagaagttacaggatgtgagtcaagtacaagcatttccttggttgaatatttaccattggacaaataaaatgagtcacagatcattgaggatactggaaaagttagaagttgctcatccaaacaagttcaagagcaatgaagcacttaacattttaacattttcaacacttactacctcttatgttttgaagtttatgttatttctatggagatacacatagtaaacattgtctttgccctgattccattcacctttaaaaatccattcgtttaaccgtgtggaaaaatcaaacctagtttattgttttgaaatttagatctatttagtattttatgtgcacatttagtgcatctatttagtattttatatgcacatttcatagttctaatctgagatcattaaaatttacaaattttctttgaaaaaaaaacttacctaatcttctttgaacctccttactcaccaaagctctgtcatcattgctaagaaggttgagtttcacactcttttctccattgagcctgctccttggagacatgaaaagaaaacaggtaaaagagggtcatttagagagaatgagaaaataggtgcacagccaaaacctaatgaagaggcaactgcagagctttcctctctacatctggtggggacagcattctcatcagactttttcacggagacctagagtgctatgtggtgtgacatcagggtggcacactgatggtttcaattggtttctgcacatgttggaatttagctgaagagtcacgttttcatgccaaagggcttttatccatgtctcaccaaggatttccctcaatctgtgcacccttaagcatttagagccctgatctccagatgcaaaggctttaggaagtgagaatgaaagacctgagtttagagaggctgattggcattcccaatcccctggggaaggtttagagaccctgactccttggaattaagggagcaagtacccagctaggctccttccttcctcactcacccaacatttcaggtacttcactgatgttccacatccttctttaaaggttgctcttgtcttttttctggctagtgtctactataactgtaattgatgcccaacgcttttctggaaccacttttggccaagttcatttattattaatcaaactgtccactgtagaaaatactaaaaatgctcaagtgggattaggaatagtcaaggtactaacagcattctttttatgcccttctctcagattctgattctcctgcttatttgcaaacaaatgatacattttggtgctaatgaggaacccccacataaccttctccctgtgttacatactaatacatttcaatactatgcctagtttatcttcatgtcagttgctgtggctatgatgccccctccttgatatgtgtgaattcccagtggaaagagaaagggaaagtggaaatgccctatttggcattaagaaattgactatcagcaccatttcttcccctgaaataaaaaaaaaaattctccttgcaaaagggaactttgcctgaggttcttacagagctttggttataaagatcaacttataaagaatgcttacccctttcatagtgtccttaactaaacaacaaggatggtccactaaccgagatctaacctgccttctctaaacaacagtaacactaaatccagtgccatcactgcacagtggagaatttaccactaatgtgaaaagctttcagttttgggaatatagccattatttatttctaatcatatgtgtatttttcccttggccaggaatccataggttttgcacaatagtaattaattccattaacaaatagtagtgtctcaaaaggcatctttttcattttcttatatttgagctggatttttgtgagacgaggcaattgctcaactacctttgctgctaccactgcttccattcttaaggacatagtatattcaaaaataaaccataagcatggctttttgctattgataaagagagaaatgtctaaggaaatgagggtaaaaagctttcaaaattaatacttagtctacttaaatgaaaatctgtaaacatctaatgaaatgcttgtatatataacttagtatcttttcccaatttattatcatttttatcaaactaattccattataaaagctcttcctgtttcagtccccattaaatgaggttttactgttgttctttaataattttccttcatcttacagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagaggtaagtatttccactcagctttttgttaaatacgattttccagtaagcattttatctttggcctttgcagattaggaacttagacaatggtgaaagcaactgacagagcagtgataacaagtgtacttgatttctgttctatagaaatgtagccctgtaaatcatatccgtggggatttgcccttgtgcatggaagcaattggataatcccccaaatatattagaactaaatcacaattcgtcctcgtcctgtgtgtactagcaattatagtttcttcaaaggtgccatttactttcttctaaaactcagggccaggcgcagtggctcacacgtgtaatcccagcactttgggaggccgaggcaggtggatcacctgaggtcaggagttcaaaaccatcctggccaacatggcaaaaccccgtctctactaaaaaaatacaaaaattagccaggcgtggtggcgggtgcctttaatcccaactactggggaggctgaagcaaggagaattgcttgaacccaggaggtggaagttgcagtgagccaaggttgtgccacagcactccagcctgggcagcagagcgagactccatgtcaaaaaaataaatacttataaataaataaatatcactcctttaattttgagtatttttattcaatctctctccagtctttctttaccctgagaacagtgacaaactctatgaagcctggtttatagcagtttgtacactgctggacagcatcagaagacagagaatttatagcattctcctgatctaaagcaacatatatcatctctacaatgcactccaatttctttatacaaagataaatgaatatttttaataagctagccaaagcagcaataacagctagcataaacagtatttgtggaaatatttagcaggaaaagaaaccaatcaaaaaccgggaaatgaacttcattcttcttgttgtttttttttttctaaaaagcttttacccttaatactaaatggcctctgatcccttttattctatatgtgctgcaagaggttgtacaggcatctgccagtgtgatacaagagaagctgatggcgtgatttcccttatatgaacacaaggccttctcactttcctgtggtagcatccacacattcttctgtcaaacaccccagagcgtaatcctttgtgtgctccttcttccccaagagtggcttcactgttaacaaacatctttccatttctcttcagagtaatatatagttctgtcataggcctataaatcccagtaattgcatcaattttagagtgtgtggactcactaattgtgttctaattctacacatttggaaaactagaattttttatcatgaaaggtactaaaatggcaattatttctcttttgaagttataatcattaacagctctataaatattagctactatgtatttatatgtttttctgcaggagaataggagcactcaaaagcataagttttattttattcttctttgcattagtagagggcagcctaatgcctgacactcacatactaggcactcatggtgtcttggccagctggatgaattaattagtgaatgacttacacagctatcagacatttggcacctctgggggaaattactgccactggataaaaggctaccattgggaaaatgatgtggttaaagccagagagaactggatgaagtgagtcagggtgaatttgcttcatctgggcaactgcctttcagtttctgccaacctggattacgtattaaccagtgactaatggggaaatccttattctataatactaatcctatttttaatggtaacatttttatttcatttcagcttattagaatatagagaacttattttattatagttcttcatgtgggttaactttattttcatattttaaaatactatgtcatcctttaaaaaaatttatttgatgaggccgatgttactcaccttttcagtggttccactgtggttgaatattttattaggttaggctttaatatgagtcatatcatctacaacttattcatgaattaaataatcacattgcttatatccttgggtgaaatgtgttgcatctacatatatatttacaaacacacctacgtacctatagtggtattgttaaaagtattttttaaatgtactcttttgctgtatagaaagaagaaagaataaaatgaagctcataaagggtttgataaataattatttcataattaaatgttacgcagtgctaaccaagttctttcttttgcacagggcattttggttgtgtatatcatgggactttgttggacaatgatggcaagaaaattcactgtgctgtgaaatccttgaacagtaagtggcattttatttaaccatggagtatacttttgtggtttgcaacctaataaatagcttataataaaacgttgatttacactttccccttgtggaaaaatcagctaccactgaaattatgggcctaatcctgaaaatttgttttgttctagacttttattgaactacttcccctgaaatgatccctcagagccctcattagtaagggggtaggagaaatgaggttcttggatgaactgagtatcatttaactataactatgtttggtttataatatttgttttgcaagtgacatttctggaaactattggaagcatgttggcacctacagtagtaatgactcattttacccagaggcattactataattattttttaaccacaacttccattaaaaagataaaaaatgaaataagacaaacaggagaaaactacgctggccaaaaattgaaaaatcataagtatggtaatacctcatttatccacatttttggagagtgaggcattccacatacatgaacttcctaaataaatgaaacctacccctttttaatgctggaacattacttaaaattttagctgttattgagaaaatctttttaagatgaaatgcatactctgtttaagggaatgcttccaaatacaaactaagtctttattggtgaccccaagccataattacagccataaattactatattacacaaacagtgtactccacatacatagtgttcctggctccgcctgtgttgacaggtctcacatgcttgcgttttctactcccatttctcattttctgcttgcaaattgcagcagcctgaaaaatgttaaccagctctactacaaactttatatgggacttaataagctttaagtgcacaaatgaaagattttcctgcaagatactttactgtcacaattatttcagtctttttaaaatataaatcaacatgctaagtagtgttctacatggttaattttgttggaagtctgaccatgagggaaataaatggacagtctttatgaaacctaagtataacctttgcactaagtttataggagacaaactggtggctggttggactctatcttgcaaaagtgggcataggtggtgactggaaggcacagtgcacggtggcatcattcactcagatgtgatgtaaaaagaacactctgcagtcaaaccctcaggacaagatgctaactgtgtggtttaccatttcattgctcttcctatctaaatttgacaaaagtattcactgttccataatgaagttaatgtctccaccactggatttctcaggaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcatgtaagttgactgccaagcttactaactggcaaactagctgtaagccagccatcccttcaaaataggcctgctctgagtctttaaaaagctagtagccaaagatgcacatttaaaatgttagcatcattcaaatgcacctcaaagtcttctatcctggtgggaaatagtgacacctggaagggtttcctggagcaatgattcttacttgctctgcaagcaaccttgctctaccttccctctgatagggacatttagtcatctttgcatgtctactatgtgccagaaactgtgcacagcacaggagaagtggaagcagagcaagcctcagcccatatggaatgttaactctacaaggcattgaaaaattaactccagatgcgttccttgctgttccttgtccttgccatccactctcacacctcaggaactttgcacttgtgctccctcagcctggaacactctccccgcaaatagccacgtatctcacttcctcatcttcttcagcttttggccgtaatgccatcttcaacataagccttccctaatctgtttaaaattgcaactgaccacccaccctcatggcttcagactcctcttccctgctctattttcccccatcacacttaactgtcatctgatacatgcatgaagctgcctgaagctgcccaatactatggccatgagccacatgtaaaaggaggctagttcgaactgaaatgtgctgtacggtgtagaatacatcccagattctgaatacttagtattaaaaaaaaaagaaggtgaaatatctcactagtagttgtttatattgattacatgctgaaatattttggattttgggggttgaaaaatacattgtgaaaattaatttcacctgtttctttttacttttgagtatggctactagaaaattttatattacatgtgtgtcttgctttatatttctattgaatagcactgtagtagataataaacaaataaacaatagctatatagatgtatatgtatgcatatatatgtacacacaccctcatcccattagaatggaagctcatgagggtaggatttttgtgtattttgttcactgctgtggctccaacacctaaaacagtgtttagcacatagactcgcagtaaataattgttgaatgaatcagctaagggttacaaaaaaaggttcttagcctcttgcaagtggtagatttttttcttgacatttatgccaggacctaaaagtcaccaggccaggaccagggagggtgggaataagaatctcaagaactgaattcatagaaggcctcaagctccgtctcggttcctgctctccaagtctctgtgggaggtaatgaagttgatcaaaagcaactttataaatatggggtcaaattatcagagaaaataagctctaggagagtaatgagatattactcagccaaaagaataaaacattccctggcagtgaacttttgcagataaggcgaattgaccttacaaagcacacagctgccctgacagaccccactttcccacttcaacttttgttattaccctgatggattaatgtggctggaggtgctaccttctctagggtactgttaccccaggattaaagcatgatagagatttcctgttatccagaacggaatagtgccatggccttttttaatccaaggagctgatactgagagcaaccacaaacccagatgtgtcttaaagagaaacctaaaaccaggaactggcctttctctatgctgtgtgcattgagtggggctacagcccttttgcagggtccccactgactacatcttgcactgacaaactcctcagtgactgttgaaggggaataccccattcctgattgccagccagtgacatcaccagacttgacagctgagtggtttggggtgatttctttctgagcctcctctattcactgtgcttctgatgttctaacatcttgggccttactaaccctggaggaactgtccctcccaaggctagctaattcctgcaaatagtaaacagcttgccttcaaagcatacctgtcatgtgcaaaccaaccaatccagagcccttatctaacctcctcctttatcaggctcttacactttgggctactatccacctgccctaatcaccccagggcccagttccagacaactagaactatcctcggagcctgctgaaatactccagattggccagctccaaacctgcttaccctgccttaccagtttcttcccagggaaactgcaatgaaggctcttgctcatgtttttcccctctctctctctgcctctagagcccagggcttcccccatgtgaccctgcatgacagggtgtgcctcctcctcttgcaaactgtgaatagcaaactatcttttcaatggcagttgtctcctgttctgttggcctcatcatacctggaaaataataaaactacattttaaaacacctccattttcccatctggaaaatggagcctgtaacacctgcctgacagaagtgtagaagtagctgtaatttatgaaaacaattagcctggtgtgttgcatacaataaatacttaacaaatggttgatctgtcaatggggcacactttttgttgttgttgttttgttttttgtttttggagacaaggtctctgtcacccaggctggagtgcagtggcacagtcatagtgcactgcagtatccaactcctgggctcaagcaatcctccttcctcagactcctaagcagctgggactataggtgcacaccaccacaccaggctaatttttttgtgggcggtggatgggagtaaagacaggatctcactgtgttgcccaggctgatctcaaactcctggcctcaagccatcctctcgccttggcctctcaaagttctgggattacaggcttgagccattaagaccaaactaatttttgagacaagataattttttataaataaacatttcagaattctaaggtcaaaattagaacagtagatgcttagtttatgcttttctaactctctttgactgcagaatccaactgtaaaagatcttattggctttggtcttcaagtagccaaaggcatgaaatatcttgcaagcaaaaagtttgtccacagagacttggctgcaagaaactgtatgtaagtatcagaatctctgtgccacaatccaaattaagtgacaaggaggaatctgtttcccactgttcaatgctagttaagctgttttctcttcttatgcaaaagtcctttatttctgttacaatcttaaatcgatgtgtaagccctggggatgtgggtgggactttcagactttatccaacagagaatttaaaaggattctccatagggggtcttaaacagctgttgtgtacttttgcttttctcagtccttccctccagtagctctcaatgttgtggtttcacactgcattagtgttggggagggagaatttgatcttcagcatttgacagtgaaaaggagagggctgggaacacaaataccaacatattgcaacttcccaagagtggatttgaagccagcctgcagaagccctaccaaaaatggtatttggcaatgaatatacaaagaactttatttgtgtctggctgcctggctatgtaatacaacagtcaacagtttgtaattgagttcatgttttcccttgcatagcactgattcatgacttatggtatgtgtgaatgaaaaagggtgtgctattaatttcctaccttggttttggtcactgtaacaacataaaagccagcttaaacagaggatgcatagccccagatagcggaaattgatttttgttgaacttcgctgtttttcttagatgctttactgtgtatcctagttctctattacctcagtggtgggatatatgagttttgtgtgctaacctagctcatttaagaatgaaaaagtaaagtatcagtcccctgtcatgctctcccataaaactgagtatcgctaatcagttgacaagcgaagattggtgattgcttgggtagttaattagcatacttcatttagcaaccaaagtaaacccacaggggagacagccttactactgcagatctacattaaagcaaaaaggactttcttatgccatacaattcatgatctctttcctcagcctgttgaattggcaatgtcaatgtcaagcatttttattcaagaattctgttgtaatttagtgttagtcaatagaggccagatgaaatacttccttcagaagttatggatttcaaatactgaagccacttgtttaatctgtagatattcagcatcattgtaaattattctatttcagccacgggtaataatttttgtcctttctgtaggctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtggtaatgtattggttatctctgagtttctcctcttttactttcatatccaactttttttgaagttttatcactacttaattttttaaaaaaattcaacaccaccaattccagttttcttcatatgtaaaaatggacttgtctgatacgtacacattgtatattttcataaattcactcatttgttcaaaaatatttgttgagtggggcaacataccagctccttaggaagcccagagctgaaccaggcatgaaccctgtcggccaagaactttggctcagaagggaagagatgagatggtcaacaatgactgtgacacaggtggcctggaatgggccctgattctcatagccccaggcgagcaagaattccacatcaagaaatctggaagctgtaactgaggcagtctagcagtgagggcatgatccctgggcctagctagtaaagtgccttcccttatctgcaaaggccatccttcttgcgcagaacaagctctcaaaaggcatgcacctgagtgctgaggctgggagaaatactcacctgggcagccagattcaccacattccccttccaccatatggagaagtggcatttgaattgggttaaaggacagcaggtttggagttgggcagctgggcaatggaaataccgatccaggtgtggcagaagagcaggaaagtataagcacctgtaaagttataaggaaacagtacttagttatttggcaagaacagaacacagagagggaagttatgagaataaatggagaaaaatatacttatactaggtcatagagttccttgaaaactgaactagagagtatggaatttattctctggtaatgtggaaacaaaaaagtaatcagattagactgcaatctttcatcattgtattagtccgttctcacactgctataaagaaatactgagcctgggtaacttataaaaagagatttaattggctcacagttctgcagactctacaggaagcatggctggagaggcctcagggagcttttacccatagcagaaggcaaaataggagcaggcattttacatggcaggagcaggaccaacggggctgtgggaagtgccatgcacttttaaacaaccagatctcctgagaactctatcacaagaacagcaccaaaggaagaaatctgcccccatgatccaatcacctccaaccacgcccctccctcagcattggggattacaattttacatgagagttgggtgggaacacagagtcaaaccatatcattccgccctagttcctcccaaatctcacgtccttctcacatttcaaaacacaatcatgccttcccaacagtcccccaaaatcttaactcattccaacatcagctaaaaagtccaagtccaaagtctcatctgagataaggcaagtcccttctgcctatgagcctgtaaaataaaaaaacaagttagttgcttacaagatacaacgggggtacaggcattgggtgaatgctcccattccaaacgggagaaattggccaaagcaaaggggctccaggccctacacaagtccgaggccctatgcaagtccaaaacccagcaaggcagttattaaatcttaaagctccaaaataatttttttgactccatgtctcatatccagggcacgctgatgcaagggatgggctcccaaggccttgggcagctctgctcctgtggctctacagggctcagccccatggctgctttcatcggctggcattgagtgcctgcagcttttccaggcacacggtgcaaactgtcagtggatctacctttctggggtctagaggatggtggccctcttctcacagccccacctggcaaagccccagcactaaggggaggtctcagggagctttttacccatggcagaaggcaaagcaggagcaggcatcttgcatggcaggagcaggaccaagtggggggagggggagcatcttatatggcaggagcaggaccaaggtggtgacaagctttcaccaaggggagaggtgccacacacttttaaacaaccagatctccgtagaattctatcacgagaacagcaccaaagggagaaatctacctccatgatgcagtcacctcccaccaggcctcagctcccacactggggattataattcaacatgagatttgaatggggacacaaatccaaaccatatcaatcattctccaagacaacttgaaaggagtagaagcaggaagatgaagtgagaagtggaacttgaaataagacacaatgagaatggaaaggaagagatgaaaggaggagcatctcagaggtagaatcagaagtatttaccaaggaattgataaaaagtcaaagattagcaaagatatatgctcatgcaataacacatatatgaagcacagaagcaaaagctggactcagaacaaaaatagcaagttgagccttaaacacactgagtttgccttgggagtagaatgtccaggcagagaagtccatcaggcaattgaaaatgtgaatctgcaacttgtaaaaaatgtattattcagcctgggctgtcatacaatagaccacagactggttggcttaaacaacaaaaatgtatttctaaccattctgaaggctagaagtccaagatcaggatgtcagcatggttgggctctattgagggctctcttcctggcctatagatggccaccttcttgctgtgtcctcacatggctaaaagaataagagtcagttctccagtatctcttcttagaagggcactaatcccagcatgaatgcccaccctcatgaccttgtctaaactgaattacctctaaatggccccatcattaaacattgtcacagtggggcttagagcttcaacatatgaatttccggggaacacaattcagtccatagcaggggtcaaggctgggaatatgcttttgagagtccaaaagcaattattcagtagtccaaaagcaattattcaactacatatataaagtgaaagagaaaagcagtgaggtaagggacccagaagcaaagaccaccatgaaagtcagagtaagagaaagtttcaaggagaaattggatgctcaacagagtccactgctactcagtacaccagaagggtcttggaagctgagtaacttgagtgatttggaggtctagagtgtgcttaggagcacaggtgttgaatggaatggagagtacacttattctattcacatgttgtaagtcagaggactgtgatgtctgaagatagagaaacatttgatgtttcagtccttaaggatgacaactaaaaaaggaaaatgtgcaaacaaagtagtcagaaaataatgttcatgggggacatgcacttgaagagaaagggttggtagcttttgagagatgatgggtcagagatctgagtgtggcatgggaagcaagaagtcatctcatccacctctctgtgaatcagcaagagggagaggtgtgacccctattggcaagagttgcaaagaaattgtgacttcaactgaaagctgagtttcagttcctgtgaggaggtaggggaactattagagaataagacgaggtgactgggagtttgttttcaatgagtaagtaggtcataggtcatggtggaggaccaggacttcagcatgcatgagattggtaagagaaagtgatagtgccatgtagagcttaatgcctgggattttgatcctgaaagattctgaaagaggtgaaagaagtgggtgctagagagggagactggggacatgttagtgacagtggcaggtgaaggcaaaagatagggagaattaacccatcctccaagaacatactgttcattcagacttgagggttagtctgccattaagaagccagagccaacccttacaactcaataataagactgtcttagtcgttttgtgctgctataacacaataccacaaattgggggatttataatgaacagaaatgtatttggcccacagttctggaggccaggaagtccaagatcaaggggccacatgtgctgaaggtcttcttgctgtgtcataacatggtggaaggcatcacatgggtgtgagagagtgcaagagagagcaagaggtgaacagattctctaacaaacccccttccacaataatgaactgactcccaagataatgacattaattcacccatgagagtagagcctcatgacctaattacctcttaaagatccctcctctgaacactgttgcattgggaggggattaagtgtccaacacatgaactttgggggacacattcaaaccatagcaaaggcaatattactcaatttttttaagtaagcagaagatttgaatagacattttaccaaagagacgtaagaatagctagctaatgagcacatgaaatgaaacatatgcccacatgaagatttgtacatgaatgatcacagtagttttcttcataatagccaaaaaccagaagcaatcttaatgtccatcaacgggtgaatggataaaaaaaaaatgtggtgtgtccatacaatggactaaaccattcatcaacataaaggaattactgatgcctactacagcatgataaacctcagaaacattatgttaagtgaaaaaaaggcagataaaaaaattacatgttgaatggttccatttatatgaaatttctagaaagaggcagaactacagagtcagaaaacaaatcagtggttgcctggggccaagagaaggagtgaagataaaccacaaatggacatgagggaattttctggaatgttgagatgatctaaaactggactgtgatgatatgatagctgcacgtctatataaatttactaaacatcatttaatcactttaatttactaaacatcaccaatcacttaaaattggtgagttttatgatctataaattatacctcaacaaagctgatttataaaaaaagagcctgatgaaattttggatgtttagggcaagtgttgggattctaagcttcttgacagccacatacatgcaacaatacccccacctccccaacaaacacacacagacagcacagaggccaaggcttcccccatagccacagtcactcagatacttgactggaaatgtacatagatttctgcagataggatggtgctatttctttctcactctcatcgaaagacactattttgtgctacataaaggctgaacctgaataatctgtacataatgctgctttgggaaatggttactgattgcatggataaatttgcacagtgttttacttccaggacagcgcaatcttgaatgttgacatggaacatttccaaaagcatgcaatgagctatgtgtatgttgaaacctgcgaccaaaaacttgcctgcttgtagattgggttttctttctagaaaatgcccaaatggagtttggctaaaatctgaatactctttaagtccattcaaacaaaatcggagtgtcactacactggaaatcactcacaccctcctctgaacccttttgcaatgggtgttgtaattgtattatacgttgtttcacacttaatacaagttcttccattaaactgtgtattgacttccttgttctcagcccttatctgcctcatctttctgaagtgtttaacattattgtaaccctcatttttcttgaaatttcctcttcctttggtttctgggacactgaaacttccagttttcctcctgcttctaggttgttttctttatcctcaatggcttctcttccttctgtcttccttctctcagatgtagctgtctcccaggatttttgtctttaggggtcatcctccaccaacagttggaaccattcccatcaataaccacctttgattctctctacctggatgtcatcatcagtgtcacaaatttaccatgttcagaatcaaactctttcctgccaaaccctcaatttctcacctcctggctttgattaatggcatcaccattgtgtaatttacccactcctcattcttttcagtgttcggtttttcaggttttgacaaatgcatgcagttgtgtaaccaccaccccaacaatcaggacatagaacagttctatcatctcagaaaatttccttatgctcctttgtagtcaacctctaccctatccccaggacctggaaatcagaaaaccagatttattttctgtctctagagttttactttttctaaaatgtcatataaatggaatcatgcagtcagtagtcttatgagtctgtctccttttacttcgcatattacatttgagagccatccatgttgtcgtatcagtagtagtaacgtatcagtaattcattcctttcttattgtggcaaaaaaatacataaaatttaccatctgaacgatttttattttattttaagttccagggtacatgtgcaagatgtgcagatttgttacgtaggtaaacgtgtgccatggtggtttgctgcacctatcaacccatcacctgggtattaagctcggcatgcattagctgcttttcctgatgctcctcccctccctcgataggccccagtgtgtgttgttcccttccctgtgttcatgtgctctcattgttcagctcccacttagtgagaacttgcggtatttggttttctgttcctgcgttagtttgctaaggataacagcttccagcttcatccatgtccctgcaaaagacatgatcttgttcctttttatggctgcatacaaccatttttaaatacacagtacagtattgttaactatgtgaacattgttgtgcaatagattcctagaactttttcatcttagcaaaactgaaactctatatccattaaacaattctctctctcccccaggccctggcaaccacaattctactttgtctaagagtttgactacttcagatacctcatataagtggaatcatgcagtatttgtctttttaggaccgacttatttcatttagcaaaatattctcaagcttcatccatgttctagtatatgacaagatttccttctttttaaaggcagaataatattccattgtacatatatgccacattttctttatccattcatctgtcaatggacatttaggtttcttatacctcttggctattatgaatagtgccgcagtggccatggatgtaaaaattctctttgagatcctttttttcaattcttttgtatatacacacagagacaggattgctggatcatatggtaattttattttcaaatttttggggacctctctactgttttccacagcagagtagttcatctctttttatttttgagtagtattccatcgtacagatgtaccacattttatttatccattcaccagttaaagaacatttggggccaggagaggtggctcacgcctgtaatcccagcactttgggaggccgaggagggcagatcacttgatgttaggagttcgagaccagcctagccaacatggtaaaaccccatctccactaaaaatacaaaaaattagccgggagtggtggcacatgcctgtaatcccaactattcaggaggctgcggcgggacagttgcttgaaccctggatgcagaggttgcagtgagctgagatcatgccactgtactccagcctggatgacagagtgagacccgtctcaaaaataataataataaagaacatttgagttctttccattttcaggcaattacttatacataattgtaatggctatgacatttgcttgaaggtttttctgtgaacgtaatttttatttctcttgggtgaatatctaggtgtaagagtaactaactgggttgtaagataagtgtacattcaactttatgagaaactgccaactatttttcaaagtggctgtatcattttatgtccccaccagcgatccataagagttccagttgttcagcatcctctcccgcacttgacattgtcagttttctgattgttagtcattctaattggttgtagtgctgtctcattttctttttaatctttatttcccaatggctagtgatgtcgagcctcttttcatgagcttatttgccatccttatatcacctttagtaaagtgtctactcaaatcttttgcctatttttaagtatttattaataatattaatttagttagggtttattttattggcttgtttttgtttcttattgaattgttcgagttctctgtatattgtggatacaagcatatcttatgcgatacacttttgccaatgcatttttttttcttttgggacgaagtctcactctgtcacccagcctgaagtgcagtggtgcaatcttggctcactgctacctctgcttcttgggttcaagtgattcttttacctcagcctcgccagtagctgggattgcaggcatgagccaccatgcccagctaatttttgtatttttagtagagacagggtttcaccatgttggccaggctcctgacttcaagtgatccgcctgccttggcctcccaaagtgctgggatcacaggcatgagccaccggtgacacctggcccacaaatgcatttttctagtctgtggattaccttttcatttatttaatggtatccttcaaaaagcaaaagtttttgattttgttgaaaattttatcagtttaccaattgataaaactttatcaatttattttttttcttttatcaatcctggtgttgatgttgtatctccatgcatctactcttgaatgctcagatttgcctatcatccttccttgctcacttacctcagtagcaaccctgtctatcacttttcatagcttacaaccatctttcacatttaatcatttctttgatcatcaccttcagtaaagttaggccagatattctccagatgagcttattgctggtgctcaaatgctcaaaatggcttgaccaatgccatacagtaagcacggatgatagcgctctcatggcttgaaactaaaactgacttgtttcctaatgcacatgaattgtacacctccctcccctcacccccgaccccccctcaaccgacagacacacacacacacacacacacacacacacacacacacacacacaccagcttctctcttcttggtcatcatcctaatcagcatcacctcctctttcactgtccctcccctcaccctgctgtcagccccacaatgctttcaggggagtgtggagtgcagacaatacaatgctcttcctggaaaccttcttcctcttacctccctgtcccgtgagtcctccagctattttctgatacccagttattgcccacgtcctttaattccttggaaaattacccaactccatcccccttttatgtgactttgtctccagacaaatctacatgtagcgtagactgtcagatagggagacctgatcacagaactttggcttcctcatcctaaaataaaaccaattacatcacaggattgtaaccaagtacaatccattataaggattaaataagatgttttgtaaaggatataatgcctatgcatgaatcattatatgacaaatacactctttcactaccttaattccagagaaaagcctcataggcttccgtattgtaggtatgcaggagtgtccctcacctattcttattcagaaacctcctaactggcctccatattgtgaatcagcttctcctttctgttctaagcttggcgcttacagatgccatctccctgagcacaactcagaactcagccatgtcccattgatttcagtctaacgcactttctttttttttttttttgagacggagtctcactctatcgcccaagctggagtgcaggggcgcgatctcagctcactgcaacttccacctcccaggttcaagcgattgtcctgcttcagcctcccaagtagctgggattacaggtgcacaccaccatgcctggctaatttttgtatttttagtagagacagggtttcaccatgttggccaggctggtcccgaactcttgacctcaagtgatctgcccacccccgcctcccaaagtgctgggattacagatgtgaaccaccttgtcccgtcctgtctaacccactttcaacatttaaaaacctccacagcacagtcccatttcaatcttatgggtccctaatcccttcccctactccaacatgtcaagcaacgtgaactattatactttatggtttaataagaacacatatgcagccaggcgccgtggctcatgcctgtaatcccagcactttgggaggccaaggagggtggatcacctgaggtcaggagttagagaccagcctggccaacatggagaaaccccgtctctactaaaaatacaaaaattagcctggcatggtggcaggcgcctataatcccagctactcaggaggctgaggcaggagaatcgcttgaacccgggaggaagaggttgcagtacaccaagattgcaccacttcactccagcctgggcaaaagagcgaaactccatctcaaaaaataaaaaaggaaagaaagaacacatgtgtactgttactcctggccccaccccctccacccaaaactctccctctgccctcatattacctgcacctataaaacaaagtctccctgttcctcaagacccaccttactgtcactctcttcctgcagcctttctcagtaccctactattatctctttgacttttggcaacctttgtacctctttgatattactgctctatattacagctattatcttattgtcctgtgtggcagttatctgctcaattctcttaaccctgttcattcagccctgggacctatctagtaacttgaacagtaacctactcgtatgtgatcaagggtcaattgatacttgttaaattgattttaaatgttaatgcatattctgggacttgaaagttaacacgatgatgttgtcagaagtgattgttgattgttaagattttcagactttgaaaacttctactttgcaaagctgaattagacagcaaagttctgtagctccctcctggcaaggggtttgagttttctgttgggatcaaggcagtcagcagccatcaagggttcttgcacttgggcaaagaagtcattaatggtaatttgtatcagcaattacagcatctacctcatttctttctttcagtcgcagcgttcaaaggcaggctttattctccttcttgctgggtactgcaagctacacttgcctctcagttttatgtcttcctactccagctgtctggtgtggattttccttctgctccaagcttccttcatttcttcctccttatgcttcctactcttagagtggcctggaagtgttgctgggccagaactgcccccctgggtcctgtccacaggggcggcctctgcccatgctgactctcctcgtgtcattcttgcatgggcacatgtccagggggagataatatgtatgacctggtctatcctgagcacagtgttttaaatcaagaaattgcatgtttattgaagttcagtagaccaaacaagacctaagggtcaggaactcttaaatgtttatcccagtgtggactcagatgtattggggaattttagcaagtcacttaacctctccgtgtccctgtgatcttcctatatagtactgatacggctattttatatgaatctagtactttcacatcttcatgtgacagttttattgaaattaattttcaatagagaaacttgttgccttgcagttttttttatttctgatttttaatatgtatttttacttatgttgatttagaccttcccatttaatagtaacctttcaatgtggttacatttcttaaagagtatttatgttcagtttgaaaccacacaaatttaaattttgggaggctttcttcttcttttacaagtaatgtaaaattgtagtgaagctattggaaaagaaaaggatagaaacatgttagtgctttgacacagcgggagagaattttggaagagatattctaccaactacagatggaatcttcatcatcatgtagacttcagatattcttttagaaaactttacatttacttataatctaaaccttacttgtttaaacaagtcatgaaatgtatagcttaataattgcctttaagaaaattgttgcccaaaacagaaaccgtattgagtatgtaaagccaagtttagttaccaagacctactgatttcctttcatatatgtatggtcacatctctcacctcatctgtcctgtttcttgttttactagtggtcctttggcgtgctcctctgggagctgatgacaagaggagccccaccttatcctgacgtaaacacctttgatataactgtttacttgttgcaagggagaagactcctacaacccgaatactgcccagaccccttgtaagtagtctttctgtacctcttacgttctttacttttacagaaatgcctgccttcaaagggtctcttacagcatgtctttctttttggaacagatatgaagtaatgctaaaatgctggcaccctaaagccgaaatgcgcccatccttttctgaactggtgtcccggatatcagcaatcttctctactttcattggggagcactatgtccatgtgaacgctacttatgtgaacgtaaaatgtgtcgctccatatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttactactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtatactgatagtggttattgccagtcatgcttgattacctgcatttgcataatgatagaggaagcctaagattgatttcacctggctgcatagagctcatccatgtaggagagccttagtcaagtgaatgctgaggaagtagtaaaacagcatgcatccccgaatctcaggaagtctctgtctttccaagggtttggtctaagttgctgattacctggatttttctgacgatctttcaactgctagagcatctggttcctgttttagcatggtgctcttctccagcaaggtgtgtccttagactagaagacacaaaaatggagcagcagccacaccattggcgcacagatacctaggtgtgggttggagagagaggccttcttgccccatcaaaactactctttatctacacaggtgcccacccttttacccccagttaccagagaaattaccttcaggttatctccatgtatattcttgtaatggtaagggaattcaaaggtgataatttcagccatctaagaattgtgtgacacattgggggtaatctaattttaaaagaacccaatttaaaataatgcctacaaaatacaatggacactgatcctttactgggagataattcaacccccgctcacggccaaactctctcccactcaaaagatgcatttccccagaaagttcaatccaactctctcccataaggagaacaacctgtcatctttacatctctagaatccggcacttagtagattctcaaataattgctgaactgaaacagcattttcttattccccatcactttatttatttatttatttatttatttatttatttatttatttatttttgagacagggtcccactctggcccccccagctggagtgcagtggcatgatcttggctcactgcaacctccacctcctgggttcaagccattctcctgcctcagcctcctgagtagctggaattacaggcacacgccatcacgcccagctgatttttgtattttagtagagacggggtctcgccatgttggccaggctggtctcaaactcctggcctcaagtgatccacctgcctcagcctcccaaagtgctgggattacaggcgtgagccaccacacccagcctactttaaaccaccatggacagagttattgcctatgtagctcccatgatgtttggagaacactaatatggagaatgcagacttttctggggaaagagaaatagaaagatagacctttaagaagtttggcttggtgctacgcatttttaattatcacagggttttcgcttcacgatataagcatcaattatatttttgctcgctgacctacacagtggattccatctttaaagaaatagggagaagggatatataacgcgtagaaatacatcaaatgcttgaatgctgacatctggcattgttaatctacctgatttagttcagaaaatgagttagcattatataaaagaaattgattagtattttatttaactcaacgaatatttatcaagcacctatatatgtcagacactgctaggtaatggggatataaaaataaacagtccctctcaccccaaggaatttgatgaaacagacaaaattacataattaatgaatattaaaaattattcatttcttagatttgtgagttgtcttgaagagacaccacagtttaaacatacacaaagtgcaggctcctgggcaacagaccaagccctaactcagattgggcaacatattggacttctctaaacctgtgttctcatctgtcaaatacattaatcatggttacccccacaaagttgtttgaggactttaaaaaaaagtgtataaaggcacctggcacaccatagttgttcaataatcataatatcattattatctttagtcttagacaataaaagcccatgtataggtagccttagttggctaaagggaaatgaggcttggaggggcattacagatgtttaaatccaaattcttaccccattctttttgtttttgttttttgtttgttttttggtttttgttgttgtttgttttgttttgtttttgagacagagtctcactctgttgcccaggctggagtgcagtggcatgatctttgctcactgcaacctccacctcctgggttcaagcgattctcctgcctcagcctcctgagtagctgggattagaggtgtccaccaccacaacagctaatttttgtatttttagtagaaacggggtttcaccatgttggccaggctggtcttgaactcctgacctcaggggatctgcccgcctcaggctcccaaagttctgagattacaggcatgagccaccatgcccagccaacttcttaccccattcttcacctcacacctgctttatatacagtagaaacagctgtgattctgcctcatcctgcatatgacagtgagggtgagagaggagaaaggtgacaagacagtggcactggcaagagaactccctcacttctttctctacactccccactatcactttaattacttctcctgtgacagattccttttttctgttttagcctttagacctggaatacacaacagacatggaagagaacattctgtctaaatgacaggcatgttgcatgaaggtgcaagaataagagccatagtcttcagtattggtgtctagaaattattattgttcctcatttttgctcaaatgttaatagatggttaatgatcattcaggttgaagaaaaagtaaactaagtacagtattgttttagttatgtgctatgtgtttgaagatgaggaatacatgactagacacacatagcaagttacacaggcacacatgactcactgttgtagcacttcagacagtttcaagacacagagaggtatgcagacgttatgccccaaaggaagaaatgcttattgctgtttttctttttcatatttgaggggttctttcaggactatctcaattccttatctatcaaagaattggaaagaacttcagtcataaaccaatgaaatatttcagttggtgaattgaaggtaataaaatggatgcttgcccaaactgtcctttgttgtaaattattccagagaactagattacgtcagccaaagatattgatcacaatgctgagaggtttataactactattaacttaccatgtgaccccagggcagaaatctaggaaaattgcaaaagcatatctactgtaatgaaaagcccatcattaataggacttactatcttgtcatccaactagtactatgttggcttcaaggcaaatatttaacaaacatttgaaacagaaagcacttctgtcttctcccttttatcttccattgatgttcccgagctattctgatgaatgtgtttttgttcttatcaataaaacatgtaggttaaaataagtgaatatatttataattattagcctatataaattagcatccaaatattgaaatagctcctactcctttattattactatcattattttaataaggagttagctcctcatgtagaccagtttagaatacggctcaagtccaattctcctgcgtagttaaaccctacctggttaagcattctgaaaactagttactcttttttttttctttttttgagatggagtctctctctgtcacccaggctggagtgcagtggttcgatctcggctcactgcaaccaccacctcctgggttcaagtgattctcctgcctcaacctcccaagtagctggaattacaggcatgcatcaccacacccagctaatttttgtattttcagtagagatgggatttcgccatgttggccaggctgatctccagttcctggcctcaaatgattgccatctcagccttccaaagtgctgggattacaggtgtgagccaccacacccggtggaaaacgaggtactcttagagaagcaattctgagatgaaaatggccatatttagaatgcataaacagacatctctgatttaaattaactactaatttaacgttatttttgaagcactgggcccaaattacaatgagaattaattcttattcctttcttgaaaagaagccctttgtctttgtgcattcaatttttcactgtcacatgagtacattcttttcaccgcatgagtcccaggctggcagaaacatccactaatccttagacctcttggctggaacgacaaaaatgcataaaatcttaccaggccaaaagagatcaactttaaaaatctttggcatccaaacatgtcagaactgtttttcgctggttctgcaaaccatttgtgttcttcatttatggtccaggggatctgtaatgtcagttcctacttttattgggcagcctggaatttttaagcaccatatttcctttacctttcttggtggtttataattttcaccgctgtttttacgagttttcttctctatgtctctaagcctaagtgtggagatgtggtaatagacagcctgctctttgccaatcaaagcccttactttgacgttggccactttgttcctgtgacatctgctctttccattatagacaaactggggctttccttctgcagaactgtgactaaacaaccaccatattcatcagtggcaacaattcttgtaaacaagaaacgctgaattcaaaggctttgtgaaatcctgcccccaagaggccacatgtctaaagtcagtcacgtggtcctcagaaatgattttagaagtctcagtaaagaaaaattacagagacactcaaatatcctagtgtgatactgctgtaaaacttcttctaattttttgttaagctgtgagaaagggcctatggaaacacctggatgaagcagcaaatcactgtcccaaagtcactaaaaatcatatttcagaaaggaaatatctagcgttaaaacaacatagatgcatttttgaaaacaaattgaattgagaaaaataataatgataacaataatgatctaatcccaggacatgtcacaggaattaatgactgactaaaagctaatggtctaaggtaatgctctcaggaattagtcttgcttattgaactgctattgttttagtaaacgaatgcttaaactgacagaaagtaaaaaatcagggctgccattatggagcctggttgattcaaagtggggcagggggagaagctaaagcaaaaaaaaaaaaaatgcatcatttgatcatttgctgttcttactcaattttttaagttcgtttgtcgttcacaaattatagattctttatcatttttttctttcatgtatctgtatgtacttttacttttgtactttaaggatgtgtttacttatgcattgttttattgacagagaagtaatctgataataaaaatgcaactccctctagtgtaggcatatcaaagatctaacattctgtttgcctagaatcgttttattttaaatactctgatctgaagaaaatgtggatcctcggccgggcgcagtggttcacgcctgtaatcccagcactttgggaggccgaggtgggtggatcacctgaggtcaggagtttgagaccagcctggccaacatggtgaaaccctgtctcctactaaaaatacaaacattggctgggcgtggtggcgggtgcctgtctgtaatcctagctactcaggaggctgaggcacgagaatcgcttgaaccccggaggcagaggttgcagtgagccgagattgcaccgctgcactccagctcgggcaacagagtgagactttgtctcaaaacaaaaaaaacaaaacaaaaaaaaagaagtggatcttccatgtgggctttagaatagtgcctcaaaattatacttcacttagaacttattactcaacatcttatttcaagagtattctaacagctgacttcttgattctacctttccgtattgcctcttccttataaccccaaaacagctaccaaaattatatatctgatcacttcactttcctgcttaaaaacctatgcccattcctagatgttctctgtgcagatcctttgttgtttcattttgtttatttttattataaaatatatttttgaggaaaaaattttaaattggacaaaaagatataaagtgaacaggaaatatcctccgaccactttctctccccctccatcctcactccccatgggtagctaatattaatgcactttttcagaaatgttccactctgcatcagtggaactgaactaaaccagacactttagtacatccttcaataacctttgtcttattgaccgaactatgactcggcacacccttccccagtcaagaatattgttcttctacctctgtgactttgaactctcaacagaaatatccccctttggggtatgagccatataaacagggctagaccaagctctgtgaactaccccctcccccactgacttataatttgatattgcttcaaaccagtatcctttacctttgttttgctcaacttttatttaaatggagaggagattaaaatgattttctcttaataaaaaattaaagaaagagattcacttgtttctatttgccaaagcagaataaatatatttttaatcaacaaaatagtatgcttttctaaaattctagttctgtttttcaatggaaatttgcagtgaaagtttccagatgcttggaagttataaagagttttaaacttaggtaataaaaataaatcacccatttatgataagcagcactctgtgaaagattatttcagaatctcagctgactgacaacttttaggagactgaactgtacttaagtgtggcaaacatgcatcatagagatgggttgtttactgtagcaagttacttgccttcggtccaactgtccttttggcagaagcacaccaatctaattttgcctgttacataaagagccacatgtggaaacctgagtcgcctgacatcatgttactgacttaatccagtcataattcagcgcccagagagcggctggcaggcccacccaccccccactctcactctcgatgtattcatgatagcacagaggttagctggacacacttgggaatcagatatgctaggtcagactcatttccaccacttatcagtagtgcgattttggaccaattgcgtaaccctcctaagcctcagtttctgaatccataaagtagaaatactaacagtggcttcctcataagattgtgcaaagattgaatgagacaatgtgtgcaaagctctcaaagggtggcagtcattattgccggagaccttgattttactttttaaatttttattcaagactctagaataaaattacctccacagatgtccaaagtttggcacagttcagaaaagtctgaaggtaaaaatcatgaaaacagacattgattttcttcatcctttttggtagtatcaacctaatagaaactggaccagggtcctgatccagtctgactttactgcctatgtgaccttccacattacttaaaagttgtgcttttcttgtctataaaaaattaagattatacctcacagcattgattgtaaatattaaattgtgtaagattttacacaagtacaaggtgttattatggttcatcagaatgtaatttttttactttgaaaatctccgtagaactcatctgattcacaaaattccctctaaccaaccccagcacttcatttgctcccacataattgctggagttgtttacacaaatctgtactcagaatcaaagagctcaaggctggagaagtcagggaatctggccctgggcctctgcttgaacattctgggtgctggtcgctagctgacccttaaacaactccatgtcctctttggagttcaaagtttgggggtaaaatcactaccccctctcaaagataaacacaaatggagctccaaggtggtgtccggtgctaacatgagacatgttgagtgtgaatctcatcagagcagtgtttttccaacataataaactgccctttgttcaaatcagaaactgatttcactcgattttcccaaatcggccctgccaggtttccttgatttaattgtatattttttgtc

SEQ ID NO: 323 - DNA, 4726 bp, Homo sapiens
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcaatcttctctactttcattggggagcactatgtccatgtgaacgctacttatgtgaacgtaaaatgtgtcgctccatatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaat

SEQ ID NO: 324 - protein, 1408 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 325 - DNA, 44748 bp, Mus musculus
  misc_feature (1)...(44748): n = A,T,C or G
agttcaaggccaccctggtctagagagctggttccaggacaaccagggctacacagaaaaaccatgtcttgaaaaagaaaaaacaacaacaataacaacaaaaagtggccgggcgtggtggcacacgcctttaatcccagcactcgggaggcagaggcaggcggatttctgagttcaaggccagcctggtctacaaagtgagctccaggacagccagggctatacagagaaaccctgtctggaaaaaccaaacaacaacaacaacatctttttaaggccaagtctgtaggggctggagtgacagctacagtgtactcatatacataaagtaaataaataaatctttaaaaaaaaaaaaaagaccaagccagtaatctcagcacttagaggctgcggtagaaggattaggagtttaatgatagcctcatcttcaaagtgagtttgaggccagctcagtctacaaaacaacaataaaaaaagacaggtctgaggatgctgctcagctggtagagtggttgcctagcaggcacatagctcagggttcagtctcgagcacctagtgaactggctaaggtggcacacagcagttattccatccctggggaggtagctaaggaagaatcagaagttcaaggtcatccttggctacacagcaaactggacagcagcctgggatacatgagattctgtttccaaaactcaaagcaagacaaaacaataacagaaacaccttttccccctcgccataaaactaaatcttaatatatagtcaaggttagacctccaagttgttttaattatttatttgacttatttactatttgtttgtaatgatgcacatgtggaggtcagagaactgtttttggaagttagatctctcctttctataacaggcccctagaccttaacacaactaactccatgatgaacataccattcaggccgtttaactcagcataaagcaccaccaaccaaaatgaaaacaaaggcctaatccatcaaagtccatagtaacaggaaagtctctaaatgtactaaccttgctatttagtttctgaagttctgcttctagctaactgttcttgttaactggagtgtgtcaacccagaacatgctttttgttttgtttggttttttggtttttttttttttttttttttttttttttgagacagggtttctcagtgtagccctggctgtcctggaagtcactctgtagaccaggctggcctcaaactcataaatccacctgcctctgactctcaagtgctagaattaaaggtgtgtgccaccactgcccggctcagaacatgcatttttgtgtttaaaagcttactctgtgaaaggctcagtgctatattgggatcccagacatccagtgtagtagctggcctgctaaggactttctattggcttaaacctatatcagagcaatcttctctggtggataccctataatactttcaccttgtgagttctggggatcaaacccaggttattgggcttcaatggcaagtgctttacctgaggagctatctcaatggcccttttagagacaagctctccatctgtaactcaagctgggcaggaactcatatgtggtccaggttggcaattctccatcacaggctcttaatactggcatgtaggcatgagtcacaatactcagcctgaagcttgtaaagaacaattcattctttcataattgtatacatgtctaacaatcatattactcttactacctcatagcctctcccctgctactgaacgctttctttttaataagccactctcctacaacacctctctccctacccctccctatctctgcctagagatgaaaacctggactggagagatgtgtcagtgaacagctctggctgctcttccagaggacccagattcaatagccagaacccacgtggcagctcacatctgtctgtaactcgagttccagggtttctgacaccttcacacagacatacatacaatcaaaatacaaatgcccataaaataaaaataaatcatatattaaggtttttttttaaacaggtctgtagaaatgcctcagtggttaggagcactagttgctcctacagaggactcagggcttgggttcggttcccagaactcataggtagttcacaaccaacgattactctacttcaaaggggctccaataccctcttctaacccctgtgggtactgtgtactcttgtgcaagcaaaaccctcacatacataaagtaaaataaatacacaatctaaaaagaatgaaaagaaaaaatgattcatttattttatatgcttgagtattttacctgcatgtatgtatgtgcactgcatgcatgtccacagaaaagggcatcagatccccagaactgtaagctaccacatgggtgcagtgagtgaagtgggttttactatatagcccttgatggcctagaactcactttgtagaccaggctggactccaactcacagagatctatggttaagagcatttattgcctattttgatatcagacatggagatgcagagtttggagtttggccatctggttttagccttgctttggtccagtatttcctcactatactcagtttcctcctttttggaatggcaatgtatactggaattgtgtgttggaagtatgttgattttgattttacaggggggtgcagttaatagatcactgagtctcagaagagactttaaactttgcacttttaaacaatattgagactgtgatacctctataggctcacgtgtttgaatgcttagccaccaggaaatggatctgtttgagagggttatgagttgtggccttgttaaaagaggtatatcactgggagggtgggctacgaggtttcaaacctccaagccaggcatagtctccctctctgcctttggatcaggatgtggctctgtactccttctccagcacctccagcaccacacctgcaatgcctgccaccatgctcctaccatgataatgatgaactaagcctctgaaactgtaagccagcatcaatcaaatgcttccctttataagaactgtggtcatggtttctcttcacagcaatagaacagagactaagagagaggtccagatgtgagggctgctgctagctcaaggtccgtctgagctacatgatgagatcgcctcaaaaagaaaaaaggagaacaaaaacatctttttaaatggtaaaattgatgtaactgctagtatcttgtcttcgcttttgcatttcaaaatgttaatatgttttaatttagataggggcccatcaaatgtaagacaagccttcctgctattggctataccagggtcaacttacagtgaaggtcactaggattcgaagttcaacagggaaaagaaagatacccacattccaagacagcaagctcatcacacaatgtttctaccacccaactttttatttctattttatcttttaagacagcatcttgttgtacagcttagattggcctggaactcttggtgacccttttgccttgtcctcttaagggctggaattatagatgtgagccactccaactgtctaggtcatactcatcatctcacagagtaggtttacctgacatttgttttttataaattttgtttatatttaacacttgaataccatgactgagttgtgcttgccaagctagtacctagctatgctactaacgacgagtaaataccaagagagctttaaatgttaggggctgctttctttttcagtgtaacattaaagatgtacatggtagggctggagagaagactcagtggttatggttacaaccatccctaactccagttcaaggagatctgatgccttcttctggcctccacgggcactaaacacaaaagtggtacacatttatatgcaggcaaaacactcagacataaaataaaatgaataaatctaacaatttcttttttaaaaaactatgacccaggtgtggtggcacacgccttcgatcttttgggaggcaaaagaggtaggcagatctctgagttcaaggtcagcctggcctaacaaagtaaagtctaggatggccagggttacttacacagagaagccctgtcttgaaaaaaaaaaactgtggctctgatgagctgcactcaatgggcccatcaacaatctatcatggagcacaggggtgcttatgaggccacactggtctctgggaatatatatgtagctaatggttgctgggggaggaaagtacaatttttcagtagtgtaaaacttgtaagctgcccatagtcatgtgaacaatcccttacatatgatcctgtaagtaaccttatctaaactgaccgggttccccacccccttctctctttcctatgccatgaatgtatcatgtattaaaaatagaaaagaagcctgtgagatggctcagctggtaagaacttgccaccaagcctgatgatccaaagattcccaggacccacatggtggaaagggagaagcagttccccccacccaatgtcttctgaccctccacacatctgccacagggtgtatgcatgtgtccatgtacacacacacacacacacacacacacacacacacacacaacaaacacttgtgtgaaaaaagaaaagaaagagagaaagggaggaaggaagggaggaaggagggagggagggagggagggagggaaggaaggaaggaaggaaggaaggaaggaaggaaggaaggaaggaaggaaggaaggaaggaaggaagggaaaaaaggttttagctgtttattaagttggagttagccataaaaacatttttggctcctctacagcaacagaaagatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaatgcttacagtctctgtattcaggaaatggagcaaggaggatcagagctccaggtgatcttttgccaaaaagcaagttcaagactgtatgaggctatatgaaactgttttgtttttaaagagggtgagggtttttaaagaaaatagagaaagaaagtgtgatgggaatgggtagtttacttgcatagtgtgaatgaagccctggttttaatctccagcactgtataaagtgggaattgtgacacaggcctgtaaccacagcaggaggatggcaagttcaaggctttcctcagctacatggacaatttgaggctaatcaggactgcatgagactctgtctccaaaaatcagatagaaggaaggaaggagcagaaaggaaaggaagggaattaatacagtatggtagctcatacctgtatcctagcctttaggactggagaatttgaggttacatggctcagtatgtagccattcatttacttgtttgtttgtttgtttattaaatagggttcctttagcctatgctggcctggaattaatatagttgaactcccggtcctcttgtttcaatttcccaagattacagatatgaatcacaatgcctactttttagatttttaaaaattaatattttattagtatgtttttatggcttagcatggttagcatatttaataggctccattgtgacattttcatacatgtatagtacttttcccccattttaatgattggagccagggctgaggtgtagctcatttggcaaagtgcttatctagcatgtacaaagccctcatgtaaatctccaacagcacatacactgggtatagtagcacagagagtaaaaggaggagaatcaggagttcaaggccatttctgagctatgtagcagactggaagccagacaagcaatatgagaacctttgtcaacataaataaggagctgggcctggtgagacaggcctgcaatctcagctgtctgggggctgaagcagttttactgaaggttcaatcaaggcttgagtagggtaataagaagttcaaggacaaccacctggtgacttaatgagaccctgtttcaatttaaaggaaatattgttaaagggctaggaatgaaggtatagctctgtagcagaatgcctgttgagtaaatgcaagactctaaattcaatcctcagtggacaaaggaagggaagaatacagtgtgcggataatgtttgaaatacaagtattcaggagtcagaagtaggcaggctgcctcaagttcaaagccagtctgttttatgtagcaagttccagaccagccaggtctgcttagcaaaactctttctgtctaaagagccaaatattaaagatggtggtgacagtaatgctaggagagaggagggaggaagagtcacgttgaatggcttcatttctaatgaaatatctaaatatatgattcaaatgtcactttataccttcaagtgatacttggctataaaaatgtgactgttatttgttaaattttatttgacggcagtcctatcaagagacaccaaacacttcatgaccaaagaattcttcaaaacaagtgagagataagctctcttttagggtgtaatggtcttcagggagatggatcagaattctgttgagttgacttcaatgggcagaaaaagagaaactttcacaaaatgttgagcaaatcacaaggactgtgaagcaaaacatgctgagtataaacctattctggtactaactcatttctgtggctctattattagagaatacatagcatttatttatgtatactttgtcacaggatataagaaaggaaaaacagaggacattgtatcatcaacaataacagttgcaacatctcaaccaattatgatgtatcaggaatcatattaacactttctatgaatctactatctgatcttactcttataaccctatgttcagaagttcccatgacctcacctacagctaacacaagcacagcacacatttaccaatgcttgaaaacacaccaagctgggattgtagtttagttagtcgagcacttaccacatggatgtgaaaccctgggttcgatccccagcgctacagtactgggacatgagcatccatgcccttgtaatcctaacactagggaggatgcagcctcccttggctacagagtaagcttgattccatcctgggctacatggaactctgtctcaaaaaacaaaaactaagaagcaacataaacaccccacacacaccaagttcttagtaacccctttcatagttatatggcatatgagtaagctttcaatcaggtcctctccctaattctctgaaataactgcaactcgcacaaacactgcatattgggaccagtttatttcatgtctagcatcttcctggacccacaagcattttatctgtgatccactactataatggggctaatttcagagatgagctggagctttctgtttccaatgtttgagtagctcacaaagtctcttaagcatacccaggcccaaagtctgttgtcttaaaaacaaattcctctagagggcagttctgataaactccttggtcaagctaactgtaccttgggagagttaattatcaaaacagatgggcactgagtctcagggaggtaaaaatagataatagataaatggatagatggatggatggatggatggatggatggatggatggatggacagaagaacagaaagatagactggatagatagatagacagatagatagatagatagatagatagatagatagatagatagacagacagacagacaatttttaagaaacatcttgaccattcaacactgccctagagtctccctgtatctatctagtatgcattctctcctttctcactttgtaacaacttgaacaaggctttttccccctaagaagcttgatgattgtccttttattgctgtgatccattcaatatccaaaattgacttggagaagaaagggtttgtgtggcttacatgtcccagtcccaggtgatcattgagggatctattcctgcacaaacatgaccaagaagcagttggggaggaaagggtttattcagcttacatttccacattgctgttcatcactgaaagaagtcacgactggacctcaagcaggacagggagcaggagcagatgcagatgcagaggccatggagggatgttacttactggcttgcttcccctggcttactcagcctgttctcttatagaaccaagactaccagcccagagatggcaccacccataaggggacctccccccttgatcactaattgagaaaatgctttgcagctgggtctcatggaagcatttccccaactgaagctcctttctctgtgatagctccagcctgtgtcaagttgacacaaaattagccagtacagatgccatagcagtaactcaagcaggagcagaggcaggaactgtggggaaaacgcttctcactgatttgcttctatgctcagatgctgtcccttgcttatccctcccagtaccatctgcccaggggtaataccacccacagtgggctgggccatcccacgtcagtcaacaaacaaaacatgtcatggacatgcctacagggatcagtgggatggaggcacctctcagttgaggttccctcctcccaagtgactctggttttgtattaaagtcacaaacaactgaccaatcagcacaatggctcatatttcatggaggggaaagcaacatttaggtcataactctcaaatctcccattatcaaattatacatttaccttcatctagacccattgtttatagagttcctccagttgaagtgagggtatccctcatttgtatactagaccaaacatcttatgttctggattatatatatatatatataatgtatgtgtatacacacacacacacatatacatatacatatatacatatttttttcttgttttcaccacttcatctactgggctccagccacaccattttgccattctcccttttcttctctgttcttctttgcatttctttcttgtcccctcccactaagacctggaactcatgatcctcctgtctcagtctctcaagtgctggattacagtggctttgccttgtctgtcctggaactcgctctatataccagtctggcttctaacccacagagatccagcctgtctctgcacacctccagtcgcagcacttgggaggcagaggcaggtgaacttttaagtttgaggccagcctgatctgcaatgtgagttccaggacagctagtcctacacagggaatccttgtcttgaaaacaactttttaaaagtcccccccccccctttttagtagaatcgtctcaacgccatatattttgaccaatcctttttccagcgactagtaatgccattcccattttaaaccaaattcccttcagtttgttttcaggtcggcctaacaatctttattttcctccaactggggatgcttttctccgcgcttctttctgggctgcctttcccttgctcttcggttcgctgctccgcagacatctctctcatatctccattgtctctaggccctttgcgctcctcgactctgaagggcctgtagaacccagggccgctagaatctcgccgttgctaggctgttgctagggcggttgcggtggagacttctgagaggaccaacattcggcgtcctagtgacggataaagttggcgccagcgtcgccaggggggtgcgtcactaacacgggcgattgggggcggggccaggcggagtcacgtggtttggttgcctacgcgctgctgggccgtgggaagatggcggacggaaagggagacgccacggccgccgccggggccggggccggggctgaggctccggcggtggcgggagccgaagtcgagactgagtccatggctcggggtcatcgccctgcatctccggcgtcgggagcgccgggcctacgaccgtgtctctggcagctggagaccgagctgagggagcaggaggtgtccgaggtctcatctttgagctactgccggagcttctgccaggtgaggggtggactagatggccgagggtggaggggcggggaggccgggagaagagactcgggatccgcctcaacagccgggggcttcgcgggggaaaaacgccacccccgtatctcgccgcgcccccgggccgggcaggcccagctctgccgtaacccgacttcagtcactgcccgggcggattgcgctgggcggtcctgagcccagagagctccctgcaagggctgtgccctgtcgctgttgcctgggtcctggccgggtggttggagcgccactgcccccctgagggatcgattgccagttcctgcagggagatgcttttttttttgagtggtgtgctgatctccaaactgaaaaaccttgtttttctgaacaatcaggagaggtgggctctgaccagagacttatctttaaagtcacatcttttggcttccctaagatacgacggttggtcttggatggcgtctggagctttctgattagggaatactgagccggttgattggtttttgtggggtgtttgtttgtttgtttgtttttgccactgtgggcgggtgtgaaaagatatgtttatgccattctttgacctgttttgtattcatctgctggttgtactactaggaatggagcctggtagctctgtaatggagattagtctgagtggaagaggtcgggagagagatatagagaatggcctctttggcagtcgggtgattgatcgtttctgtgcgggtcccaatctgtggggctacatgctgacagatgtgattttaagtttggtctccgtgaccacgttgcagttttttttctatgttttcgagtgtcttccaagtgtaaatgcttgccgtcattgtttctgcatctggtacttagactatcaggtttctgccatccctttgctcctcatttggagtaccttagagaatagaaaataatcgaggtatgttggtacgtggactcttaatgagcaattgagtgctgaaaagattgtggagttagaaagttgtagttggagtagtgagcaatctgctttgttggtcctgggcagaattagttgtctctgttgagttcatttgtatcccactctttgacccagaacttcgtctatttggaatttttctctgctaatattttctatacattagatcatgtcagttcttgtgtgcacaatcgtcagcattctcattattgtctactaataatgatcactcttatttagggcaggcatgtattccacagattttttccaacccttagaatggtgccaggaagacttatggaagttgaagggcgtcttgggcattataatggactcccaggctaggcttacagtgtgatattcctctctcaaatagacatttcataccaccccccaaaaagaaatgacagaattaattagtgcagttttggtagtgatgagaaaaaaatgtcacgcagagggtgtaaggagacttcatgggacagcctagtgagaatgacagaaaaaaaatggatgtaatgtgtgttgagaactgggagaagccactttgggtagggtagagcctcagacttacaggatataattgaatcctaggagggcctggagcaagagtgacagaggtagagatgagagggaacacagaatgctgtgggacaggagggaagtaattgcagggagagtggaagtaggaaaacaactgtggattttgaacagagctttgaagtttacattatctgccagcaaaacattaaagggtgactgtagccagtcagatcggattgtcagaatatactgtacagaagtagtgtgggaaaattggaccattaattagactagttgaatagttttcttggttccctctttcccccctctgtgtatccttggatgcccaggaactaactctttagaccaagctcaccttaaacctccgcctgcctctgctctagagaactgagattagatatgtgtcaccggtgcctgacattggttccacattggaaaggcagaatacaaaatcttttattgtatgactgaatcagaagatgaaaagctgggagcacataatacataaagattggtggctggtagtgcattaaagaaaagggctgactgtgctcctccagtggtcactgttatagattgttctcaacaggtattcagaaatatcatcctagcctgagtgtggtgggacatactttaatctcagcattcttgagacagaggtggggcaagtgggcctctgagtttaaggccagcttggtctatgtggtaagttccaagccatccaggtctatacagtaagaccttatctcaaagaaaagagaagaaatgttataaaaacttaaattgtacctactgttataacatttcttatatgctgttatcatataagaaatatgtctatctcaagccagcctttaatctcaggaggcagacaggggaatctctgtgagttccagaacatcctggtctacctagtgtgcgttcaggacagctagaaatacatagtgagaccctctctttaaaaaaaaaaaaaaaaaggaggagtcgggcgtggtgtcgcacacctttaatcccagcactcaggaggcagaggcaggcggatttctgagttcgaggccagcctggcctacaaagttgagttccaggacagccagggctatacagagaaaccctatctcgggggnnnnnnnnnnnnnnnnnnnntaaaagcctaatgaatgtggtgtctcatctgtaattccaactccagggaagcagagacaagagttcccctgaggaaactggctggccagaccatgtgaaaataggaactctttgttttgttttgttttgtttaagatttatttatttttatgtgcccttgatgtttttcctgcatgtgtatatgtctgtgcaagcatgccagatcccctggaactggagtcatagacatttgtgagctgtcatgtaggctgagaattgaaccgagttcagctcttctggaagagaacagccagtgctcttaactgctgagctgcctttccagcccaggaattctgggtacagggatgctcatcagagaccctgtcttggtttaaggtgaagagcaaacaaggaagatatgccagcctccaacttccatttggagtaagagaaccaattccaaaaagttgtcctttgacctccacgataccactgtttttaaaagtaacttaaaaaaaaaaaaaagattaatgctgcactttttgttaatgttgaaaaatcgtcttgaaattttttgctatatttaggaaacacattctcagtctgggtggacagggtgactcagtggatacaaatgcttgctgctgagcctcatgacctgagactgactccagggacccacatgctgtcctctgacctccacatgcacactctagcgtgctgctcaatggatgaatgaaagaattgtaaaaaacattttgaaagtcttagaactgttaactttgtttgtagcacaggttttgaagactttttaaaaaagatttgtttattttatgtatatgagtacactgtagctgcacagttgttgtgagccttcatgtggttgttgggaattgaatttttaggacctctgctcgctctggtcaaccccactcactccagtcggccctgctttctccggtcagccccccttgctcagtccctgcttgctctggcccaaagatttatttattattatacataagtacaacgtagctgttttcagatgcaccagaagagggtgtcagatctcattatgggttgttgtgaaccaccacgtggttgctgggaattgaactcaggacctttggaaaagcagtcagtgctcttaaccactgaaccatctcgccagcccttgaaggctttgtaattgaatttcatttagcatacaagaaattagttgggaggtgattatactggaaggataaaagagttaccaaacaagtaatttaatgagtaaatatattacatacttttaaattctagacttacagtaacattgcagatagcttttgtttgcttgtttgtttctgttttgttttgttttgtttttgagatggggtctggctgtgtagccttggctggcctcaaattggctactagaccaggccgtcctggaactcatatgcctgcttctgcttcacaagtgctagaaataaaggcttgtatcaccatgtccagctcaacttcgtagatttttaatagttaaaataagtactgcacataccttttttgggttggttattgaataaaggggttctgagtcaaataggccatataataagctctctatgggcagggtatacattccaagactgtcccagacaggtgtataaaatgaatctctttacaaactgttgttccatgtcctctattccccacctcacccccacatttactcatgggacaggcaagatggctcagtaaaatcgattgctgcaaagcttgataacctaagctcagtccctagaacccatagtaagagagaacaactccccaaagcaattctttgacctccagcaaattcaccttcacatgtgcctcctacctcagctcccacggatatggatggatggatggatggacggacggacggacagacgaactggcttttttttttttttttttgtaaatcacagtgacatcacagaacagaacattcacaacgaccagtatgcagtactgaaggttgtatgaatgttgtttctttctcaagatgtcttagtttgtatctttcctgtgatgatgtgagatgacaaagtgcctgagagatgaaataaattgaaagatggcttcttatggtctgcttactagctttaagcttttgtaaaaggattatttgagcacaagctctaataatggaactggcttctcagtaactaacattgtagcgtaccttagctatttgggtatcttatagggatatttatgtctctcgtgggacagagatggatggtccaagatttcatcacactgtttaaatcagtgtgtcatttaaaagttaatacagtattatttgggcacttttccacctgatatttttgactaaccaaaaaagtggagagggctgatgttctgacttcatttaaattagctcgatggacttggacttggtttggttctttttttccattactcaatagcattttgaatggaactagttagtatatttattatattctaagtaaatacattgtgaagactaagatggtctttaaaaaaaaaaaaaaaaaaaaaccaaccttggggtgtgtgagttgccggggtttagctttgaaggaaaacagcttacagcctcagctccagcttggtttttagctctcagcagcaatcatgtcattactagtccctgtattcaggtgggttggtgtgttttcaagtcagggtttgtagccctaggaaatcccccctgcctctgccttctgagtgctgggattaaaggtgtgcgccaccacccacctacctcaagtgggtttttgaaggtgtctgatgctggttttggtggctcacacttgaatcccggaacttgggaggtggaggctagggaatcaggagtcagcctgggctatattaaaccttctcaaacaaataaaccaaactgaaaagggtctggggatgtcaatcagttggtagaatgcctgcctgctaaacaggaagtcctgtgcatgggcttggtggtgtacaccattagttactaactaactaatactcaggaagtggaggcgggaagctaaacgttttaaatttggcggtaggatgtttaaacattcttagaaagcctgaagcactgatttgattcaataccagaatccactaaattgggtgtggtgtactcaggatcagaagttcaaaatcagcctcagatataaaatctgttagaggccagcctgggctacaggagaacctgtctcaaacaacagaacaaaacctatataagaatgtgtcacacatcattgcagggctgacttttaaaggcagggtcactatttatacacctatatataccaagtataggactctgtatatagcagcctggtctttaacttgtgatcattctcccctactctacaaatggtaggattgcaagtgtgggctaatgcaggaagttacttttaagctgtgtcctcagtgcttagcaagtgtttaccactgaccccttcctcttgtttttgtttgacactttgtatgtagtgtcatctgttctttttcttgctgtctgtgttttagttggcttcctcctatttgtagccttattttcacaaaattctagctttctgattgcatttatctatggttgagattttaaaattccctgtagagtgtatctgttatcctccccatccccacccaacactctcactgtgtaggccaggctagccacacttatctttgcctgctgagtgttccaccacagcttcaccagtagtccccttgcttcaccctccagtgttttaggattattggcatgaatcactgcacccagctttctttctgtgctttatatttaataggtagtacaatgttgacatataaatgatatttttaaaagatttgttctagtgtgtgttcatgttcttgaatgcatgtgaatgtctgaggccagaagatggtgttagatacgatatatatatatacacacacatgtacagacatacatacatagtcctggaactcagaaatccgcctgcctctgcctcccaagtgctgggattaaaagcgagggccaccacgcccggcagcaaactgttaggctgtcttctcctgaatctgccacccacctcaagtaattagttgaatgagctgtagtgctgtagtgtaggaactgtgtggtatttggaagaggcaagaactttaaaagaacgaggtaggagtcttaccacgttctgagggacattatcagctttagcatgtgttttatatcatgtacctatttcactgtacacattatggtgttagtaaggctaggcagataatatgaaaagcattttagcattgtgtaatgttgcaggatatttgatcacactgaactctgagattgttattcactggggaaaaaatgttttagttgtggtgtggctcagccttagcacacacctttaatccaagggctttttgcttgaatattgtaaacaggattaaataaagtcaagataaggtcaagaggcagagcaagcaaccagttgacaggaagaaaacataggagtcttaagaaaaaaacatagagagtaagagggagtcaggaggacagttacagagatgcccaggaagcagaggggagggacattgagtttgaaggagattatttgacactgtgtgagagaggggattcctggtgggatgttgtctgaagaggaaggtcagctgggtgctttctgtgcctctctttcactccagcatctggctctctagtcttcattggtaaaatggaccaatcgagattttgttttaaaacaaaaaagtagaagagttgagttagcaagtgaataggacagcagtgcagagatgctgagatgggaaagagcatggtaaccatggagattcttgagctttatgttttcttcattttttttaaatttactgtgcattttattttatgcatattggtgtctcacctttatgtgtgtctgtgtcactgtgttggatccctgcaactggggttacctgtgagcttgcatgtgggtgctggggattgaacctgggtctcttctggatgagcagccagtgctcttaaccactgagccatctctccagccctgagcttaatattttcaatatattgaaaatattaattaattaatcaatcaattaattaaaaagtcaggctgaatatgtaagtagaacaaaagttgtctagcatgccatagggtcctggttctatcctcagcacacagacatacttgaaaacttgattattgtccatgttttcattttgtatgatgtgtacatatctgagtataagtgtgctcttgtgtgtggaggtcaggatgctttcagagttagctctcctctcacagtgagctctgggaattgaactcaggttgtcaggcttatgtggcaggtgcttttgcttggcctgcaaacaagtaatttcaaacacattagcttttcttctgctgctgctttctcttgggagatatctggatagaaattacatggtaagttgttctctaagcagaagcaagcttagtggcctgtgtaatccaagcattgtatgaagtgacccttggagcagtgaaactttgcttgcagtgtctgctgtgggaccattggttcttctgctgttctctgagaccactactgtcgtttcattccatgcatcccactatgtggtcattgttaattacaagtaaataggaagcaccactaacagtaagactgtgaagactgccaaaacttaggtgctttgtttcattcagaccaaatgtctgtcacctcttccagagaccttccttaacttccaaagaccttccttacctatctttggttttgatggggcaggtctcactatgtagctcaggataacttccaacttaaatcctaaactgtcccagtgcgagatgcacaggtgtaagccagcaccttcagccctggctatcttatctcaaatagcacttccttgttatcttcgggtcactgcctgtctgacctgactcctcagctagaatggaagtgtccagaaggtgttgacttcagagtagttcctagcactttatgggaatgcagtaaatatgatagttgctggtttatcaggttatcagacttagtgataggtgtccccattcacagaaccatttcacaagccatcatcttgtttgtttttgtttgaggagagtctcgatgtaagacacattggccttgggctggtgagatggctcagtgggtaagagtacccgactgctcttccgaaggtccagagttcaaatcccagcaaccacatggtggctcacaaccatccgtaacaagatctgactccctcttctggtgtgtctgaagacagctacagtgtacttacatataataataaataaatcttaaaaaaaaaaagacacattggcctggaactcttcaagtagctggtgctggccttagcattatgatcctcctgtttctacctcctgagtgctgggcttgccacatttgatagcactataatttaatagtctatgttgttttttagtggtttctatcagtatttcggagaaccctattaaatatgattatttatttctgcaacatgaattcctagattaaaaagaatgttaatgggagctggagagatgtcacagtggttaaaaagcactgactgttggctcttccagagaatctgagttcagttcccagtacatgatgaatctcaccatctgtagctccaagggatgtgatgccctcttctgatcctcatgggcgcgcgtgtgcgcacgcacacacacacacacacacagagtgcacagatatatttggaggcaaaacacctatatacataaaacaataaataaattactttttaaatgtaggtagatattagtctaccaataagttgaacatatttgtccaccagtcatgcttgtgaatccttattccataaatatccttgccaatttggtgctgtgaaacttaatagtttctatgttaaaaacatgttctcatcttgtaaattcaaactgaagtagtatttctatgtaaattgtatatttaaatattcttttaaaataccttattcatgtaatgttttgatcatattcatcaccccaaaattcctcccaaatctcacacacccagtgtcttaagtcagggttttactgctgtgaacagacaccatgaccaaggcaagtcttataaaaacaacatttaattggggctggcttacaagttcagaggttcagtccattatcatcaaggtgggagcatggcagtatccaggcaggcatggcgcaggcagagctgagagttctacatcttcatccaaaggctgctagtggaagacttgacttccaggcaactggggtgagagtcttaagcccacacccacagtggcacacctactccaaccaggccacacctccagatggtgccactccctggtccaagaatatacaaaccatcacacccagctttgtgcctttcccccccccccccccatacagtccagttgtgctgcctagatactcttgggtaggcatgatctttctaccaagtgtcgcaccctacttccaggattctcttccaatagctatcagttgccactagcccgtcaattagggacagtgcttggtgcctccttccctcctccatgctgaaattttgtctgatttgagcttgtctaggtctttatgtatgtcctcacatgtgcagctgcccttgtttttctgatttttcccttctatcatccaccacctttggctcctgtcccctcaatctttctgtttccctttcttcaatgatccctgagtcttttgcagggagagatgtaatataggtgcctcttttagggcttagcacgcccaaatctcttactctctgaatgttgaccacttatgggattcctgtgttggtcactatttacttcaagaagcttctcataagagggttgggagatggatatagcaatgagttagtagtttaactgtgtctatttatcagtttaatagtaataggtctctcctagggcctatgacatatctaaccacgggttcttgatcccaataacagtgccaggtgtgcgtttcatcttgtgagttggtccttaagtccaattcgagtgtgtttagttactcctataaaatgtgtaccactatttccccagtaagcattattgcagctcttgagttcacagctgggtgagtgataactgttcttcactggcagtcgacatctagcatcttccagcactatgaaagcaaaccagcagggtgaagtgtccagttgagtaacagcttgatttctctgagtagagtcttactgtcaaattctgaagggtatgcaagagcaatggtggtagcctgaaatgtttgaggttctatagggccccgtttgtcaacaactccaaaagaggtaactaatccctggtatccgtttttttatttgctaacctgtggtatctagtagggcttttaagttggtgccatttgaactctatgtatatgaaatatatacatatacatttcagtaagcttctatagtagatgtccgtatgacttttccagaaggcctttactttaggctttccacattcttgatagcaatattatagcagtcagctaccacgtctgtgcaggctagacaagcaagccctctctgccagttcacctgcatccccagcccccagggatgagatttttaaagatgttatttaacagtaagtgttaatattatatttgtgcccctgatgagttatcatttatccctctagagtaaatgcctatcccaatggaagcctcactactaatttaactaagattgcttgtttacatgagttgtgcttactcttttaatttggcttttctttgaagtgaaatcttgatgtctactttaaaggacttgtaaatgcaaatgttaatttagagcacatttccccataaccagctagcagtgtggagaaaatgtcatgcttggaaagggctagtcattgtgagctagagagcacacatatatacctctgactaggagtttgcactaatttcattccaattcctgttgaccttcaatcattctacagatctgtattgttgtctagagatagctgctgatatgggtggtggggcagagcaattggaaacagagatcattgcccttattactattgctttggataaaagataagtacccagcatgttaaatttctttcaaagaaaaaagatgtttaagcaggattctgctgtgtagctcaggctgtcctagaacttgttactctcttctgtctccacattttaaggttatgataaacatatatactgttatgcttggctcaaaaaggtttttgtttgttcgatgttaggcaagctctctacaaatcatgtccctagcttcccataaatgtgtatgtgttatgcttgtaatggatataataaattctaccttttgcaatcaatagattggtctctattcaaaaggccgccttttattcctgatagatactggcatggttacttcagctatccctactctagtggtagctcactgaagctccacatttgcatttcccctttgagtcacgtttcatatttttcttttggggcttatttttgcaatctgtatctggtccagggctcagttgtttgccattttagaagattaggagttttttttttttttcatactattgagatttgagacaagtaagtctgtgtgtttctagtctctttgttagttgtgcttgcaaagattttcttctccttttgcttctttaacagttaattcaaagaacatagagtcttaattttgtttaacttcaatttttccacttttcctttgagttgtattttaatcatctgtctaaaaaagttctctctccttaagaacataaattaactttctgtgattcccctccagagattttacagttcaaggtttttaaattcaggtatatgatccatttgaattaatttttatatttaatgtgaggcataagtggacattacttttgtaagaattgagtttctgattaaacactttgttgaaacatccctctctgggttgtgccgtgagagtcagtggtgtttagggctgcatgtctgggttctgtctcctgtctgtctgctttgccgccagtaacactttcattttgctcttctcaaacagtctgttatggaagtgatattgcacatagaagcaggaaaaccagcacttgccaaggaatatggagactacggagggttttgtttttgtttttctagacaggatttctctgtgtagatcagtctggtttctgttgcacagagatgtgcctctgcctcttgagagatgggattaaaaatgtgcatcactatgcccagcctggaggggttttgttttatttgattttttttaaataaatgttcaatattcccagttctgtgggtattagtgactagcaaagtaatgtggatatacttgccactatagagctatagagctataggcatgagctttgtacagatgattgttaggccacatatttcactccaattttgaaaaggttatacagtatttagcacaaaatgagtattcagtcaacttttaattgcttgatagaggcccagggttcaatcctcatcactaccagacaaaccaaaagaatcctagagggctgtcttggctggagagatggctcactggttaagatggggtacagctcagctttcagacagccaaaaagcatgtctttctctcttacagctagggttattatgcttttatcatatgtggtaaatctcaaatttaaaaatatccacttttgttgctaggattgtaacttaattggctgagtacttgctgatcatgcaggaagccttgagttctgttcccagaatccattaacctggctgggtggctggcacaagtctgtaatcccaacacttggaaggtggaaggaagatcattgattgctgaagccagtgggaggtatgagaggcccagtctaaaaaagaaaagaaaaagaaaaacacatgtcagcaattagcaaatattgtagatgagtctctttagtaatactaactcgctaaaggaaaacgggacagttagttacttgtatgtgtctccctctctagagccttcctgttgcacattcaagttcctctaagatcttgaggctcatagttgattttcaattatttaaccttttcttttaggtttttttttttttttttttatgtgtatgagtgttttgtctgctgaatgtatgtgtgtgtactatgtgtttggtggcttcaggggtcagaaaaaagcattattagaactggagttacagatgcttgtgagtttggggaactgaacccaggcctctacaatagccagaagtgctcttaaccgctgagccgtccgtctcaccagccccttatcaaactcttaaaaagatgtggctgttttggtttggtttggtttggtttggtttggtttggtttttttatgtatatgaagatttgcctgcaggcatgtatgtgcaccatgtatgtatgtgtgcctgatacctctggaagagcaagtgctcttaaccacagagccatctctccagctctggcccccagttcttgagctcaagctatcttttctgttttaccttcctctagaagttgcatcttcccacctgcatccagttaattacagcagtacattcatttacactttggtataacagaactttttcatctttcccaaatgaaactgctcattaaacacttaattccctattttattctttcctttcctctttctatgaatttgacccctctaatatgtacctttctttctttctttctttctttctttctttctttctttctttctttctttctttctttttctttcctgttctagaatttactacataaaccaggtgctgggattaaagaggtgtgccatcaagccttgcttttttttttctcacccattttttttttaatgtatgagtgtgtgtacatgaggatatgagtgccacagcattacatgtgtgtgaaggcacaacaacttgtgggagcctcttctctccttctaccatatgaatcctaaggcttgaactcaggtctccaaggtttatcaacaactggtggctctgagctacatcagctgccctcagcttcatccttttacatgtacatatcttgtttcttaggattggttaatgaaaaatttgtctttttcttactgaatggtcttgttatagtttttgaaaattactacaccgtgtatataaggattttatttataggttatctgttggattccattggtctctgtcttttagtgattactcacaattgaaaatgtaaaaaacaattcaggcacagggtggtgaaaaggttgttagctggtttggtggcacaagcctataatctcatcacttcagaggcagaggtagtaagatcaggaattcagggaactgaggccagcccaggctacaccaaaatctgcctcaaaaacacataacaaataaaatgaaaggattgtaaactgaataagcaagattctgcatttctccgtcaagctgatactttatccatgcaaaaatcacacctcttacctctaagggaataagataatttgttctggagtgacagtggtctaggaacatggattcagcccactcccaatacggagttccattgtagtagacgtggttggttatgtgagatttttattagttttagaacaaagaaagacaattatcaaatgtgttgctgaggaccacaggttccaacaaagtaggggtggggtggggtgaattgttacaggtattatgctgtttgacttcttagttcttgtgctggaagctagtggtttgccaagaatgcattttaaagtctttgatagtcacagggatgtaggtcagacagacattggggagggcaatgaataccttttaaagggacaagaaataacccaaggcaatttggctctgttctgcagcattttacctttcatagtcacaaagttttggcatttgaccttgtagaatttttaacacaggttaagttcccccaacttcatatgctgtctaacgtgtctaatgtgatagctcttcagtatgtcactgtcttatactaataataggattgtaaattaggattgattttctttctttcttcctttcttttctggagcagaatccagtatcatgtaaagccttagaggttatggagccagaaattgtatttatagtccattctaagaaagtagtcatggggccactaaagcagatagttccaaacctgtggtcactaaatgaaacaagaagatataaatgtggggagagaagtcctgacagtggtaggagataggagtcaaggtgaagagtacctggtatgtaatgtatgaaactgtcaaagaacaagtcaataagagtgtcatgaatgtaagtaatattttacacataggggaacctatctttattttccaccgcaaagagatcagggcaggatgtggtagtagacacctataattccagcatttaggagactgaagcaggagaattgtgaattcgaggctgacctgggctacattgtgagctttagggtcagccttgattacacggtaagactctgcctcaaaagttagaaactatgatgtgcatgaatctacagtgtggctggggatataactccgtggaagaggacttgcccaacatactggactgagggggtcacacagcaaaagtaaaatgaagtcaaagaaagctcttcagtaaatgtagagacataacatcaccataaaataaaatgtttcactttacacattaaggaaattctcaaacttgcctgttaacagtgatctgtttctgggtggtgtttttatgcataatggaaaatagcacatatttaaagatacactactgttatggcaaaagcaagaagcattttaaaattaaaaatgaaatgaagctagaaagtatatttatgacctatgacaggatcagtatctaaaatagtctgtggagatgggatggtggactggacccagtgaaatgtaatcagggtggacgaagaaatgtagagcgatggactgtgagtaggccagatttctgagctcagagcagctggaagtaatgtgtagcggctgtgttagtacagaagcagcccaggtcccagattgcctctaggtacttcctcagttcaagcagccagctgttttcttctcactcattaatgtcaaccccctcggtcctcattgctaactgatgtttaaatcttagttctcatcatctttggagtcctcccatctccttacttttgcattttaaaatgttaacccctgtttcagggatgagattcaattgctgactcccgcggaagcttgccctttacaatataatcacattgctcagatttagaactttattttcaaaataggatttctctgtgaggccctggctatcctgggacttgctctgtagaccagaccagccttgaactcaaatgatctgcctgcttcaacctaccaagcgctgggattaaactctccacctcttagctagatttagaattttatgtatttcatttgttgagaaattaaaatcagaataagatttcttgtgttatgtgcagattttaaaataatgcacacacttatctttaaaaaaaaatccagttaccctacgatgttcatttgtaatgaacaactgacacttgtagttgttttagttgggtcgttgttgctgttgctgttgctttgggggtgcaggttcttctgtagctggatgaggatgacactgaacttctcatctgtcactgactctcaagggttgggatgacaggtctgcaaaccatggccatcttttggtactaggatcaaacccagaacagtgagcaggcgagacagttctacctaaactgagccacttccctgacatgaccacaggattgcaaagtagtgggtgtcacttagcactattgccagaaaacttcccagaagcagtgactttcgaatgggaggtggatgtggtaaactctgaggaagtaggccaaatgatgaccacactgcagaggctgcagacactaaaggtagtggagtcggaagtaaaggcagagtttggaaataagcatatttattaaagcgatagtaggtttgtgagttctgagtagacatacagaatagtgataaaacatgggtattggaggcaggtgactagttcagattaaagcgtaaaatctgtccgtccccccccccccctttggctcttcaagggggtttctcagtgtaaccatctcttgctgtcctggacttactttgtagaccaggctagactcgaattcacagagatccacctgcctctgcctactgagtgctgggatcaaaggtttgcactaccacacccagcttctgctttcttatttaaaaaatgaagtaaaggtcggggatatagatcagcggaggatggaaatgacaaggaagtctctctgtgtctcttttaaatcagctgaagggttggatgtggctcagtttgtacagtgcttacctactgtatatgaagctctgagtttggacccctacccagtagctcataaaacagttctatagtcccagtctttagaaagtggatcagaaattcaaagtcattcgtgcctaaatgggaagcctgacactggctagagacactttttttttttttttttttttttggctgtagctaatgtggaaagtgtgagttggttacaagtaacaacacaaggtgaaagagctgcggtttcacctagccacttcctcattgtaagcaggcagctgctaggcaaggcctaacatgcttgaagctctaggttctactccaatcttcctctccctctcctcctcctcctcccccctcatacacacacacacacacacacacacacacacacacacacagagagagagagtagcctgtgggcctagcatgcttggatatacttaaacttaggtgccataagagcctactgtacatctcagctatatattgtatctaccttattgctgctaggctctgaattttgtgcatcaagttactatactagatactgttggcaacttgcaacacatcattaggcatctatgtttctaaataaaaccaaacatggaaaggtatagtaaaaataatagacaatagaacattttctgcgcttttctttttttaactagaatccaattttattcagatcagcactgtccaacaaaatactgtcttaatttatgatctgagttctggagtgtcagaataaattatggcatactttgaaagccacaagacattaattttataataaaaaatggaagactaatactttttcaaaatatgctgtagaggcctggagagatggctcattggttaagagttcttgctgctcttgcacaggaccttggtttatttcccagcacccacaccgtgactcgaaaccacatgtaactccagttccagggactctgaatcccttttctgactgagcatgtacacaatacacatacatacgtctaagcacgcactcaggatttttgagacagggtttctatgtagctctggctatcgtggaacacactatgtatgtacatcaggctggtcttgaagtcaaagctcaacctgtctctgcctccccgagtgctgagattaaactcacattcctccgtgcctggttcaaaatttaaaaaaaaattttttttgtaaagataaccattaaggatatactcttttctttcttcctaatcccagcacaggtcatttttgttctggggttctggcttttaggatcctccaaataatttatagtctctacccttgtttttgtttgcacctttgttttattgatttaacttaaaaattgtatttatctgtatgtaaaaatgttttgcttgcatgtaatctgtggttggtacctgtacaggtcagaagatggatggcatcagatcccttggaactggagtttcagatgacttatatgtactgagacgtgaacctgggccctccagaagagcagccagtgctcttaatctagaaaagcaacctctccaaccctttttactctttttttaaacattgtctattttgattagttttaattatgtaaatttgtaggtctctgcatgggtatgtaaataagagtgctgatgcatgagaggcaggaaaggggtgctggggttttaactgctcaaggtcagctgcagggagcaggtgctgggattatgaatttgagtcctcaataagagcctggtgtggtggtgggtggtgcactctttaatcccagccttcaggaaacaaagccaggtggatggatctctgtgagtttgaggcctgcctggacagaacatgttccctgacagtcagggctacataacaaagagactctgactcaaaacaaacaagagcagtatgtatgctcttagtgggctcttgtaaattaaataattaattaatatgttcctgtggcaggttccctactcacctcaatgctttatcttccagaatgaaagacacacacacacacacacattgggccactgtctaaacttcactacctcctgctgataattccaagttactacttactacattctgtattgtatcttggctgccttggaccccactggactgcgctcttgtggctccttcacgtggcagctatcctttgtcctgcactcctctcaggcatggggaatctcctttcctccacattctcccagcctggcagatctccttctcctcctcctggaagtcctgcctctgtctgccctgcccagccattggctgctggcatttttattaaccaatcagaaccaactgagatcagggtcctttcatgtcttacatgcagacatgtacaggtccccaattttgggggacccaaattgacattagaatacaagcagcagtaggccaactccactacatttcccccttttgtccagttaaaatggcttttttttctctcagatatacattgaacataattttgacaattatgtaaattataaggtacagcatacacttacaatgtctagtacattatctttgtcaatttaaagtattctattatctatcttaacttaaagagtttacaattctgtacttaaattttgtttgatttttaacttgtaataccatctgaaaaccatcctttcgaatctagaacatcatctttaatgttaaataacttacatttaattatgagattatagctagtcttcaacccgtcagagatctgactgagccatctctttaaatctatcattagcccttgctgaccaaaaccatgtgattcatgactataatagagtgaaagcccttaggaaagaacctattcaatactatatgcccaataaatataactactattttggaatgcatcccttacataaaatgtgaccatcttgaagttattctctcctgatagtttcacaaaataaaatatgaagatgacagaaaaatagcccacaatcccattactactgcagtctagctgtgttagcatattttagtctagctgtttgtggtccttttgccctacacattgattctttaatgtacagatatgttgcagttatagcaaacttgagaactagagagccttcagaaccgccaaagggaaccgttgtaacaattcagataagagtactagggactgggaataagtcactggctgccaagatggtgggagactgagttgttttctgaactagaatcaacaaacttgatgctagtttcaaaattattttagtcttgacttctgaaaagaggtggaaataaaaggcaaaggcatatattttctggtgaagatacttggttttgtacatgttggactttgagactaaaatacaccatccagaagaaaatacaaggatttgagataatatagcaaggactatatacttgaggcagtattctgatagtaatctgcctggaacttgaataagaacaagcttgtaaaagtttttaaatagttaagcatggtgcctaaatagttaggtatagtagtctttcaaacatgcctatctgattttacttgtttgtggaataaatttgtttcctaaaacaaagaagaaatttcatcaatttgatctctatagaatgccactgaacttgaaagggtactatttatcatttttcactcccttgccagcttcattggtgtcttctaaaacaaaacaaaacaaaacaaaaaaacaaaccaaggaaactttttctaaaatgcttctgatgggatttggtttacatgaataatttatgttatttgaatgagtataattcattcaacctaaccttgcattaagaacagataaaactttgggagtttagcttagtggtagagaatttacttaccaagtacaaagcccttggttcagtctccagcagcgaatgaatgaatgaatgaatgaatgaatgaatgaaatgaaatgaaattactgaatacataaaaacattgaagattgtttcagtggttcttgaaatgctaagcatgatcctagtggctatgttaaggagactccattatttagtttaaactaacgtgggggaagtaaagaattaggagtataaaactacaagtcaagaagctggggaaatggcttagcagttaatagcaaataactacttttacagagaccttgagttggtttgcaccatccacattggatgactcatggggatccagtgtcgtcttctggccacctcagccacctgcactcatgtgcatgcccaagtgcacataactaaagataatgtaaaatgccacacatagtgacacaggcctgcagaggcagatggatctctatgaatttgaagccaaccaaggccacatatacatgcatacctgtatctaacaataccaagtaaagtgaaacaaaatataaaattaaaaaaaaaaaatacagacaatgaacaaatcccaagtcttgaatctttgaaagtgaataacatggactgtggcctggagctcagttggtagagtgcctgtctgacttgcttgaactcaagcacagcagcaactgggcatggtgggcacacttgtaatctcagcactcaaattcaaggtcatcttgggctacatgaaaccctgtctttggaggacattggggaggatgatttgattaaaatgatacgttgcttttctgaaaatacaggacactcagttgagaattcaaatgtgtacgcatcacatcattcagtgtattgagatcatttttatatatgtagcaggttggtatttcacatgtcattaaaaggaggagaggttgttttttaactaattgtaaagatcttttattgttcttgtgttttgaggtaggctgtcctgtaacccaagctgacctgactgtgtagtcaaaaatcacttttaaactaaaacttccaagccctggcagtgcaggtgtgcagcacatccagctcagaaagggatcttaatatgaaaccaaatgtgtaaaaagtttggaatcctgcattgttaccatatttctttgtagttttttaatggggggggggggtacatatatgtgtgcctgacactcatgtggaaataaaggacatcttcacctttgtaggtttcaggtcatctggtttggtagccagtgtcatcaactgttagccatcttactagccctatttgtaattctacgacagtagttaaaaatctttatagaatttactcataatcaagctgccttctgaaagtaagacttaactgtaggagtaaaagcctaattaggagcttcactgaccagttagaatgtgttctctagaggggaaatggtatctgtttatgtggagctaagacacaaaaaagttacatcaggcttttatggttgtttggttttgtttctgtttttgtttttttgagacagggtttctctttatagctctggatgtcctggagctcactttgtagaccaggctggcctcgaactcagaaatcctcctgcctctgcctcccgagtgctgggattaaaggcgtgcgccaccacgccgggcctgtttttgtttttgaggcaaggtcttggtatagccttggctgtcctggaatttactcgtactcggcaagatcttcctgtctctgcctccaaggctggcattaaaggtgtgtaccaccacacccagctttacgttatgttcttggtgtcttttcaaggaaataaaggctcacgtatgttctaagagttgaacaagaacagttcattcaaagcaagatagtattgctcaggatttgcctgtcttcgagagtgacagtagccacatgagtgagagagtagttatttcctggggctttgcttataaggtgggaaagagggactaattgttaagggtcatttgagttctctactttagttgacagacctgagttgtcccttctgatatatctgattttaattatatagtccattcatgtataagcacaaagtggtaaataggagatcctttctaaaagctcaactcctagacaattgcctgattgtttatacacccaaaaccaacctgtttcttaactttgcatacatctaggagtatgttttaataagtgtctacaaagaggaggagaaacttactctattatgggtaggatgtacatggagcaaccctcctttccattttccccttcaatttagtgatgtattgaccaaacttgctactttaattctgcatgtatatggagatccaactcaggtatattgtggctttactcctctgatttccccctgtcagaagaaccattctgcattccactcactctgaagggatgattcatgaattggtgaatatagaattctttgaccaaggcctaaaaagacagtgtgtacacatgtgttaggaaaagaggaatgaatagtacatttgagagtgaagagccaatttgtttcctttttatttgtaaaatgatgaaatatgtttgttttttagaccttattgcaatatgcaagcaacaagaatgcatcagaacacattgtgtatcttctggaggtataccgcctcgctatccaaagctttgccagcgcacgtccatttctaactactgaatgtgaagatgttctcttagtgcttggcagattagtcctgtaagtttaagctcttaaagtacttaagaattgagtactgttgattgtgatgtttgcctgacttctttacagtgccactgtttattctgcaaagcaccaattccctctactctcaaccttcattaagttcccaagaggtaaagtccaagtgaggcaccagctaaacaaaatctacctttagaatcagtctcatttctctcccccatccctaaccccccacccccttaccccaagagtgacctggctgtcctggaactctagaccaggctggccttgaactcagattcacctgcctctgcctccagagtactgggaattaaggcctgcaccaccactgctcactgaagtctttcattctcaggtttgtacttcagttacacagtccattttccttctctttcccataggtatagaatgaggttaatcagtttgttatgactgtgaccaagtgccgaagaaaaccaacttaagagagaattattttgccagtttcaggggttttagtccatcatgagaaggaggcctggtcaagtagagcagtcttcaccctgaagcaagaagcagagagagaatgcctgccccaagaatgggtttgctcccttatcttcctaatctatctggagttcgggctttagacagcactgcttacctcaactgaagtctcccccttagttaatcattggtggaaatctttcacagatacaccctgtccatcttctaggaatctcagtctaatcaagtcggcaaccagaattcattaccatagatttaggatctggaaattggttatctttgagaaatagcatatacttggaaaagaaactgaaactttgcaacttgtttacatcttttgaactgaaaataattttaccagcacaaaatatcattatagtaaagccaccctatgtgtccatagtatttagctgttttaatattgggttgcctgctagcagatgaaattacaccattaacatcgctcatctcaacagctattcagatgtaggctggtgctgtctcatttagatcctgcatcgctgagtgagatacgtgctggtcagagtactctatcttttgtctagccctacctgtttgaattctcttcaccacagctgaatctctgacatttttgtggaaggttagtattccctattcatcccattgttctcccttccaagtcccacttacttcctgccacttgatatcagtctctaccggcaaaatgatgtgctgtaagatttaggtgagctgttggcagattgatattttgagttctttattgatatttttaggaatcttcaaaaaatccttttctgttgcttcttccctctccctgggtagtaggtactgtggaaggaagaatcatttttgcttggttttagaagtgaagaaatcacttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatttgtgattattaaactgaaatattcagattgttcataagacagtgccttgtcgatcaatataaatctctagatcagccaaactagctgtcatcgattctattcatacattatactcacaggagaccacttgggtgctcacttttctaagagggtggaacagactagaaaatggcaagtgtccttcctgcccagcaacaggcgtcaaatgatccgttaagggtagaaactgaaaaggtattttaaaaatatacttacaaactagggagatttttaaccagtaaagttcctgccttgcaagcgtgagggccttgagtttggatccccagaactcatagaaaaagccaggtgtggtactagaggcctataatcctagggatgtgagatgggaagcagaaagaggatcctagagctcatgtctacctggcctagcctccttggcaaagctctgggcctcttgaacaaagaaggttggtaatatgctagagaataacactaaggtgttgacctaagtgtgcacacacctgcatatatgcataaatgcatacaaataaacattaaataatatgaatcgtttaattactgatctctaactaagagtcattgctctgtattattttatcttaaatattttatgtcctttaatcaagtaaaccttaaaatgtagagattattcaaatctccctttacaacacggaggtacacataggaaagttagcttgcccagagtaacatccaccaccttccgattcagaatccttcattaatggcttcatgcaggacacatatttcacagtaacttggacctgtttcatatgggcacagataaagatttatatattaaaaacatactttagagtatagaaatgtatttcctctaggctatatactacaaaatgaagtgattgtaatgtctcttaggggataagaaaattctttgtcattcttggcctatttgaaaccaagtaatgtggttctgatttctcacataccaaaacaaccattagattcatctttcatgtatggcacattgatttctgcttttgtttgagattgggttagccgaaatctaagaccaggctgttcttgatctcattctgtatcccagaaggcctcaaccttgtgacagtcctgccctagcctcagagtgctggaattacagatatgtagcactacggccagatgagcacaagtatttttgtcttgatgctttgaggccttgtttggtcctggcatgttgcattctaaaaggacatatatacttaattcttatagcgctgttagtatttttattttatcctccctagacaaaatactttcataagcttctttattttcttagagtgtttgcttgagtaaaataagtgcctcttcccccagtgtcagttttagtagttaatcaaacttgtaggatatatttttgaatgtgctcaggaaaattaatggactagcactgcagataaacgagcggtttggcccctgttaaaattctgaaatataaaaataagttttctcatttttttaaaaagatttatttattatatgtaagtacactgtagctgtcttcagacactccagaagagggcgccagatctcgttacggatggttgtgagccaccatgtggttgctgggaattgaactcaggacctctggaagagcagtcagtgctcttaaccactgagccacctctccagcccaagttttctcattttatgtgacaaacggaccaagcagtacatggcattctggatacttttgtcaaaaataaacttttctttcttttttggtaaggacttgttatgcatgtatccttggctagcctcgaacttttaatcttcttttctcacctcccaggtgttttgattgataggcatgccatcatgtcatctttggggtattattttgtttcatgctccatcctcacccagaatatgagtttgtatcagcgaaggcctcaggtcaagtcctgctgaccaatgtacagccctcatgtattagaaaacctattgtgaacaagtttttgtccttgttcttgttctcagggctggagattaagctcatgctgtctgagctctcttacactgggctgtatttccagcctgatgaagatctttgttattgttcataatagttagctgcgttttgttggtttggtttggttttggtttggggggttttgtttgtttgtttgtttgtttgtttgtttttggtttgactagagttcactttgtagctagcccaggtgggccttgaagacatgatactcctatgtgagccatacagcttattcttcggttagtttttattatgagcatgcagcttattctacatgatttacctctttgataaccacatggtattctttactgtgtgtgaacatgaattatttcactaaatatctcctatttgttttaatggtatgaaactgaataacttactgccatttcagttttatagatttctaggtgtgtcagttgtactttaaaaaaaaaacaaaaacaaaaaaacaaaaccctgtgctggcaagatggctcagtgagtaagggtttggtttgttgttgttgttgttgttttgttttgtttttggttaggcctgacaacatgagttgaagcttcagaactcactggttggaaggagagaattagctgccacatgttctctgatgacctgcacaaagtattcttttgcacataaataaaacatttttaaattaaaagaatttaacagatgaaaaagtaaactatttggtgtgacatccctgaccttggttctcactcctttaaggttgaggatcatttcatctcagtactgggaaatactaataacatcagatttagatatatggggagaagaaagtattattaaaaccatttacatttcagttactgtttatcgcagtaggggataatattttcttctttctgttttgttttgtttttcaaggcaaaaatttttctgtgtagccctaactgtcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgtcagtctgtaaaaggaaaatgttaacaatctaaaattatttcaaataattacaggttaaatattggcattagtaaactattactggaagtctctctctttcccccatcatagaaggttggccttgagctcttgatctttctgtttcttcacttgtactcactgattgctggatatgtgccactctgtctcactatgtaggcctggctggcctagaactccagatgtgccttcctctgcttctcagatgctaagattaaaggtttgtgctgtcatacctagtagcaattacgtttatacgcgtgcacacacacacacacacacacacacacacacacactaataaccaagaccttaaaatgttttgtataaagccatgtcctttttaactaatacattaacaagaatttaaatagttgaaaatcagggttggagctgagtgaggctcagcagtacccctcactccaatgtcatacatacatcgtttattcccatatgatagttatttttatttgcaaggctatgctgcctgaatactgaacgggctgggcctttaagtgaagtctgctactgccaaggttagtaggtctggccattgtaattactgggatattttagatattctgctcaggtataaattgattatgataataattttacatgaaggaaattcatgaaaacattttaaatacatttttaacttgcttggaaatattctagtagggaagtacaaacatttgaggtttctctctctccctctcatttttttttttttctttttggattttttttttttttaaagatttatttatttatttattatatgtaagtacactgtagctgtcctcagacactccagaagagggagtcagatctcgttacggatggttgtgagccaccatgtggttgctgggatttgaacttcggaccttcggaagagcagtcgggtgctcttacccactgagccatctcaccagccctccctctcatttattaagtgttggggtccaggagtttcctcacaatctacatcaacaccgacctcagtcagacagggatagtgtattgagcatacgacccaggactgatttgtcagggacacaaatccagacattaagattctacagggtttttacacctaaaatccacaaacatttatgccaagttattccaccagtcaggatttagggacaggattttgttcagaacaatgtctttatacacttatgctgttcccattagttggagtattcaactgagtcaaggaacttgccttgtctaacattattatcttgtcaaacaggatggattggacttgtctaacattttgtcaaacaggatgtcagttacacatgtacatgtctctttctgccaagtaggatagcagttcttagggaggctttaggaaattaaactttactcaacccctactcaaaatgcaagtctttttttgtttgtttgtttttgttttttcgagacagggtttttctgtgtagccctggctgtcctagaactcactttgtagaccaggccggccttgaactcagaaatccgcctgcttctgtcttccaagtgctgggattaaaggggtgggccaccaccgcccagtgaaatggaggtcttattccaaatagtttcttatgttggtgcaggtgtctcttatgttggggtccatctcaggggcagcttatataagcaaataccataaaagcttatatacaggtgcaggaaatcttactgggtggttggttcaggtccaagttcattgtggataactagacaaaacagttctactgacttctgattggtttccaagggcacagaacataacaatatgtatcaatcaacttgggcatgaaagtttctttctttctttttttcttttttttttttgttgtgtttgtttgtttgtttgtttgtttttagaaagtttctagaaacaacatttgagaacgtttccttatattagtaatagcacaaaatggcaggctagacaggtaatagttacctaggccttaatattttacctagactttcaaagtaagtattttcagtttattgatatttaactaagttgagaaggcaaagctttgtcattagcttctcttcttaaatatgctctttggttttaggagtcacatgatgcattgttggaatttggaaataataatttacaaatactggttcatgttacaaaagaaggagtgtggaaaaaccccattcttcttaaaattctgtcacaacagccagtagagacagaggaaggtaagtcttaacactctattggccatattgagttctaagagatttgaaattggttattgattaaaattttgtacctaagttttttgttttgtttttctgaatagtaaaaaatagttgctaatgtgtgtgtgtgtgtgttgcacactagaatcccagcatgcaggatctggggacaggagaattggttccaggtcagcctgttacagtttcaaacaaatatttgatattttacttttttctataagaattcttacttttagtgttgtatgtctttgtatttgctttaagttgtctcgaattgagtaatgattctcatatggagttcctgaaatgaagattaaattgatacagttcttttgttttgttttgttttttgtttttcgagacaaggtttctctatagcctggctgtcctggaactcactttgtagaccaggctggccttgaactcagaaatctgcctgcctctgcctcctgagtgctgggattaaaggcgcacaccaccaccaccgcccggcgctagctaacattttattaagtatgactactgtgttcatattgttcagggtttttgttgttgtctttttgtatagtaagcagcttagcataagggtttgtggggttttgggttttttgtttttgtttctcacatgaaataacctgttgtgtgtgtgttcagaagacatctatgggctagggtctctccttccaccttttcattgtggagaatcttacctcagattgctaggtggtcttgccagccttcaggtgtttagatttttctattggccatgacctttggggacctgtttggaaaagataattttccttcataaatgtaggcaagtgggagactaacaaatgattatcagtaagagctgttagagatcatacactgccaatggtgggttatgctttgcttttgttttgtttttcaaagcagcgtttcactgtgtttccctggctgtcctggagctcactctgtaggccaggctggccttaaacacacagagatctacctgcctctgagtgctggaattttaaaggcatgagccaccaccactcagcttatggagtatgtttatcatgtattttctaattttagtagtgtccttttgttagtatggtatatctgtttatatcagcattatcacagagtgatgcattgcatcacagtgttcctatggctacattgtcactaagtggcaagaaattgccttttagaggtttttaagtatatgaacattttacctgcaagtatgtatgcacagaggcttgaagagagggtgttgggaattcccctagaactgagttactgatagtaagccactatcagtaactatatatatagttatatagttatatatgtatatggatgtgtctgtgtgggtatgtgcatgtaagtacagtgccaaaggagactagagtcattgaattcacctggagctatagttacagctgtgaaccatctcgtgtgagttctgggaataggattttggtcctcttaaagagcaatatgtactcttaaccactgaaccatctccatccctacgaactccttttaaattaatccttaaatgtgattgttttcagatgataaaggacagatactgtcaataattatttagtcttcctaacacctatggctggggatggccttataattggcaagtgttgtactgctaagctgtttgtttatatgtatgccacagcagaggacagctttgttaagtattgaaacacatggattacacaactgttgttttattttgcagcggtagtcatgaaccagtaccctggacgtgcaggataaatgctttgtcgagctgcctttccagctcctagatttcctttcaacatataaatatatcgataagtaaataagaaataagtatctgagaaatatagatactttttaagaaagggaaagaagctaggcatggtggcacacactttaatctcagctctcaaaagcggaggcaggtagattaaccttatttgagctagacactcatctgtgctagctggccagcagagagctgccagtctccaagcttcagtagtggagttaatacatccttttgtgagtcctggtatcaaactcaagtccgcagagcaaatgcttttatccagtgagcatcaccccagctcttgaaataacctttcagttattatttacatttgttatttaatggtttagttatttttattgaatttttttccggtgcattggtgttttgcctgactttaaaagtatttgactaagggttgattacccttacatcactaagtccatggttccatagagaatacagaagtctaaacattgtagttgaccacagattggtagcagaagagcacagaagatatcagaaataaataacaacaagtaatagtgaacatttattccatgcttgcttttgtcctgtttcttatgtgtatcactcctgtttcacacatgatcctggaatccccttaaggggaatgacttgtattaacatcttatacatgagaagcttcatcgtcagtaagaatgaatcctcagatggcaatttagaaatctacagtcttactataaccccttattctgcatgtacagagaaatcttagtgtgataagagatagatgaaaagtactgtgcagcaggac

SEQ ID NO: 326 - DNA, 227 bp, Mus musculus
ctggagaccgagctgagggagcaggaggtgtccgaggtctcatctttgagctactgccggagcttctgccagaccttattgcaatatgcaagcaacaagaatgcatcagaacacattgtgtatcttctggaggtataccgcctcgctatccaaagctttgccagcgcacgtccatttctaactactgaatgtgaagatgttctcttagtgcttggcagattagtcct

SEQ ID NO: 327 - protein, 76 aa, Mus musculus
  VARIANT (1)...(76): Xaa = Any Amino Acid
LETELREQEVSEVSSLSYCRSFCQTLLQYASNKNASEHIVYLLEVYRLAIQSFASARPFLTTECEDVLLVLGRLVX

SEQ ID NO: 328 - DNA, 99886 bp, Homo sapiens
  misc_feature (1)...(99886): n = A,T,C or G
gcaggagaatcacttgaacccaggaggcgaaggttgcagtgagccaagatcatgccactgcactcccgcctgggtgacagagtaagactctgtctcaaaaaaaaaaaaaaaaaaagaaagaaaagaaaagaaagaaagaaagaaaagaaaatggattctctaaatgacttgtttagttggttaccctcagggctaagttcattttttcgttctggtcttcaagtaattgttattataatcataagtacagtttccattttcctagttatcaaattactcatgattcgtgtttcagcttgcttgtgatcaatgactaaaactagaataataattgcttaaaaagttgccttaattgaaaataagtcacacaaccagaatcagaccactaagttatactttccttctgttgttcataattaggctttggcttctttcggcttatgaattaaacatttcccctctctgtggggcatgactctctaggaatgagacttcctagtgatgtgagatataactactctctaacaaatgcttcttccgtaatgctttcttcaaagatcttgaagaaaaggggaaaatgtgaaagaaaaggaatagtctgtctatttggggcttctaaaagcttaggttttgtggaagattgactttggagaccaagtcacagagcatgacctcttaatcttgactttttattatagattaatttcctttcttattttcttgtacctgactcagatggtacctgagatacaagactccttgactgagtctatataagtctccttgactgattcttgactgagatataagactccttaggccgggcgcgtggctcatgcctgtaatgttggtcaggctggtctcgagctcctgacctcaagtgatccacccaccttggccttgcaaaggtctgggattataggcatgagccaccaagctccgcctttagctttactttttgatgttaacatgtgaactagttagtataaattagaaaaaaaacaacaggatcataagcttgaatattccattcaaattgtctggtaaaatgagtagggtccaggtgagagtcagggaattctttaactatgcctttagatttcaccttggttcataaaccaaggtaggttctcccctaccagacaccagctactcacaaaatggagccagaacaatgggagtagaagtgggaggaggaagaaaaagtagttgagataatgaaggataaagagaaggaggagttgaggaggagaaatttcagcagcttttttatttcagaaattgtttcagagaatcttttgttttctttctgtaaagaaagaactttatcaaaacctcttttggaagcctctaaatgccattgaaaataacttttccaattgctctgttttattttagagccagcttattctaattgagcatataagtaaactagattaggcatttcaaaggcacaccattttggccattataatttggagtcattgtgagttattcacgagcagttttctaaatacttacctgaaaaggcatcatgtcatatgtgttaactataaatccagctggagtttctaatagtgggtctctcttaaggaggaaggttcagttttagatgcacagttgcccatagtgcatcaaaagacttagggaaagttgttttgagatcaagaaagttgttttgagatccctaagaccaaaagacttagtgaaagttgttttgagatcgagtgtgctgcttgcgaaaatagctcctcaaggtgtcactcttgagtcagttcttctcacatacaaatctcaatgataccaacaaacttggatgcttaagatacagggtaatcaatcctttatgtgtgctcaccagattaagcaaggtttcctttaaattctacttaagggatttcctgtgagactgttacttatcaggagtgattaactcagatactcacactagaccttagttgcttaaggtgacttttagctgggagaaacagtgtctattatcttcaggacttatttcatccttatacagagtatttcataattttggtcactcaagaagcaagcttgaatttgtcaattgaaccaagcctcagaacctggctagctttaaatattataacatttttgcttaaaccacaaagatttacttcctctttttaaaaataaactgtttttcaccttatcaacattttgaatgagagaaaaagttgtaaaaactctaaggagtaattcaaaacaaaaaccttaacctcacagaaaagtgaaagtcacaattttttttttttttgagacatagtcttgctctgtcacccaggctggaatacagtagtgtgatctcggctcactgcaacctctgcctcttgggtttaagtgattctcctgcttcagcctcctgagtagctggcactacaggcatgtgccaccacgcccagttaatttttgtgtttttagtagaaacggggtttcaccatgttggccaggctggtctcgaactcccaacctcaagtgatccacccacctcggcctcccaaagtgctgagattacaggtgtgagccactgcacccgactgaaagtcacaaatctatgatcagcagaatctctacagaataacaaatgaaactcctatcttgcagcagagctttaattcttacttcctccagttagaagtgtatagctggaataaagtctgaatcctcatcaaagccaagaggactacaacctgagaggagccttaccagggatccccattagttcttttgagggtggatgaacaaaagttgttcatgctggtaccaagattttggctgttagtgaaatgacaggaatcactggaatgaaggtttgccttaggtcccttcatggtcgccaaaatgtcaaccttaataatgaaattcaggcaacagtattaaatattgagtttattcgagtgtaaatttgagggtggccatctgagaggatatagactccaaaaagatggggtcagtgctctgaaatggagaggtttgagggtgcttaaataggtaaagtctggggaagcttaccaggatttcaacattttgcatacaagattaatgcatagatacagcaatttgattgattatatgcagtgtttcttttgggggaagggtatatttcacatttcacattaaggatgtaatagtcaaggggtctttttttcttgtttgagccaagtaaaagaaaataggaaggaagttaatctataacaaaaggccgccacgcacagtggctcacgcttgtaatcccagggctttgaaaggctgagatggacagatcatttgagtccaggagtttgagaccagcaaccccatctctataaaaaatgcaaaaattagcttggtgtggtggcatgtgcctgtagttccagctacttgaggggctgaggcagaaggatctcttgaaccaagaagttgaggttgcagtgagctgagatcactgcactccagactgggtgacaaagtaagaccttgtgtcaaaaaaaacaaaaacaaaaaaacaaaaatgccagtaaacaagaggtcatgctttgtgactcagtctccaaagtcaaccttgcttagggcctaacaacttttagaagctcaaaatagactattttctttcacaattttaaattaaaattaagtaaataatgctagaattgtaaatttcatttaaaaaacaattcagtcttattaaatatttttgtacaaatagttattcccaatgctaatattcattgtctatttatgattatgtaaatgttcagtcttactctctactcatgttacatctagacagatacatgtatatatcagtgtatacgcatatgtgtgtatggagacaattaaaaaaaggaacatctgccactaccaagaaacaatacatggttatgcaagaaaatgcatttatgctatctaagaggaagagtatgacaagctaatttgtgttttctcttacccaagtgcttctgtagctcgaacacactctacgtagcatttcaaaaacagtgtgcctatttctcttaagtagcacaacccaaaaccttcaagacattaggatgcagttgtctttcatttttttaatggtggtaaaatatgcataaggtaaagcttatcattttatccatttttaagtgtatagttcagtggcattaagtacattcacattgttgtgcaagcatcaccaccctccatcaccgtaactttttcatcttcccaaactgaaattctacatccattaaacaataactctgctggcctctctctcccccagcccctggcaaccaccattattctttcttactctatgaatttgactactctatatacctcatataagtggactcatacaacatttgtctttttatgatgcttgtttcacttagcataatcaacatttatccatgttgtagcacgtgtcagaatttcctccctccccctgttttttcaggaatgaatttctttcctttttaaggttgaataacattccattgcatgtctataccacattcatttatttattcattcattcatggacatttgggtcatttttatcgtttggttattatgaataacagtgttgtgaacacaaatgtacaaatatttgttcatgtctctggtttcaattcttttggtgcctttcagctttgagtatatggagcaagagacgtgataaagaggttccctaaagcctgaatagtagtggtaaagaaagcaaatatttatccgggtgtggtgatgcacacctgcaatcccagatactcaggagactgaggcagaagaatctcttgaacccaggaggcagaaattctagtgagttgagatcaccccactgcactccagtctagtgacaaaggggaaactccgtcaaaaaaaaaaaaaaaagaagaagaagaagaaagaaggaaagaaagaaagaaacaaagaaacaaaggaagaaagaaaagaatagaaatggaaaaaagctaggcttgttgttgcatttctgtagtctcagctactcaagagactgacgtgagaggcttgcttgagtccaggaaggccaaggctgcagtgagctgtgatcataccactgcatttcagcatgggtgacagagtgagaccctgcctcaagaaagcaaatatttaagattgtacttgtgctgagtgctggatttcaaatgataggggtgcccatgtgttctttaatatagttactgtgtgtgtgtgtgtgtgtgtgcatgtgtgtgtgtgtaagaaagagagagagaggtttgtgtagtcctctaaagtgtgggacccagggcagggcccttgttgcctggacttagggtggtattgtcataagcacatacatgtattagaactgggtgagtgtagcagtgagtgtagatagaaaagaagttgacagactatgcctgggacacttagaaatcacaaagaaaagagagaataaaagaaaagaaatcaagaaaaaaaaccccaggagaatgtgcagacttggaatccaagtgaaattaaatgttggggaattatcgacaatgccaaatactgctaagagattgactaaacaaggactgataattcacctttggacacacacaaaagtagaactcactggtggtgttaaaatgagctgtttcattgactggtggggataaaacctgactgagaagagttcaagtaagaatgagaagagggtaagtagaaacagaaggtctggccagctctttagagaagtttttctataaaaggaagcaaagaagtgggatggaagctagatgaagatgtggtggagtcactagagatttatttttctttttgcctaacagaggtggaacagctgatggccccacatcttcagctgaagctccacagtcacacatacaagtgcctatctggcatctccatttaaatgtctcataggaactcacaggaaaatcaaacttaacctgttccaaatagaactcttgattctccctcactctatccccagtctgttctttcctaagccttccttttctcaataaacatcattgcccaccattcaaaccaaaagccatgtagccattccagattatttcaatttcctcaaaaacagtgcatcagcctgttagttctacttccaaaatacatctctaacttgatcatctggagtactacaataggttccctgctttcattctcgcctctcaccacctattctcacatggcagcaagagtgtaaaccagacaaagttacacctccacttaaagctttgattactcagtaaaacaatgattactcagtacacttcaaatccccactgcttaccttgagctatactgtcctacatgacctggctctttgctccttctccaatctcatcttcacttctttctctctcttgcaccatactccagacatgctggcctaaacctaattatttgtattacaaagatataaaaaaatagagaataatatttatatatatatacatatatatactttttttgagacagagtcttgctctgtcgcccaggctggagtgcagtggcgcaatctcggctcactgcaacctctgcctcccttcacgccattctccttcctcagcctcctgagtagctgggactacaggcgcccgccaccacgcccgactaattttttgtatttttttagtagagacggggtttcaccgtgttagtcaggatggtctcgatctcctgacctcgtgatctgcctgcctcggcctcccaaagtgctgggattacaggagtgagctaccgagcccagccaatagggaataatattatagatattatataataatatataataatattatagattatagagccagatctaatactttaattaatacttagctacatgtaccattaaaatgtaaactacatgtcttttctgaatctctattacctgaaaaagtgcctaacacataatatatgctcaatgcatctggtataattgaatatttgcttcacattaaaaaataagtaaaacattacagatacagtgaatgctccttatacctccttcccttcctctttccccagaagaactacctaccattctaaaggtgatatatgccatgcctataatatccctagttttaatattttgttacttgagcatttgttttctatgttttcaaaatttacagtatagaataatacgttaaatatcccttgcgatttgtttttttatcatgctttatgcctattatgttgatatatgcagttttcatatgttttttggctgtatatttcagtgtgtgaacataccataatttgtttatctatttcttactgttgaacatttaggttgtttcaaatattttgttattcccaatagtgctgcaatgaatatgagcaacatgacagttaagagggtggattctagagccagactacccaggattgaatttcaggcaccatcactagttgtgtcactttgggcacgttacttctttgtgctctagtttatttaattgtaaaatgatggcaataaattttcatgatattgttagtagaattaaatgagttaatacatataaagaacttcgaaaagtgcctggaacatattaaatctcaatgaatattgaccgttattattattacccttattattaggaattgcttaattacaggacatgtacatcttctatttcattaaatattacacattattctcctaagtgatatgtcaatttatgcttccagcaggggtatataagttccattttcctatttcctatactaattaaaaattcctgtcaatctaatggatatgaaattgttgttttacttgtactttgatagttacagcaaaattatatattttttcttgggtttattggccattcagttttcttttttggtgaactgcctttttacctacttttctttctctctctcttttttttttttttttttagtgtccctcaggctagaatgcagtgatgccaccttgggtcactgcaccacagctttgatttccagagctcaagcgatcctcccacctcagcctcctaagtagctgggactagaggcgcatgccaccacgcctggctaattttgttttcattttttgtagacacaagatctcattatgttgcccaggctggtctcgaactcctgaactcaagcaatcctccggccttgggctcccaagtactgagattacaggcatgagccaaaacgtccagctttttaatttacttttctattgggttgtttgcctttttcgattttgggaactatttgtttgtttgtttgtttgtttttttgagacggagtcttgctctgtcacccaggctggaatgcagtggcgcgatctcggctcactgcaacccctgcctctcaggttcacgccattctcctgcctcagcctcccgagtagctgggactacaggcgcccgccaccacgcccggctaattttttgtatttttagtagagacagggtttcaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatggctgggcgcggtggctcacgcctgtaatcccagcactttggaaggccaaggcgggcggatcacttgaggccaggagttcgagatcagcctggccaacacagtgaaaccccgcctctactaaaaatacaaacattagccaggcatggtggcggacgcttatagtgccagctactttgggaggctgaagcacgagaatcacttaaacctgagaggcagaggttgcagtgagcctagatcgtgccactgcactccaggctgggtgacagagtgagaccctgtctcaaaaaacaacaacaataaacaatggttatatatatggggaatatcatttagtctgtggcttgtctttgtgtgctttttcaacttgttatacggaagtaacacattttaatacagtcaaatctaaatattttcccttatggtttgtgcttttccggtcttattaagaaattcttagccgggcgcggtggctcacgcctctaatcccagcactttgggaggctgaggcgggcggatcacctgaggtcaggagttcgagaccagcctgaccaacatggagaaaccccatctctactaaaaatacaaaattagccaggtatggtggcgcatgcatgtaatcccagctgctccggaagctgaggcaggagaatgtttgaaccaaggaggcggaggttgcggtgagctgagatagcactgttgcactccagcctgggcaacaagggtgagactccgtctaaaaaaaaaaaaaaaaattcttccctatttttgacattataaagctatttttattttctgaaaaatgtttgcaggtctttaatccatctcggccttatttttggaaatggtttgaggtagaaatctaatcatttatttcccttttggaaaaaatgtctcatcgccatttattgaagagtctgtcctttcgcccactgacttgtaatgccgtctgtatcataaaccaagttcccttgatgttactcttcatttcggcctcacaatctttgcttattttccttctaccagggatgcttttcgctatgttcctttcagggctaccttcctcttgtcccttcagatcgcagttcaaatgtcatccccctcaaatctagattgctctacaggcatttctggctccgtgatcccatgacctcaaaggggtctaggtgggcatagcctctagccagttgttgctaggctgttgtcaggactggcgatgcgtaggccactgagagcacccggagtccgagtgacggaatcaggcgggcgcccgcgtcgctaaggagtgcgtcacagtgcgcgggcggccgggggcagggccagggctgagtcacgtggcttggttgcctacgcgctggtgggccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccaggtgaggggctgactggctggctgagggcggcggggcggggaagtcagggaaggaggccctggatcctctgtaagcagccgggtccaaactgaaaggcgccacctccgtgactcgccgcgcccccgggccgggaaggcccagctcggaagctcgaccgctggcccccctgcgccactgcccgactttggccaccgctgggtcgttttgctctgagccttactgagatcccggagggccctggcgggtccctggaagggctgtgccctgtcgccgttgcctgtgtcctggccgggtggttggagcgccactgccccctgagggattgattgcttgtccctgccgggagatccttttttgagtggagtgcagatctccgaactggtaaacccgggtttttctgaataatccagagaggtgtgttggggccagagacttatttttggagttaacatcttctgggctcctaaaaggtatgacagttggcttcgaaaggcgtctagagctttctgattagggattgcggagccggttggttgtttggtttttgctttttttttttttacgtttaagccgttctttcgtcttttctgtatttctttgagaggattgtgctaccgagaataaggctgactctttgagtagaagaggatgggaagagggatgtagagtgtggcctcttttggcagtcgtatgatcatttctgtgccttggtgggtcctaacctatgattacatatttatgggtgtgtttagtttagtctccatgaccactccgagatttttctgtatgttttcaagtcttttacaaatataaatattggccattattatttctgcttccaatgtttgttctgtcaggtttcagaggcacccatcagctccttatctgttgtaccttagaaaatgcaaaataatcgtggcatgttggtacttggagtctaataagtagtccagtatgctgaataaattgcggcgttctaaaataataattttggggggcaatttgctctgttggtccggagtagaataaaagttagcttgcttgattgcttttcttccctctctctgccgaggcagaagcacctcatctctctgaatggaattttgtccttactaatcttttccgtggattgtaccactccaatttttgtgtgtacaacctgcaacattgccctgtactattaaatgttaacgtgttgttgttctctgcttccttagtagtagtcatccctgtttagtaagctcatttattttacagatttttactgacttcataggatagtgccagggactttaccaagtgctggggaaacatgagtaagacagcacttagccttgatgaacttacagttggtgggaggtggtaggaatgacagtatttccagtgcggttttggtaatgatggaaaaggaggtgttgtagagacaatggtgaggagagagccttcatgggatatcctgatgggaaagacaattaactagaaaaataagtaaaaaggttaattataaattgtagtatgtgcttagaaagaagtaactgggagaggccactttagttagtaagaccctatgggctgcaaggatgaaaatgagtcacgtgaaggtctggggtggggaaagcatcccagtgccaaaggtagagattggtaaggacccagaatgctatgggaggaggggaaactaatggaaggagaggggtggtgcaggaaaacaactgtgggttttgggtaaggcttctaagcttgagttgtctccctggaaagatgacaagaatgaatgtaaccagtcacattgaagcttgtcaaaggatcacatatatatgtattctgctttatgtctagtgcttgcaactgcagttttgtttaaggtaatgttttaatgtcttgagtcttggtgacaccagagatgtgatggcccagaagaatttttaaaagaaagcatgtgtaatttgtcttttctatgaagttttttttaacctaaaattttcccaaaaaatgttttttagactaataaatgaaacaagaacaagtattcctgtaacactgtattgtaatagaaagcacatgggattgggagttaagttgggtcttgactgtgactttaccactgcttagctaataaccttgggtaaccatgtctgcaaaactatcttattttctgacctttatctccttataatgctttatacaatcagaatagaaaatttgtgtacaagtcttcacaaaatttatcatatttttgacacattttcccctgtagtccagataagatcaactgtgtccttgatgaccagatagagaaaaagtaaaaattgtatgaagaagcaggaaaattttcaccatcagtaaattttgttgaatagctcttggtttcacatttgaaaagaagaataagatatattcatttacttaaggaacactgattgtgtgacagttctgaaggtgggagcctagttaagacagttttctcggactctaggagaggagcacataatatataaagatagattgtaggcatttttacattataaaggtctgacccctgcttatgggatgcttaatactacaaatgtattttcatcagttatttagttagaaatgtcctagagacttagattgtaccaagtaatcccttttgcaacatcctgggaccatattctctccaactcttgcagcacttaaaagaaatggctctatctttgggattgcaccaaatcaagaaataaactaacatatgagtgaatagagaagcttgtctcattctgggcatattttcaattttcataagtttgtgaagatgataaaatgaaacactgaaagtaatacttactaagaaaatgatacttaggtcaaactgtattcagtgaaaattggtattaagtgactatgggatgtggtttgttttcctctttccttcagttccttttctgaaaccactgccagacagtgtggataagattaactttagaaaacagtctttctttgttttcttgaaaaattgatgatgtcttctcaagtttttcctgtattttggggaccaggattccttaagttttacaattggtgtctctatttgtaacacaaattttgaagactttttttttagtaaacttcattatcaaaattgaaattattgagtgattatgtgattacactttgagaatactgggcaaagtaattttatgagtaaaccacgtttatatgagacacttttaggttcaagactaacagtgacttcgtagatttttgatggctaaaataagtaagtactccattaaaatttccatttttcctagattagtgatggggagtacaagggctctgagtcagatagcctatgtactggcttcactattgaaatagttgtgtgaccttgggcatgttattttccttaaacgttaattcttttgcaaatggataatagtacttaagttttgtaagcaaattcattgttgtaaggacttaataagaaaatatctatttttaaaaatgccttcagaattgtctgtgttatccagatttcttagctttgtaataaaaagttttcacaaccttggtctcagcatgcttttcagccctccccttgtcagtcccatcacctgaatccaacttgtttactcctattcaggagttctttacttggagtcagtccatggaccaacatgtgattgcagttattcctgtgattaaaattttgtctgtaagtttccaagcacataattttgggaaagatgattttaattttcatttgacttctcaagatccaataaacgtattaactacgttaacgagatctcaggccgtgtctttccctttcattgtgtggttctctcattttctgcatgggagatttttcttctttagggcccagtataaatgtcatcccttctgtgaagcttttcctgatttaccagataggtttcctcttatttgtttgggatttttttggggggacactgtacatacctgtagttttaactcttaattttattgctgtcactgtcttcattcaggctttctcctgttgcagcaacctcttcactaatctcttgttttctgactgacatctgcagttcatctttgtgttctttctaaattataaatataatcttgttcgtcactttattccctaaaatacctcaattcctcccccctctccgccaaaggaaagataaagttcaaacttattagcttggtatacaaagccttttagaatccagaccaccaactcccattttcccagcctcattaaaaaagttggtttgatcccaccttcaccactgtgtccatttctcactctgcctaaataacccggggtcttcctttccccatctacctatttatcctttaagacctggctctaatattatggtctttcagctttttctgatttcagcaggcagaattaggtggttctttctccaatgcattctattagcttccagtacataaacgtggtgcctacataatttgtttccatgtttgtcttttgtattgacttgtaaatcaacaagagcaggggtcttgtttattcttttttgtatacttagtacctagcaattagtatgatgcctggcacacaaaactaatttgttaaatcaattgtagggacttcatgatacacacatgagatagacacttaaaacagtactttagggggaacctctaatgtaaaatctagtatgtaaaaagcaaattaaccataagaaattactataaagggagaggttgtggagaaataggaacacttttacactgttggtgggaccgtaaactagttcaaccattgtggaagacagtgtggcgattcctcaaggatctagaactagaaatatagaaataccatttgacccagccatcccattactgggtatatacccaaaggattataaatcatgctgctttaaggacacaggcacacgtatgtttattgcagcactattcacaatagcaaagacttggaaccaacccagatgtccatcaatgatagactggattaagaaaatgtggcacatgtacaccatggaataccgtgcagccataaaaaaggatgagttcatgtcctttgtagggacatggatgaagctggaaaccatcattctgagcaaactattgcaaggacagaaaaccaaacaccgcacgttctcactcataggtgggaattgaacagtgagaacacttggacgcagggtggggaacatcacacaccggggcctgttgtggggtggggggaggggggcgggatagcattaggagatatacctaatgtaaatgatgagttaatgggtacagcacaccaacatggcacatgtgtgcatgtgtaacaaacctgcatgttgtgcacatgtaccctagaacttaaagtataattttaaaaaaaaagaaattactataaaggaacaggataggagcttttggccatttcttggagacattatttatcaatctaagcctacattcatataataatgtatacatttacacgtgtgcagtgaggaatagcattgatggagagagaaaatgagaggcctagtattgaggaagagtagtcacctaataggacaatagtttggagatgccaagatgggtataatcagtccccttaccttgaggttgatggccatgaaggctcttgagccttacctcttacatatatttcaagaagtttttaatgcattagcttctcttcttgcgctgccttctttttagcgatatctaaatagaaactacatgacaagtagttatcatagcaaaagctagctttgtaatgcacatgacaaaaacatagtataaatgtgacccgtgaagcagtgaaaactttgggtgctgtcatttactgtggtaccatcttgtctcttactgtgtactgtgacctctagtggtttctgtttcttccatggatcatactcttctgaatagtgttgacaaaaacttactgcaagactgcaaagactaaaacgtgttttattttcattcagatctagatacttgtcacctttcccagtgaccttccttgactgtcttatctaaaatagcacttccctattgcctttcacctctttaagtactgctttatttttcttcaaatcactactaatcttgtatgtccgtctccccaactgggatgtaagtgccatgaaggtgttggcttttatttacctagtgcctagtctctaaaacttaatgggtactcactaaatgcttgttgatcttgatctcctccctttcctgtatctcccacttgaatttttgagagtaataagcaagtcttaactgtctttatcaagaaatagggacatttggccagctgtgatggctcatgcctgtaatcccagccagcactttgggagaccaagacgagaggatcccctgagcccaggagttcaagaccagcctgggcaactctacaaaaaaaaaaaaattaaaaattagccaggtgtggtaatattagcacacctgtgatcccagctactcaggaggctgaggcaggaggatcacttgcgctcaggaggttgaggctgcagtaagccatattcgtgccactgtactccagcttgggcaacagagtgagaccttgtctcaataaataaataaatagaaagatactttttgtttgtttgtttgtttgtttttgagacagagtctttctctgttgcccaggctggagtgcaatggtaagatagcccactgcaacttccgccgcctgggttcaagcgattctcgtgcctcagcctctagagtggctgggactacaggtgtgtgccaccacgcccagctaatttttatatttttagtagagatggggtttcgccatgttggccaggctggtctcgaacttctggcctcaagtgatctgcccacagcttcccaaagtgctgggattacaggcgtgagccattgcacccggccaagaaagaaagagacatttttttgtcaaccagtttatcctgcttcccagcagggatcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccctgtctctactaaaactacaaaaatcagctaggcgcagtggcaggcgcctgtaatcccagctactcgggaggctgaggcaggagaatcgcttgaaccctggtgacagaggtggcagtgagccaagattgcaccactgcactccaacatgggtaacagagtgagactctgtctcaaaaaaaaaaaaaagtgacctttatatgttttcaaatagagtgccaccaaatgggtatatgaccttggggcaagtcagcttgttatttgggtgcctcatattgctccctaaatgagatgctctttaaggtttgattctgctccaaaattatataactctattgaaaaatgtttgctatataagattcattttctaagtcatctccaaatatttgtcttgtctattcttatcaaaataaattaatcttttaaaagtatgttttatttgtaccatacctatatattgtataaaacagacacagaaatacataaaaggggtgagatttttaaaaactcatttgaatataagtattaatattatattccttctccctgatggattattatttgcccctgtagaataagtgcccatgccagtggaaactactgattagaactgaaagtatttgcgttagttatgctcactctctttatttggttttttcttcatagtgaaatcttgatttcagtctttaaaggacattgtcaatgaaaatgttaaatcaaagggccaagcacagtggctcacacctgtaatcccagtgctttgggagaccaaggcgggaggatctcttgaagccaggagttcaagaccaagactgggcaacgtagtgagaccctgtctctacaaaaactttttaaaagttagttgggcattttggtgtcttagctatttgggaggctgaggcaggaaatccctgaagctgaagagtttgaggttacagtgagctgtgtttgtgccactgcattccagcctgagcaggagaaccaagactctgttctgttatggtgggggtgggggggggagttaaatctagaccagacgttcccataaagttctaacagtaaatgtgcataaaacatcacatttggatcaatcttgtgttttattgtcacgtgaaatggagaacatatatgtatatttgaacctaacaagatttcacttaaaattctcattctggccaggcacggtggctcacatctgtaatcccagcactttgggaggcctaggcaggcggatcatgaggtcaggagttcgagaccagcctggccagtatggtgaaaccctgtctctaccaaaaatacaaaaattagctgggcgtggtggcaggtgcctgtaatcccggctacttgggagactgaggcaggagaattgcttgaacccgggaggcggaggttgcagtgagctgagatcgagccattgcactccagcctgggcgacagagtgagactccgactcaaaaaaataataataattctcattctattcgggaggctgaggcaggagaatctcttgaacccgggaagtggaggttgcagtgagcagaattgtgccactgcactccagcctgggtgacagaacaagactccatctcaaaaaaaaaaaaaaaaaagtacaatttggtgcactttggcatatcttaatatccatgaaaccatcaagattatgattatatccatcatccctagaagtttcttcctactgctttgtattccctttcttaccctcctcttgtatacataccctcccatccccacttaactactgatttgctgtctctataaattagattgcatttttaagaattttatataaatactataatcatatagtctctcttttttggtgtctctgtataattattgaaattcattcatcttgtatatatcagtagtttattttattgatgagtattcattatatggatatatcatgatttgtttatttacctattgatagacatttgaattgtttccagtttttgactactacaaatcaagctgttaggaacattttgtgtggaagtctttgtatggacagatgctttttcttttcttttgggtaaacacctaggtggaatggctgggtcagatgacaggttttccagagtagttgtattttacattcacatcagcgctgtatgagagttctagttttctatctcctcactaacacttggtgtggccagtgtttttcattttagccactctaaaattgctgttagttcattgtgattctaatttgcatttccctaatggctttttaaaattttgagatagggtcttactctgtcacccaggctgcagtggtgtgatcttggctcactgcagcctctgcctcccaggctcaggtgattctcccacgacagcctcccaaatagctgggaccacaggcttgtgtcaccacacctggctaatttttttgtatttttttataatggcgggattttgccacattgcccagattggtctcaaacttttggtctcaaacgatcctcccgccttggccttccaaaatgctggggttacaggcgtgagccagtgtgcctggccctaatgacttatgtcaagtgtcttttcatatgtttgtttgccatccttatatcttctttgacgaagtgtccaaatctttgccattgaaaaataattgttttcttattgttgaattttgagaggtgttgtgtttgtgtttctgatatatgctttgcaaagattttctccctaggttgtgccttctctctttttattattctcttaacagtatatttctttcttttttatttatttctttttttaattaattaatttttttttttgagaccgagtctcactttgtcgtccaggcaggagtgcaatggcgcgaccttgactcactgcaacctccgcctcacaggttcaagcgattctcctgcctcagactcctgagtagctgggaacaggcgcccaccaccacacccggctaatttctgtatttttagatgagacagggtttcgccatgttggccaggctggtcttgaacttccgacctcaagtgatctgcccgtgctgggattatcagcatgagccaccacaaccggccttaacagtgtatttctttctttctttttttttttttgggaggcggagtcttgctctgtcacccaggctggagtgcagtggtgtgatctcagctcactgcaagctccgcctcccggggtcacaccattctcctgcctcagcttcccaagtagctgggactacaggcgcccgccaccacgcctggctaattttttttttgtatttttagtagagacggggtttcatggtgttagccaggatggggtctatctcctgacctcgtgatctgcccgcccccacctcccaaagtgctgggattacaggcgtgagccactgcaccggccaacagtgtatttctaagaacgtaaattcttaatattgataaattgtgtttttcccattatatctaagaaatctgtctaatccgagaccacagagatgttctgctattttcttctggagattgtatagttttaggttttacatttaagtctatgattcatttggagttaatttttatatacggtgtgagggatggatggaaagttctttagatatagatataggtatatctaaactttaaaaaaaatcactcgtgcttgcttcagcagcacatacattaaaattggaacaatatggagaagattagcctggcccctgtgcaaagatgacctgcaaatttttgaagtgttctatatttttcagggagtctcaggccaaggatgtcgtcgaagagtacttcaaatgcagtaaatgaacagataaatctttggctcacaaaaatctttggctcacaaaaaaataaaaaacatatatatatatagataggtatatagatatatctatagatatatatgagtgttatataaatatatctatagctatgtatatgagtgattttttttaaagttgcagcaccatttgttgaaaacctatcctttctccactgaattgcctttgcaccttattgaaaattagccatacatgtgtgtctcattctggattctattctgtttcattgatctgtttgtctactctgatgccaataccacactcttatgttgcattttcaaacaaaatataatatactataaaagctatatagcacatagagacaggaaatagaatagtggttgccaagggctagaaggaggggagaatggagagttgttttttaatgagttcagagtttcagctttgtaagatgacaggagttcagtgggtagacgttcgagtggcagcacaacaatgtaacaatgtgaatacttaataccacagaaatatatacttaaaaattgttcagatggtaaattttatatgtattttaccaccattttgaaaaaatagtttgaacccaaagctgtctttggtgttttttttttttgttttttttttttttttggagagatgggatcttgctatggtcttttttgttttgtgtttttttttttttccccagagatgagggcttgatatagttagcccaggctggtctcaaactcctgagctcaagcagtcctcccgccttggcctcccaaagtgctgggattacaggcatgagccactggtatcccgccttatcaccattttttatttttattttttgagatggagcctcgctgtgtcacccaggctggagagcattggtgcgatctcagctcactgcagcctccacatcccgggttcaagtgattctcctgcctcagcttcctcagtagttgggactacaggcctgtgccaccacgcccggctaatttttgtatttttaatagagacagcatttcgccgtgttggccaggctggtctggaacttccagtctcaggtgatccacctgcccaggcctcccaaaatgctgggattacaggcatgcgccaccacacccagcctttaccaccatatttaaaaaagctattttgtaggatgctggtacaaaatgggtagtcaatttcagttgactgatttcagaaaatgagacccagagaggttatctggtaattgatggggcagagattttaaactgtagccagaatgcctgttatttccctctgttgttacacaactacctcagaattgtaatacttttacccagcatgataaagtttgaactttacaatctccagatttaagaagtattgtaagtcagtccttttagtaataatggctcgctaatgcagaaatggaggatggtttgaatttatcctccctgcccccagcccccgtcgtcttccttttgcatgatcatccacttcagtttcttgaaaatttctaatccaaagtctctagacttaaagttaactcttttttttttttttggtacttttattgtggtaaagtatacgtaacatagaatttgccatcttaaccatttttgagagtacaacttagtggcattaagtacattcacattgttgtgcaaccattacctccatccatccatccatctccagaactttgtcatcttcccaaagtgaaagtatgtacccattaaatactaactccccattcccttttttcttcaccttctggcaaccatcattctactatctgtctctatgaatttgactactcttaggtacctcatataagtgaaattgtacagtatttgtcttgttgtgactgccatatttcacttaatatagtgtcctcaagatatatcatgttgtatcatgtcagaattttcttcccctttaagactgaataatactccattttatggatatatcacttttgttcatctgttcatgaacacttggatttcttcctccttttggctattgtaaataatgctgctgtgaacacgcgtgtacaaatacctcttcaagatctgctgtcacttctttgggatgtgtacactgaaatgaaattgttggatcatatggtatttctgtttaatttttggaggaaccaccataccattttccaaaccactgcagcattttacatttctaccagcaatgcacaggggttcctatttctccacacccttgctaacactttttctgttctttacttttcttttcttttttttgagacagggtcttgctttgtcacccaggctggagtgcagtcacatgatcttgactcattgtaacctctgcctcctggaatcaagtgattctcctgcctcagcctcctgagtggctgggattataggcgcccgccaccacgcctagctaatttttgtatttttttcagtagagacagggtttcaccatgttggccaggctggtctcgaactcctgaccacaagtgatcaacctgccttggcttcccaacgtgctgagattacaggtgtgagccacttggtctgacctcttttattttacatgatagtcaatcctaatgggtgcgaagtcgtatctcattgtggttttcatttggatttccctaattagtggtgtttcatatcttttcatgtgcttattggccatttgtatgtcttccttggagaaatgtcttttcaagtcttctgcccaatttttaattggcttgtttgttttgtgttgttgagttttaggaggtctttgtgtgtttagatattaatccatcaacagatataagatttgctgtattttctcccattttatgggtttcctttttactctcttgatagtgtcctttgatgcacagaagtttttaattttgatgaagtccagtttatatatttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaattagccgggcatggtggcgggtgcctgtagtcccagctaccttgggaggctgaggcaggagaatggcgtgaacctgggaggtggagcttgcagtgagccaagatcgtgccactgcactctagcctgggctgacagagtgagactgtctcaaaaaaaaaaaaaaagcaaaaaaaaaaaaaaaaaaaaccacaaaggctggatgcgaggtggcttttgcctgtaatcccagcacttggggaggccaaggcaggcggatcacttgaggtcaagagttcgagaccagcctggccaaaatggtgaaaccccatctctactaaaaacaggaaaattaaccgagcctggtggcgcacagttgtaatcccagctactcaggagcctgaggtgaaaggatccacttgaatctgggaggtgaaggttgcagtgagccgagatttcaccaccgcaccccaacctgggtgacagagtgagacttgattaaaaaaacaaaaagaaagaaagaaaatgcctggctagccacagtggttcatgcctgtagtcccagctacttgggaggctgaagtgggaggatcaccagcagtgatagaatgagactctatctcaatttaaaaaaaaagtgataatgaagaagattgattattccagccattcttcacatacccagagtatgcttatagtgggtataagagatctcactacttaatttgaaccaacacatgagggggtaaagatttaggaatataaaaagtataaattagtatagagcaaactggaagttcctcaagagtattgaatctttgaaattgtgtagcttacagaagtcctggtggaatgtctgtcagaagctattagattggtggcaagagcgttctaagtggacaggtggattgtggaaagactaaccccatctgtatgcactctgtccttctctttgcatactttagttagcagttggttaatttgcatgtgtggtttcagccatcatgttgtattgactcattctgaaagctctgtgaggataggccacatgtctgcccgcccccactgcatctagcactttatgtgtgataatctattgaaaaatatttgtcaaatgaataaaatggtgaatgtattcagcagacatttagtgagacttgagaatgtcctgtgggggtggaagtgggtagaggagtggtaggcctataaggattgatgagacataatgtctgactttaaggaacataaatctggcactaaatataaatttttgaaactccttaattcttagattagccaatgcagacagtaagtaacttactgacctaaaccagaatttttttgtaacatagattttaataaatttctttgttttttgttttttggtttttttttttgagacagtcttgctgtgtcgccaggctggagtgcagtggcgcaatcttggctcactgcaacctccgcctcccaggttcaagcgattttcctgcctcagcctcctgagcagctgggactacaagcgcgcgccaccacgcccatctctaatatttgtatttttagagacggggtttcacccatgttggccaggatggtctcgatctcttgactttgtgatccgtccgcctcggcctcccaaagtgctgggattacaggcgtgagccacagcacctggctgattttaataaattaggtgaaatcttagttatgtaacagacacccattctgcattctttctctactaattcagctgggaagcaggattgcttaggggtcagttttataatgttactcagtttttttattttattaaaattagggatttgattaagtggtgacatgttgcttttctgaaattacagaagggcatttatctaaagtgactgtgaccaagtagcaagatacttaattgagtaggtcggtatactaaaaatagctcaactgactgtaatgattcaggtatgcaaagatcagataatgcaatatattagttaagggaacttttactgtatatggtataatggtctatggtatatttccttgtaagttgtttctctctctctctttttttaaatgttaaagtaatcaagatgatgctaacagtcagttaccagaactcatacagggaccatttgtgtggaaactaaagctgcagaaaatccagcagaatcctgcgctactattgtagttatttgtagttgtttaggcagaaaaatcaaagacaggaagttaggaatgtttgaagacattattctagggtaatgaattcagataagatgtatttcactcatgttaaagctatcctctgaaaataagacttgcctatagaagtatccccaaccaaaagcctattaggaactccctagcccagtcagacagaatgtgtattccagggagaaggctgtatcctgcttatgttagactgtactacatacttcacgtcttaactagatataccaattaagaataggcaaaacctaatcagttgtcagaaggaagatatatatgaacaagagagaaaacaactccatggaactcagaaggagagtccccaaacatgaatttggcagtgatttttcaacactgtccagggagaacataagccagctttccaccatcatttggacaaatttttagtgataggacacatataatttatcaggctttattgtggtttcattttcttttggtttagattcaatactcaccagataacttctcagatgccacagtatgaggaatagggtaccctgtgtggtaagaggactattccccccattgtaaccaaataaactggcatttggcctatatggtaattttcttcataaactttataaaaaataaatatatattttgttgaggatacagggctagtgaaaaataaaaatatcaatataacattaaccttttagaaattagttagcataaattaacccttggaagcctaatcaattccatgtgtccagaaaaaaaaaaaaggattttatggtgctgtagaactgagagtcatattcaggaataattcatctcttgttgtagaaggcagggatcatagtcttattcttatgtacccagtgcttggcacatggttgaaaactcattattgaattatagagatggcaactccagacctatagtgagaacaactagacattttatggctctactcttagaattattctgacatcaaaagagtagttctgccatttctttaactcagcagaaatcattcattaagtgatgaaaatagaagcttctaaacaaaccagagccttaaaaggcaaataaaaggtatatgcatctgttagaaaaaaaatgggagagctatgtggtgtgtttgaggacaaagacaatctgtttcattatttttatttgtaaataatttttaattttattttgtagaccttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgtaagtttgagaacttaaatcactcttaaaattgagtaccattggtcgtgttgtttgcctggtttctctttacagtggcatcacatttattcttcagagcaccattagagtcataccattgaatgaaatttccttcctactcacgttcccaggagatatagtccaagtgaagctccagccaagcaacatcatctttaacttgcctctagagtctcttttcctattcaggcttggaatctgagaatgatatatttctatcccttaggtatagattgatttaaatgacagaatacctggaaactggtagtccttgaagaacatcttggcaaaaacaacatgaaattctgcaatttgattatatttgaactaagaataattttattagcaaaaaatatcagggtacagtataagattaccatcctaagaaagagatcatgatttagcgcgggcatggtggcgcacgcctgtaatcccagcactttgggaagaggctgaggcacgagaatcgcttgaacctgggaggtggaggttgcagtgagccaagatggcgccactgcactccagcctgggtggtggagtggagactgtctcaacaacaaaaaaaaaagaacgtgatttagctgttattttaatatttagctgcatagtagcagacaaaattacacctttattgtaattttcatctgcaaattgaaaagatacaacagccaatcagttttagctgggcatcaccttgttcaacttacagattgtttagtgagatgacttctagtctagatggtttattttattttttttctagcctcacctgttttccttcctattttccagtggccctttatggaagaccagcattcctggttttatgatcatatttttccttctaccaagtcctagtttctgttttacctattgtaatccctaaggggtaaaggattattctgtagggttttagagagatgttgattcattggtattttgagttgctcattattcaagttgtagtgcatttcttttttcaaaaaaatcttcctgttatttcttttctgtgtcttctggataatagtcagaaaaaggaaactcttttgcttggttttttttacaggtaaagaaacgactttgccagtcttcctgcttcctctgcaagtgacagaaacctatagataacagttacatatatttatcatttatcattttatcagctgaattgacagtagtatgagctcccatttttgtctactggaattagaattgtcctatatgggtgcctcttcacacccaaataaacaaaataaaactgcttggaatgtgatttctaaagagcttattatattcttaccaaatgtactaaagcaacaatgtaaatataaagccttgtggtctttctttttttcctcctttttaaattgaacagtcaatataacaactctgaagcaaattttgaagagtaaaaacatttaaaatagcctaaacaaatgtaaaatagatttttagtattgctgtcatactctacttaattattactataaccacctttatatacttactcatttttattgtaggagttgtttcgaattactgctttcagtgtctgaaagtgaactgccatgtgaagtctggctaccattccttcagtctctacaggtgagttgattttaactcagaaaagttttctgtatccaagacacctaattaattactcccagcaaactaaaattggaaccttagaacaaaaacaagtttattatatattgatattaggtcatgaaatgataaaaaggcccttcacatgaaggggatgtattaaaaatgggttttttaaatttggttttgtttgcctctacatagttagaaatcaacaaaaaagtttcattattcaaacataaagtttagacagcataaagctatcaaaatcatacatgattataaagtaacagtatttggatccttcatagcatacttattggtaaccttcaatatacaaaacactatttcattacatctaaggttcacctttttcttcctaacactttaagaattgtacctggctgggtgtagtagctcacggctgtaatcccaacactttgtgaggccaaggcaagtggatcacctgaggtcaggagttcgagaccagcttggccaacatgccgaaaccctgtctctactaaaaatacaaatattagccgggcatggtggcggacacctgtaatcccagttacttgggaggctcaggcaggataatcgcttgaacccagaaggcagaggttgcagtgagccaagatcgcaccactgcactccagcctgagcaacagagtgagactctgtctcggaaaaaaaaaaaaaagacataataaataatagaccgggcatggtggtacatacctatagtcccagctactcaggaggctgaggcaagagaatctcttaagcccaagagtccgaggctgcagtgagatatgatcacaccactgcactccagcctgggtgacagggctcatccctaaaataataggactcgtctctaaaaataaatgcatgcagtcattcatttattgatcactaattatgtaccaatcactgctttacactacattttacttgttttatatcttctaatcaaattacaaaccttatagtgtgagaattatttgaatctccatttacaaatggggagacaggtgaagagaggttaattagcttggacaaagttacacacagatttcaaaccctgagcttactttgctaactacttccttgaggacacagcttagacctgtttcatggaggcacaaataaagacatgcatattaacagacacacttcattatctgaacatttctttcctctggaatacataacccaaaatgaaatgatataatgttctctttagtgagaagaggattctttgtcatgttcttggcctatttaaagccctgtaatgcagtcctaatatctcacatatccgtacagctgctaaaatcatctttcatgcgtagcactttgatttttgtcactctgtgttctgaagcctgccagtcgttttgttctggcatatggcatcctagaagggcaaatcctaattaggactattactactatattaatactgtttgagtatcccatatctcaaatgcttaggagtagtttggattttggaatatttgcattacacttagtagttcagcatccctaatctgaaaatccgaaatgctccagtgagcatttcttttgagtatcgtgttgatgcttacaaagttttggatttgaggaacattttggatttcagatttttggattagggacactcaacctctatcctttttagagggaaatctctcatatttctttattattttcttagcttgcttgaataaaatagttgcctctttttccacttgcataagctttttcaggtttatcagatgtgtaggatatattttttaacatgtgttcagtaaataaatgtagtaggggtacaaataaatgttaagacatgatccctgttgaaatccaaaagataaaaagcccttaagttttcttattttatattataaatggacaaggcagcaaatggtattaaggatacttttggtaagagaatagtttttatcagagcaggctgcaggtagaatatttctcaattactatttacagctgagtaacttttttcctatggacataaaaatatacactctgcaaatgattttttaatgaaaaatgacagcctattttctgcaacttggttttttacataataatcatggacatacatctaagattgcatatgtagatctcctgttttgatgatcacctagaattctgttttgtggttgtgcctttaattgaccaatgtcttgctatttactgtaaatggtgcaagagtgaacatcttgaaaagggcggcagagtggtcttagcaaaaaaaaaaaaaaaaaaagagcatcttgtgctattatttctgtattgtagatttcaagaactgggctaggatatttccaccttaaaaagaaacaaattgaagttttaaaattattcttgaaatgctaccatagtttttgtagttttatagatttaacattatttttaaaaaataactttgctatattagatgtctattggtaacaaaggattacataccattcttattctgagtaaactgtattttgaactttaacaaatgagaaagtagagaacttttaaaaagaaactcaaactgtggtttttatttcagttgctgcatatcatggtgggtggtagtattttctgctaaagtgtaatggtacaggtcagttagacattataaatatgataaacctgacacctcaaatttttaacttttcacatggactttttctcctcactccaaagtaaacgcgagtcattctaagttaagaagaaagaagcctgaggacaagtcaagctgttaaagcaaaattgcagcatttgttaaatattgctattggtgaactaataattagaaatattactttctgtatcaattccatattttaagtcctttctcagtggaaaataatgcaacatattgggtgggtgtgtgggtgggtgtatatgtgtagtaaaagcctattttaacatgaaggttaagggatgggggagactttatatcttgtagttttcacttgagtgaatactaaactatattcttatgcctgtgaacatttttggcttatattttccaaagaaatgttgacgtaaatggaagcttatgttcctagagaatttcaggagtttaaaataagggaaacaaattagaattttagaacatgggaacaagctcaccataatcaataatactcagtagtaatagaggacagtgaaacatatacgtaatcatttatactgaattacatttctgactccttttccctcacccttgaatataagaactttaatgaacaaactattggtaaatacattttgtttgctgagttaataacttagacttttcaggacattttatatagagccacctgtcatttaaatagcaattttttagacgaatttaaacaattatataatgatttgtgtcactaagtaatactcctgtaattcctgttagaggaacaggcagcctgtgtgaatactgcagaattctttaaaagaaagcggcaccaatggctttcaaataattaaatgggcacagtggctcatgcctttaatctcaacactttgggaggctgaggcaggtggatcacctgaggtcaggagttcgagaccagccaggaccaacgtggcaaaaccccgtctctactaaaaatacaaaaattagccaggcgtggtggcaggcgcctgtaatcccagctacttgggagattgaggcaggagaatcgcttgaaccaacaagagcaaaactccatctccaaaaaaaaaaaaccaacaaaacaaaaaaaataaatcagcctccaccagggctatcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaacttattttctgggtgtgctgttcttgttctaggagtcacatgatgcattattggaatttgggaataataacctacaaatattggttcatgttaccaaggaaggggtgtggaaaaacccagttcttcttaaaattctgtctcaacagccagtagaaacggaggaaggtaagtcttaagactatattggatgaggatttagttctgagaacgttggaattgattatgggttaaaattttgggaatttaacttgtgtatatatctagtctttctgtttttactttgagtagtaaaaattaactattagcatttaatgttttgcttaagtaaggattcttgcactgttagttttaagtccctttacactcatttttaaattttgcattgagtagcaatgttcatacaaagttcctgagacagaaatgaataatctgctgtaatctttggtgtgtggtagagctttgcttatacttttcttttcttttttttttttcccgagacgttgtctcgctctgtcacccaggctggagtgcagtggcaggatctcggctcactgcaacctctgcctccagtgttgaagcgattctgcctcagcctcctgaatagctgggattacaggcgcgcgccaccacgcctggctaagttttgtattttttagtagagacgaggcgttaccatgttggtcaggttggtttcggactcctgacattgtgatccacctgccttggcctcctaaagtgctgggattataggcaagagccactgcgcccggtctgcttataccttttttattggctgcaacaactgagggccatgaaaaaagttttttttattttatatatatgaaataattggaattcattgttttatagagagatgcaaagaatgaagtttttgttgtttttgttttgttttgttttaatttgagacaaggttttactctgctacccaggctggagtggcacaattatggctcactgcagcctctacctttcaggctcaagtgatctgcctgcctctgcctcacaagtaactgggactacaggcatgcgccactgtgtacagttaatttttctattttttgtagatatgggggtctcactatgttgcctaggctggtcttgaactcctagactcaagagatcctcctgccttagcctcccaaagtgctgggattacaggcatgaaccaccatatctggccagaatgaaatatcttatttgcaaaattgtcagtcgaagaccagaaaaattatgtatttgaattgacatttgcattttagatcacaaaagtatcttctttgatagagccaacaactgtaacttcatttacgtcaagttagtggaaagttcaaaggattacactctgttaagtacattttttgctataaaaacagactttagaacaattattacacattttgagatatctttaggtcttagaactagccatttgattgtcgatcctttaaaatatcccagttagtttatccattcaccaagcttaagcacctaccatatacatggtgtttggacctctctgtatagtgagaagatgggcataaaggcacttagattttctcttgatccgtttcctctgatcattctagtgcttaccagttgcactgacaagaaaaaaaaagaataaggaaaagtgctgttaaatagaaaaagcattggtgtttatagttttccattgaggtcctcaataaacggcatccccttgtaaatgtaggtagatggaggctaaagtatcacctttgttattgacaaaagctgttagaaccaggtaatttcagaaacatcccagaattgggcagatcctatccagataagtcttgactggggcagaggagattgcatgttttgtgcaggcaggcccaagcccaagaggaaaaaagggtggggttgagttaaacatccttagtgtattttcccctgatatactaatcaactatgtcaccccacctctggagttaacagtaattaatcatttttaacatagaaaaacatcaagaaatggggagaagcattgcttacctaacattcttggtatcctgtttattcagtaaatattaattaagcactcactatctttaagactctgaataggtacatgatacctacatatccaaggaattatgttgaggaccacagtataagtggtgggtaacatgtagcctgcctcctttcacagttggcccttaatctaatttcaggtcaaaagattaaaaagctttctttatatctctgctgcccctgcaggccagatatttaacatatttgataccaaaaagcagtgatgttcatctcactgattgtcttctgtaataagtgccaattgttgataattttacctgatattcacctgacatgatcagtaaagatgccatggaagagctgtttttcttttctgtttttttttgaaatggagtttcgctcttattactcaggctggagtgcaatggtgtgatctcagctcactgcaacctctgcctccggggtttaagcgattctcctgccttagcctctcgaatagctgggattacaggcatgcgccaccatgcccggctaattttgtatttttagtagagatggggtttctccatgttggtcaggctggtctcgaactcctgacctcaggtgatctgccctcagcttcccaaagtgctggaattgcaggtgtgagccaccgcgcccggcctctttttttttttttttttttaaagacagcgtttcactcttgttgcccaggctggagtgcaatggcgtgatctcggctcactgcaacctccgcctcctgggttcaagtcattctcctgcctcagcctcccaagtagctgggattacaggcatgtgccaccacacccggctaattttttatatttagaaatgagttttcactatattggtcaggctggtctcgaactcctgaccgcagatgatccacctgcctcagcctcccgaagtgctgggattacaggcgtgcaccactgtgcccggcagagctgtttttcaactggatcttaagtgttactgtttttacataatgaagtatatagtataagataaagtgtcatgatgtctgcacctttcttttaaatggttctgaaaaagagaaggcaaagaaatgcggcaaaccagttcaattgttaaatctagttggaaggaagggtataaaactaaaaaaaaattttgtattgaaatgtttgaagaaatgagatacagaaaggattgtgattgggagtgagacatattgttttaaatattgaagcatatggtagatttcctttcaataaagaaattcaaagattgatatcttcaaatgatttgtaaaatacaagattgagccatatgttaaaattgatttagcagcagtttaactgtagttataattattgaataaaatagcttaccgcatagaaataatagctatgatttttagagtgcctgctatgtgttgggcactgtatttgtgctttcatatctcatgtaatccatgaaacaggtgagagattacacatacccaagaccatgtagttacaattgtggaggcagaatttgagcccaggtgaggtgacgttaaaatgtttttgattggagagtgatgacccttcagttgctaagtgcatggtttaattaaacatccgtaatatacaagcccttgtgcttagtgctgtagggaatacaaaggctaacaagacatgatatttgttcacaaattgctgacagtgtaataaaggagatatcagagacaatagtaagtactattaaacatttactccgtgtttggccttgtggtgagtcttatctgcatttctagtatttctttaatttgttcatccatgtgagatgggtataacctttttacagatgaagaaacttgagtctcagagaggtcagttaatttgtccaagggtctcacagctgtgtgtcagaatcaggtttcaacatcagatcagtgattctaaaacctgaaatgttaacgtttgtacactataatcccttatcactgttcttcgagaaaactaaatgtggggaaagaagtaaaatgctgtgggaatttgcaaggcgataggttgtgtaggtaatatgcctgttatcaggtatgttgcttcctgttggatttgcagaattgcttacaacctcatatggcaggtaaatagagcagaatctgatgttaggcaggcagaataggatataggggagacgtgacaggaaataataggcatgatttagattggagataattagaaaagaattactaggacataataactaagttgatttccttgaggaaaggaagtatcaaggaaagataattccaaaattttattgttgtataattgagagaatatcattgctgaaaatagaagtagggaataaggagctatgtgagtgaagggtatgaccgtgagttcatcttgtggaatttagtaactgtgggactaaaatggaaaagtccaagtgattgtgacctgttttccctccatgctttttgaccttgactacatattagagtatctatggaatttaaaaccaaaaaacatacatcccaaggtccagactccacttgctaaatcataatctccagagttggagctctggaatccagaactttttgaagtgccttaggaaatgggcacttacatattgctgatgggaatataaattggtacaatttttggagagcagtttggcagtatgagtcagtattacaaatgaacagagcctttaatttagcaattccgcatctaggaatttgttgtgtagatttattcacatgtttcagattacctgtatatagggttgtaagttgcagcattattgatgattgacagagattggaaacagcctgcaagtgtatcagtaggggattggttaaataaattatagcacatccataccacataatgctattcagttgttaaaaataagaagatagctctaactgcacagatgatagaataacctgtatcatatattaagtggcaaaagaaaatgtcttccatactcatagaatatttctggaaggataaacaagaaattggaaacttgttgtttctcagggtgggaaaccagagcactggggtcagggtaggagggagaaaaactttaactgtatagctttttctgtccttttgaaatctgtgattatatatatatatatgtttttctttatattattttaaaggataatgttacgattgattctcatatgtagttaaaattgggccagtggtttatccttagtataaaccattgctactctacacacacacacacacacacacacacacacacacacacacacacacacacacacacacacacacacacactggtttatccttagtataaaccattgctactctacacacacacaccccagtggtttatccttagtataaaccattgctactctacacacacaaacacacacaccccccccacacctcacacacacacacccccccccccccccccgcaacctgggagcttgtgagaaaagcaaaatttcaggtcccagacctaataaatcagaatctgcattttaataagctccctaggtgatctaggcactttcaagtctgagagatactgttttagattaaccacctaaagcagtttgtttactcaccacttggcttgacatgcaatattctcacctctattctttaagtaatactatgtagtgatgtcacatacttgttggatatttactattcaaaaattgagggctcggccgggtgcggtggctcatgcctgtaatcccagcactttgggaggccaaggcgggtggatcatgaggtcaggagatcgagaccatcctggctaacaacggtgaaaccccgtctctactaaaaatacaataaattagccgggcatggtggcgggcacctgtagtcccagctactcgggaggctgaggcaggagaatggcgtgaacccgggaggcggagcttgcagtgagccaagatcgcgccacggcactccagcctgggtgacagagcaagacttcatctcaaaaaaaaaaaaaaaaaaaaatttgagggctcatccagagcactgtacagtcaatgccaagtgcctaatattcagtacagctcagaagtactgagcttcagtacttctgaagctttcagagtagcattttccaaagtgtgtactgaaccaggaacacatgttttacaggttactaatatgtataaaagggttctctggtcaaatcagtttaggaaacattgggtttttaaataaaagtgaacagttttctttattgcaggactgttcagagatttgaccaaggaatcctttttttttctaggactatctctcaggtcttttggtcggtggaacacactttgagaaatgcctggtttagaggaaagagcaccactggctttggaatccttggcaagttacctaacttctgtgaatattaattttcctaaccttagactggggataataatacttgccttggtggtggtgtgaagaataaatgagaggtatataaaaatatgcagcttaaaacttgatgtctcgtaagcattcagttgatagttgttaatattacataggttacttgcttcatttcttgcatttatgcttatagttcatttcactatttcttaattttcctctcatctctattagatgaatattgagaccagagtaaacttctcatttatataaactaaatttttattaactaaaaatcaaataaaaagatctcaaactttcatcttagcaagtctgacatgttatgtggtatgttgtcaaactgttttatttttcattttttctagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggaggtgagtaaataattgttgtcattcaaacttggtattaatttaatagatttatatatatattgcatggtttattttttccctttagaatgaaaaccaagattcatttttttcaggctaccaaaatgtatgattttaattgtatatttaactgctcgacagatagaatgtaatattttagagtgaatttgaaaagtagataactaaagaatatacagaggcatgtttacttatttgggtgatgatttgctgtgaaatctttaaatgtgaaagttgttttttctttttaaagtaatgacgtctccatgtttggggaatgcagaagttgttaatcatggcatcaagggataaactaaagaaaatggcacttaattttagcttaagttactttatatatttaattttgtaagcagaaaagtataggactctagattccatgactacatcctgaacaattaagtggccaaactggatatcatggaaaataagggttgagtctttttttttttttttttttttttgagacaaggtcttgctctgtcacccaggcaggagtgcagtggtgcaatttcggctcactgcagcctctgcctcccgggttcaagtgattcttgtgcctcagcctcccaagtagctgggactaaaggcatgcgccaccatgcctggctactttttgtactttttagtagagacggggtttcaccatgttggccaagctggtcttgaactcctgacttcaactgatccacctgcttcagcttgtactactaaaagtacaaacattagccaggcatggtggtgggcgcctgtaatcccaggtactcaggaggctgaggcaggaaaatcgcttgaacccgggaggtggaggttgcagtgcatcgagatcgtgccactgcactccagcctgggtgacaagagtgagactccatctcaaaaaaacaacaactattttatgtatcagattgcatcctttaaaaaaaaaaaacctcaattattatgtttcttaaatttggagttagacttctctaatggtttttgacattatacagaaaaaaactagagattcttaagctttatttcatcatctacctttaatcctcttatctgccattcaattctgacatatggattcttactctgaactgaaattttttattagatgtagtagtcccaaggatctggttttatgctgtagtaattctgaaacttttacttgtaatatcttactctccaaatacaattgtctatctttctaccttactccctttaatatacagtctccaccaggatcaatcaagatctattgatcttgtcaccttttcattttcccttatcccccttatgtattcacttccctatttaactctgctttgtcattgtcagatcatcattatcactctcaaagagcgagaggtcctctctcttttttttttttttttttgacagagtctcgctctgttgcccaggctagagtgtagtggcgcgatctttgctcctgggttcaagcaattctcctgcctcagcctcccgagtagctgggattacagtcgcccaccaccacgcctggctaatttttttgtatttttgtagagatggggtttcaccatcttggccaggctggtcttgaactcctgacctcatgatccacacgcctcggcctcccaaagtgctgggattacaggcgtgagccactgctcccggccactggtctctctcttaattgtacttgtttgactaccagtatcctgattatccctaaatcttcacctactctatgtgtttacctgcactcatggggccaaatttacatggagaaaaatctgccagctaattttactccaggctagagtgtggtggcgcacactgctcactgcagcctcaaaatcctgggctcaggtgatcttcccacctcagcccctggagtagctaggaccacagaaacatgccaccattcccgattaatttattttttatttattttttatttttttggagagacagggtcttgccatgttgcccaggctggtctcgaactcccagggtcaaatgatccgtccacctcagcctcccaaagtgctgggattacaggtgtgagccactcactgcacccagcctatatttctttagcccattcattctcccactcttagatagttgcatagttttttcttattcttcaaaactatactgtaatactttctgccctgtttcactctctgttgctgaacttaactccctatttctctgaaaaaaattgaagcgctgagaagataaataagagaattttcataagctctgtctctgaaacatctattcatctaccagcatctatgaatgtacatcttctcttctgttactagagataaattatatctgttctcctagctaaggccagcctccctcacttctgtatttcaattgatgttgtctcccttaaggataatgctacagcagttctccttttctctattacatcatcgatttccctgtctctgttataaccaccccattggcatttatgctattatttattctgtccttaaaaaagagctcttcttaggtccagaggtggtggctcatgcctgtaatcccagcacttagggaggccgaggcacaagaattgcttgagcccgggaattgcttgagcccaggaggcagaggctgcagtaagctgagatcacgccactgcactccagcctgggcaacagaacaacagaacgagactctgtcttcaaaaaaataaaataaaataaaaataacgctgctttagatcctgtttctacttttagctactgccccatttccttctggctttttaagcataatttctttaacaaattgtcttaatttactatcgaacattttccttccttctttttttttttttttttttttgggacagagtctcgcactgtcacccaggctggagtgcagtggcacgatcttggctcgctgcaagctccgcctcccaggttcacgccattctcctgcctcagcctcccgagtagctgggactacaggcgcccgccaccatgcccggctaattttttttgtatttttagtagagacggggtttcaccgtgtcagccaagatggtctccatctcctgacctcgtgatccgctcgcctctgtttcccaaagtgctgggattacaggcgtgagccacggtgcctggcccatttttcttctttcaagacattctaatatgacctttgcccctggcagtataccatatcactaaatctaatgatgactttcagttttctgtctacctcattgattactcctttctcagttctactttgctgtctgatgagtacatgttgcagtacccaatgactctgtcattgggtcttctctttttacacttaactaggcttatttccttcatctttggctttaaataccaactatggtctgactcccaaaagttttctctccagccctgttccctcctccaaactccagacccatatccaattgcctaattaccatctctacttacagatttaacatgtccgtaactaagctcttgatattcctgatatttggactttgcttttatgagggttttttttagtcctcactatgtgtttggcaccatgctaaatgctttatatactttgctacatttaatcagcacaatagctctgaggtagctccattttattgatgaggaaagtcaggctcagattaggttgtgtgcttcaaggttacaaagctaaagtggttaagctgggattcaaacctgagtttggtgtactaccagtaatattatattaaagacataggataaggaatattatccttgttggtatttaccttagagtttatatgccaaatgctgtgttaggcattggggttcaaagatgaatgcagaagtctctggactggcatacttggttttactgttggcctctacattttatcttgaaaatagccagaataatctctctaaaacttgtcgtgccatgccacttctctgcacacaattatctaatagctttccatcttactcagaatacattcagaattctttattctatgtgccatgggccctggctacttttctaacgttctctcaccttatcttgtaatcttagtgcccactactctccagccgccttgtctttgctgttctttgaacaagccaaggatgttcctgtcttagagctttgtgcttgctattccctctgacgagaattgccttccacaagataatttgaatggcttactcccttacctcatgtctgctctaaatgttctcatgtctgttcaatattaccatatcagagaggccttcctcgctgtctcatctaaaatattaccctagccccctactctgccctaaatatctgctgtcattattataaatatatactaacccatttaaaatgacccctatcactttgtctttctgcctatttgtattttcttcatagtacacattactgcttctactaggcatcatatttgattattcggtatttcctcccactagattgtaaactccggaaggacaggaacataggttgtttactggtatatccctgtattctagaagaatgcttagccatgtaggcactcaatacttattgaatgaattaatgaaaggtatagcctcatcccttgatcttttgttactaggatttctagctttattacctgagttatgaccagaatgtcaaagctggaacattccactcatgctttctaagtttttaaactttgcttggaggtctttttgaattttaaaattgtgattttatatttctctctctcagctttattttattttgaaatatagttatgctatctgtatatttataaaaataagaaccaagatgaaaccaagtacagtgttgtgattcagatttctgtataggttgattgcatcctggatcagtgcttgggtcaatagttatttcaaatggctaagaccccctgctatggcccagatcatatctcccactgtgagaatcttttatcagatttttttgttgaaaattgttttttttggagacagagtctctgtcgcccagcctggagtgcagtggcgtgatctcggctcactgcagcctccacctcctgagttcaagcagttttcctgcctcaaccacctgagtagctgggattgcagacgtgcgccactacacctagctcatttttgtatttttagtagagacagggttttgccacgttgcccaggctggtctccaactcctgacctcaagcaatctgcctgactcagcctcccaaagtgctgggattataggcgtaagccaccacgcctggccccttgttgaaatttaagatgtacttatatctaagatacttcccagtggccaaaatactgactccaggaatttgtgattctgtcctggctcctagtagtctttgcatttctatcaactaacgtattttttcaagtgctcacagactttattctgggatggatattgggttagcaacattccacttggaagcactgtggcctggtctttgagatttagtagtaacttgaatctgagaggattgtctaggcagggaaagtatagatagagacagaatgctagtcatctttgttttggggaatgaccttacacaggagcacagatacgggatgcagagatgaaacagccagttggtggctatgaagtggacaacatgtagtttcctcaaatggggattgaagctatgacctagggcctcattaataaatgttcttatttgttagactttctggtgataaagaaatcaaaggataaaatgctttgcactgcctgtcttttcagactttctacttgaatcttaaatataactgcagaaaacatttattgctcacttgtctattccaagcactgtgctgtgtgctttaaatgtgtcggtatctaatccttataaaaatctattaatttaggccaggtgtggtggctcatgactgtaatcccagcactttgggatgctgaggagggaagattgcttgaggccaagagttcaagaccagcctgggcaacatggtgaaaccccatctctacaaaaaaaaatgcagaacttagctgggcgtggtggcatgtgccgtagtcccagctactcgggaggctgaggtgggaggattgcttgagctctggaggtgcaggttgcagtgagctgagatcacaccactgcactgcagcctagatgacagagtaagaccctgtctcaaaaacaaaaaaactttgaattttatagaaattaactgaggctctgagagatgatattactggcgcatagtagtaagatgtccagtaagtggtgtgcccagggtttaaatccaaggtgatctgcctctgctttgcttttatacatattaatctgacactcacacatctcatgtacatgatccaactcactgtcactgccaaccttctggttctttctggattctggttcttaaagtagacttgttgtgcaggcaagtttttatttcttttgtttacccagaggggaaacttcagaaaagatgggaggggactttgaagttctgaggcttgtgggtggctcattactggactggatttactgaggagcttaggtagagtatgtttttcacaagacatctagagaagtgaaagcaacaatcaaaatatgtaggcttgaatcttgacattgtcatttactagccatacagccttggccaggtagctttattttccttatctataaagtaggcacaacagtagtagccgtctcacaaaatggctggatagtttaaatgtgataatatctaaagcacttaacacagttcttggcatattttagacaccttacaaacatagaccctagtataagaattctttaagcctggggtgcagaactagggaggatccgtcgaagtcaagattgatcagaggtgaaacctgaatttgcacagagaaacaatgtggtatacacagagatagcctcctatgacttcatctacatttttaaaagcagtcatatgggctggacagagtggctcatgcctgtaatcccaacactttgggaggccgaggcgggcagatcatgagatcaggagttcaagaccagcctggctaacatggtgaaaccttgtctctactaaagatacaaaaaattagtcaggtgtggtggtgtgcgcctgtaatcccatctactcaggaggctgaggcaagagaatcacttgaacccaggaggcagaggttgcagtaagccaggatcgtgccatttgcactcgagctggggcgacagggcgagactccgtcttaaaaaaaaaaaaaaaaggcgatcataagagaccaactataaacctgtatgctaatttatttatttgcagtatcaggtagtgtaaggagatagattgcttacctctaatagcagctgcagtattttatgtttgggaaagttaatcagactgagatgtagtaatggttattctcagcacctgacacatgccaaaacaattcaaaagcagcagcaaaacactacattttgggtttgattcctcatcctgtaataataacaactttactctctcagcctttgcttaattaaaacccgttttgtttctaatgttgtattaggcattggcaaatacagcaaactgtatggcccagtttgtttgccaaaaatagttacagaaagagaagtactaagctcaatgattactgccctaaattcagtagaagtgtaaagatagagaattctgtgtttatagaaaaattgatccttgaattggagctttaagtaatggtggggtttggatgggtggaaagaatggtttggagatgactgaatggtagtaaagcacaggtactaatgagtactttgcagggatccactggagaataaataccctgcttagggcagagtggttattgaagtcttgtgagaaataagacctgttggggttggaaaagaagggcttggaaactccattgcattaatggttagatttgatgcagtagaaattaagaaggctttgcagttaggaagtgacatgtctgaagtggtgttttaggaagactagacagaaagaatatgtattatgtttaggacaagagattgtagccagcaagaggacaaaggacaggacttgctgaccgggcaaaaacagaggaggatgtacagagataccttcaagaggctcataaggcttctagcttgggagactggaagaatagtggtgctctgctgctaattagaagaaagaatgggtggagggacaagggagagtctgggaagatgataagctttgttttatacatgatctttcctggtttattaataacaatgtttggaaacaggatttttcctgattgtgttgagtttgcagggaactgtgttataggaaatacgatttgatactattcacaacagggggttggcacccacccagctacctgtttttataaataaagctttactggcacaaagtcttacattcatttcttgtctgtggctgcttttgtgctacagtggcagaggtgagtagttgtaacagaaactctctggccagaaaagctaaaaatattttctgtctgtccttgtacgaaaaatatttgctaacctctgctctacaagaattaaattttccagtctatttcagtggtttaatatcggttggtctaaccctccgtgttctacacgtgatgaaactgaagccaagctgataatgtttccaaggcccttcctgcattaagctaattagaaaggccaagcccagctggaatgcaggtcacctggctccttggtcagccttctttccactctaccacctatttccatgtgttagacattgataagccatggtctgattgggaacatcttggtgatatatcattctgttcatatttatacatataggtgtgatttaaaacatttttatcatgatgtggattaatttgttaaatataccaatgcaaaacatttagtacacataaagttatcttaaaattattttaaaggaaccctagtatcatcgtatcatcataactagtcagtctttttttttcctttctttttctttgagatggtgtttcactcttgttgcccaagctggagtgcaatggcgtgatatcggctcactgcaacctctgcctctcgggttcaagtgattctcctgcttcagcctcccgagtagctgggattacgggcacgtgccaccacgcctggctaatttttgtatttttagtagaaacggggtttcaccgtttctactggtgaccagctggtctcaaactcctgacctcctgttatccgcccgcctcggcctcccaaagtgctgggattacaaggcatgagccatcacgcccagccactagtcagtctcttatcctagtgatacttttcttttgcaagtgtcaacagaattaaaaataatctgtagtttgctttggaaaattactagtgagtcaccagatgttgattaattagagtttaaattcagcatacgttctaaagtagcagagttacacacatatttgccatctacttcacctgagttcaggagaagagttaacttgagcaacagctgggaataaaagtacattgtatgttggtacctgggggtatcccaataataggcatatgtaatgggaaaccgctgctggggaagatttagccagacacatacaattaagattaattgactgggtcatctgaaagtcaaaattcagaacctagtgggtaaagagtgagtcctttcagatatctggtaggtctggaaggcagaagaatttcatggaatcctggagttttaggttgtgatactttatttatgtagaattgaatgagatgacattgctattaactttacatattaaaggattttaataaaagttatagacttggcagtggctcagtgtcccaagtggatgtttcctatattttttcattactgaaaggggaagtctttgcaaagatcaggttttcaacatagaaaagataacattttaaacatcaagcacttctattttaaagagctcaagaaatctgtcagcagagttcttggcgcagttaaggcaggggtccgtttcattcttaatccctgaatgaactacatcttcggtatctgacgtggttgatagacacaatagcagatggttgtttcttttcctgatggggaaaggaaaggacaaacaggatccaatttacttaccagcctaacactgttgggaattgacacagtcactaggtataaatgatagagcagatacctttaaacaggacccagtgggaattcagtttgggagtagaagaaaaagtaaacaggagtatagaaattccagatgtagtttaagtaagaatcaagattaagatgaactctgaacaaggaataattacaaaaggtttaattaagtttaaaatatgccacctccaccaccttcttttatgctaattggctgcctgttagaccattggtgtttaattgcctgattattttgaaagtcttaatacttctactttatccttgtgatcatacaaggaatgagataatacactcagaatacactaatgacagaaagtctgtgtaaagaaattgaggatttgcttgtttaggtattttatctcctaaagcacagttctttcaaatagctttgaagagacgtcttcccagaactttgtatgcatctggatctcacttctgatcttactttcatgggttatgtgtgggtattttggttggtgtatgattgcactggagggggtcattatgaagagtcgatcagacatattgtcaagaattcagcaggacgtttcagccttctttcagatacacactgtgatagggtttaaatggaagcattggtgaccatttatttctttaagaaatatacaaggtccgtgcagcatcatagtactggtctgtagcattactgcagtttaaaaggagtctcatgtttttaaaactggtcagtattcttttttcccaggtaatgtctttgaagctaacagatgattttcccaaagatatctagggttacttgaaatgtaagtttgctaactgtaactcccacctttcttctactcaaggatgcaagtgaatgaagtattattatatgaataagcttaaatctactttgattcctttttgaaaaaataaaacatttatcaactttgatttttaaaatctattactaggaacaaattgttttcagtatacctcagaactaatcagggaaatactgcattgaaaaccactattctagagaaaggtaatgataaaatattaatggcactggccggaatactagtttacattgatagcctaagcaggaaaataacttaggaacgtaagtatgctgcctgtacccaccttctgttatgccagttggctgcctcttatgcctgttattactgttgtttaattgcctgattattttgaaacctttctaactgtatctaatcttgccttttcctaatttgttttctgcagtggccaaggtgatcctttttcttttttaagtaaaattagatattttattttgaggtaattttagattcacatgtaattacaagaaataatgcagaaatgccttccatttattcagtatacattcattggaggtgtctgctgggcaatggggttacaagaatgaacaagacaaaagggagagaaacaacagacagtgttcatacaatgtgagatttagaggtctgagctggaaattaagagttctaatcaccatttgaaaccagagagtgaataagattaacttttttagaactctgaaaaataaaggctttacagcaatctgaggaggttttactcaagaaaaagaaataaatctcataagaatatcacctttgacctcagctggtaatatgcctgtcaggtggctcaaatttttttgtcacactgcgcatgtttgtgaagtgatcacagaagtgctctgattattgatttgggggttttacaaataaattttagcaagtaggctaatacacaaatacagaatctgcaaatagtgaggcccaactatatattcagagaactaaaggaaacatgcttaaagaattaaaggaggccaggtgaggtgcctcacacctgtaatcccagcactttgggaggccgaggtgggaggagctcttgagaccagcctgagcaacatctacatgtgcaacatgtagagaccctgtgtctacaaaaaaatttttcaaattagctgggtgtggtagtgtgcacctgtagtcccagctattcatgagactgaggtgggaggatcacttgagcctgggaggtcaaggctgcagtgaactatgatcatgccactgcactcccacctggacaagagtgagcctgtctcaaaaaaaaaaaaaaaaaaaaaaaaaaactaaagtatgagaacaatgtctcagtaaatagagaatatcagtaaaaagacaaattataaaaaaccaaaatgaaattctgaagtcaaaaagtgcagcaactcaagttaattcactagagaaggtcagcatcaaatttgaattaccagaagaaagaatcagcaaacttgtccagtctgagaaatgatagagcccaaaatgcatgaaatagcagaatcaaagaggcaaatggacaattcaaacatgagagttggagactttaacacccactctgaataatgggtagaacaactaggcaacaaagaaatggaagacttaaacaatactgtaaaccaactggactgagcagacatctatagactactccacccaacagcagctaaatatacattcttctcaaatgcacatggtctattctccaggatagaccatgtgttagcaagtaaaacaaacctaaataaattttaaaggattgaaatacataaagtatgttctctaactacagtaaaataaaattagaaaccaatagcagaaggaaatttgggaaattcacaaataagtgaaatttaacctaccttcccaaataaccaatggattaaagaaaaaaaaagaaattagagagtaagtttttgttgtattttgttttgttgtttttgagacagggtctcactctgtccctcagactggagtgcagtggcagaatcatagttcactgcagccttgaacctcctgggctcacgtggtcctcccacttcagcctcccaaagtgttgagactacaggcatgagccaccatgcccagcccagaaaatactttgagatgaatgatgaaacacaacataccaatatttatggagggaaatttctatttgtaaaatgttgattttaaaaaagaaatatcttaagccaataacctaacgattcaccttaagaaactagaaaaagaagagcaaattaaactgaaagcaagcagaaggaaggaaataataaagattagagtataaataaatgaaatagagaatagaaaatcaataaagaaaagtaataaagttctttgaaaagattgacaaaattgatatactttcagttagactgaacaagaacaaagagaatactcaaatcaggaataaaaaaggagataccatcaaccttacagaaataaaaaggattataaaggaatactctgaacaactgtttgccaacaaattacattactggatgaaatgaacaaatttctagaaagataaaacccactgaggccaggtgcggaggctcaacgcctgtaatcctagcgctttgggaggccaaggcggatagatcacatgaggccagaagtttgagaccagcctagctaacatggtaaaaccccgtctctactaaaaatacaaaaaacaaatcagctgggcgtggtggcacacacctgtagtcccagctactcaggaggctgaggcaggagaatcgcttgaacccgggaggcagaggttgcagtgagctgagattgtgccattgcactccagcttgggcaacaagagcgaaactctgtctaaaaaaaaaaaaaagagagagagaaagaaacccacagaaactgactcacagataaatagaaaacctgaatatacctatgactagtaaagagggtaatttaaaaatttcccacatccacagggcctcactgtacaaaacatttacggaagaattaataccagtccttcacaaagtattccaaaaaatagaaaaagagggaacacttcccaacttatgctatgaagccagtattactttgatactaaaaccaaacaaaggcatcctaagaaagaaaaccacagaccaggccaggtacggtgtctcacgcctgtaccagcactttgggaggcagaggcgggcagatcacttgaggtcaggagttcgagtccagcctggacaacatggtgaaaccccgtctctactaaaaatacaaaaattagcgaggtgtggtgacacgcacctgtaatcccagctactcaggaggctgaggcagaattggatgaacccaggaggcggaggttgcaatgagctgagatcgtgccactgcactccaacctgggtgagagagtgagactctgtctccaaaaaaagagacaagaattccagaatgtccactcatgcaacttctgttcttattgatctctttgcctctatattctcctcaccttctcctttttttctgggctgttgaatacatctgtaaaaactcttacttaaggctgggtatggtgactcatgcctataatcctagctctttgggaggcttaggttgggggaacatttgaggccaggagttcaagaccaacctcggcaacaatatgaaactccatctctacaaaaaaataataaaataaactgggcatgatggtgggtgactgtagtcccagctaccttggaggctgaggcaggagagaggatcactggtacctaggagttcgaggctgcagtgagctgccatcgtaccactacactctagcctgggccacggagcaagaccctgtctcttatagtaaaaaacaaatgggccgggtgcagtggctcactccagtaatcctagcactttgggaagccgaggcgagcagattgcctgaggtcaggagttcgagaccagcctgggcaacacggtgaaaccccatctctactaaaatacaaaaaattagctgggcgcgggagcgtacgcctgtagtctcagctactcggaaggctgaggcaggagaattgcatgaacccgggaggcggaggttgcagtgacccgagattgcgccactgcactccagcctgggcaacagagcaatccgtctcaaaaaaagaaagaaagaaagaaagaaaaacccaactcctacttaagtcacaacatagcataaggtaaaagaagtaacatataaccagcatagtatcacctttctttaaaatatgtatatatttgcagtagtcacatattaaacccatgctgtgtaacgtgtatgtagacataatactggaaaaaaattcacattgttaatactggttatcattgagttgtaagatttaaggatagtttttattctgttttctaggttttctatcgtaaatatttttgtaatgagcagaaatctagtaaatagtaattaaactacaggtttcaagtgatttcttttggatgtatatccaagtgaaaacaacaaaattatctgttttccccataaaaccccatgagtaagtttcagatcctttagtcttctgttatcattggcctgtatgataactttgtggaaatcagcaaaaagtaccatcaccctctaactccaccttcatatggttgcctttcaaaggtcttccgtcttctgagggcaaaagcctcattggggcttgacaagtggactgaatttcagcccccactaactcccttggctggttacttttgtgccatgcaaaactgcacaactctgtgacatggccttattcagtctgtctttcccccagtgtatgatttagctctatcctaagtctctaaacttgtttaatttaacctttcattcactgagtgtcagctacgtgacatcacgcattgccgttacatcagataaccttttccctcctcacatgccacaattactctcacgttaattagtttgctcattccagctttgtattttttgggctacattctcccctatccatctagactgctatctccccgagaattcttttccttggaatctttgtggcttccttcagtcagtattattcttcctgtcttcagttttctgtcccatttattcttcatgttatttatcttatagttatttttcattctaacaaatagttattgatgttcattcatgggtctggcactgttgtaggcactgaagatacagtggtgaaagaaacagacttttgccctcagggaacttacattttagtggtaaaatagtaaacataattgattctttaaaacacgtgttcagtttgtcttaatagctatagaattgtaagccccaggactagaaattatatttaagaacaaaaaattgtttcagtatcttaagtataagatgtttcctagatactcattaaaactctcaaaagtttgttggtgaccttcattttaatttactttagctgagaagtattttgtggcatatatttgttttttagtgtggtcttaggtatttattgcaaaagattgaggacaagtagtataaccatattttattagtgaggtgttatctcattttaatttacatgaattttttaagttatttatttacttttatttctttatcatatcttttcctctatattcaagaaggtacaggtatttggggcataatactgagattctcttcaagtcaaaggatattaactgagtgcttgtcatgtgaagatcctaaaacaggtgctaagggggataaaagtataaaataagatctagtatctgttttcaagggatttagagtctataaggaagaacagataacagatatgaaaaaactctggcttcagtttttctcatttgtaaaaatgatcagatgtctcatttagttaaatgacagtggaaaataagtctagagtgatattcctgttattagctcagataagtgggtgcaaggcaaatgagctcttgaattggaagcttatacaaagcccacactataaactagttccgccttcacaatagaaaccttgatggaagtaaaacagtcaagttaataggtaatgaaaatgtgtgtgtgagataccatgcttaggagttatgaacctcttgatcagaaatttaattatcaggcatattcgtgtattttaaaatgccaggtaaacagcaatattaagagctaattaaaagaatgttagtatttgctgaaactgcataattggagaaagttaagtttaatttgagacattggtagagaaagttaaactttgcttgtttaggccagtgcaggagcatgtttaccaacaatccctgtggtaacttagaaggcatggagataatgataatagaaaaacagaagtactggccaggtgcggtggctcacgcctgtaatcccagcactttgggaggctgaggcaggcagatcatgaggtcaggagattgagaccatcctggctaacatggtgaaactaaaaatataaaaaaattagccgggcgtggtgtagtaatcccagctactcggggggctgagacaggagaatcacttgaacctgagaggcagaggttgcagtgagccaagatcacgccactgcagtccagcctgggcaacagagcgagactctgtctcaaaaaagaaaagaaaaacaaaagtgcttctactcctagcaactctcaagagttgatgctcccacagtattgctgggttacccacaactatactgaaatattttatttctatttctatgccatgctcactcttattaggccactgcatgtgtttttcttgtcctggagtatctttctcagttcactctctctttgccatggcttattcctactcattcattcctactcatcttaggtgccactttacccagaaagtcttttttggtccccaaatttgagttagattcttcctaccaaaggtatttttaaaaagtatactctctcattgtagctatttgattcttagtaactgcttccttactaacaaccctgactagactgtgatatccattagggcaaaaattagattggcttgcatctccagtacttagcacggtgcaggtatttagcaaatggcactgctttgctaggcacatacattttgatatggctatttttcttacaggattttgtttacagtggatttgggatattatttatagagctgtgctcttgtcctcaagtttatagtctagctggagagccatagtgaaagtgcataaaaaagttaaataatagggccagggcattggctcacaactataatcccaacactttgagaggctgagggaggagggatcactggaggccaggagtttgagaccagcctgggcagcatagtgagacctcatctctacaaaaattaaaaaaaaaaaaaaaaaaaggtgtggtggtacacacctgtggtcccagctccttgagaaactgaggcaggaggatcgcttgagcccagaagtatggaaacttcagtgagccgtgattaccctaactgcactgcagccttggcaacagagtaagacactgtcttaaaaaaactaaaaataataaaaggtaaaggccagtatgagtaggttaaatgttggcccaaggcagaataaatagcccaatttaaacatttttaatttaaaaatgaactttggactcattttttatttgtgaaatagaaataatattgcctgccttgccagtcttacagatttgtcatgttgagatatgaaaaaaaaaacaagataatacagtaaaacttatttgaaaaaataaaagttctagaaataagtgctacaaaggagaaatttgagagtgtttgacagcgaaccaaataacatgacctcagaagttaggaaaggattctgtaagaaaataacatttgagctgagctttaaaaaaagcctttctgcacctacctgaagatatgactaaaattagagccttagaaccacccccttgtaactgcgtagcgcactggaggagttgagctgtttacctcatttgctctgatgcaaaaaaaaaaaaggccgggcacggtggctcacgactgtaatcccagcactttgggaggccaaggcgggtgaatcacgaggtctggagattgagaccatcctggctaacacagtgaaaccccgtctctactaaaaatataaaaaattagctgggcacggtggtgggcgcctgtagtcccagctactctggaggctgaggcaggagaatggcttgaacccggaagtcggaggttgcagtgagctgagatcgcgccactgcactccggcctgggcgacacagcgagactccgtctcaaaaaaaaaaaaaaaaaaagagaaaggaaaggagccccagaaaaatttgattgatttgtccagaggatttttatttgttttttgtttgtttttttaagatttaagtcatataaatgaaaagatatatttctaaaaagggttttgatggtctgaaaaactcattaatacactagatattttccttctatgaaaaaatgatgttaatgtagcatttgtatttaaagcagttcctgaactggcctcctttagccccactgatattgaggataagccatatgttttactatctgtaaccagagtgacccagctgtggtcatagatactaggggaagacaggaacaggaaagaaaaaaaaacatagtaatacttcaggtaaaaataacctgagattattatatataatttgactcatctatatggtagcaatgttcgtaatttttttaaactgcaaaaatgtttttatctgtattgagactgtagtagaacttccttatagtgtctgttcccttctttaatattttcttatgtgaaatattcatgcaagaagactcattcattagcaggagaaaattatgtctctaatttttgcctcattaagaagtttcaccttatataacaaagtttactgaaaagtcaccattttctttttgacttagtcatctcatttttgatagattgcaaaggtcgactgcaaggaagtactagacatcatttgtaatctggaatctgaggggcaggataacacagcatttgttctttgtacgacttaccttacccagcagctccaaactgcaagtgtatattgttcttggtaagtatatttagttttacactctttatttgttagtacatagtatagcatttagggtttatgtaaaatgttaatttgtttctaatttaaaacctagcatgacctgtgaatagcttcttgcttccacacacaatcatttaattaaaaatatcattggtttaatctagtcaagaaaaggtaaaatgttcctcttgatcatcccataatgggttgtctgttaactccaatatatgtcttctaccttgaagataaaattttgtcaatatgaaacaaacctgtgttagttagattgtttttcttttcatttttttagtatcttctgggtagtcactccccattcttatttgggaacccacaaatgaaaaggatcaaattatctaggtttctaggtcaaactagcactaaaaaaggaaattcacttgaatagtaatctcttttgcaactttggaactatatagttgaattgcattattttggttttaattcaatttatatcttgtttgcctacagaatacttagttgctaaaaaggaaacagtaagtgtatccgtggttctttcattctaactgtattgaatctatttaggccaaagggacaaacctgatacacaggaaacctctaaaatgtaagactctctgtcagtaagtatcagattagtggtatggataatgctataggagatcagagagaggtgctcactgtataccagagtattaaaggtgtcagggaggaagtaatatttgagatttaattctaagaatgggttggatttgcattatcttgattagaggagctctgagtatttcagaacctaaggatggcttaaaattggaaatgagcattttgtttataggaaaacctagtaaagccttttgtgtacttcagccctcattgatctccctctggatcgtctgtctatttttatagttttatggttaataccattgtatgttactatatttctttttgtttattattttatgtagaaattttgtgtactgtaatctcacccagtcctcataataatcattgcacaggtgaggcagtgggaggatcatagggaccagagaaaacttgtaattgtccatggtctcaaggctaaagtggtagagctgagattcaagcccaggttttagacttctaatccagtgcttttcttctgtatacttgttttcttggcataggccaaaattcaaattgtagttttttaccaccaaatccactatgccagagttatacctcctgtgagaaaggagatagtgggatagcgacttaaatataatttctttataatgaaaaaatatccaccattatagctaggttttcagtacgaataataaattaaatcatatatagaatgtgttatagattgtgtttaaaatttttctccccttcttcagtcagccaccattcactcttccagagctgttagtggctctaggattaatgctgttcttctgtagcaggaagagatgaatggagatttccctttgtggcctcctcaggagctataatgagtaaaggaaagaaaatcttagtcatttcacactttgttaaaaggagcttctttcaagcaattcaaggagcaattgcatcttttttttttttttttttttgagacgaagtcttgctctgtcacccaggttagagtgcagtggtgtgatcttggctcactgcaacctccgcctcccgagtagctgggattacaggtgcacactgccacgcccgactaatttttgtatttttggtagagactgggtttcaccatgttggtcaggctggtctcaaactcctgaccttgtgatccactgcctcagcctcccaaagtgctagggttacagacgtgagccactgcgcctggccacatcttttttttttttttttttttttccccttccattgtttttgaaagctttttttttttttttttttttttttttttttggtagtgggatgctggagttagaatatannnnnnnnnnnnnnnnnnnntttttttttttttccccttccattgtttttgaaagcttttttttttttttttttttttggtagtgggatgctggagttagaatattagaataacataaaacattgaattttggccaggcatggctcatgcctgtaatctcagcactttgggaggccaaggtgggtgggtcagctaaggtcaggagttcaagaccagcctgaccaacatggtgaaaccccgtctctactaaaaatacaaaaattagccgggcattttggcagacacctgtaatcccagctactcgggagcctgaggtaccagaatcacttgaacctgggaggcggaggttgcagtgagccgaggtcatgccagcccaggagacaagagtgactccgtctcaaaaacaaaaaacaaaaaacattgaattttactaaggaaaattaatcacaggaattctgttcatatgagatagatcttttgttatgcttgaggtagtgggacataaggagtatttgtttagaaaaaaattttaaattaagtggtattttggataagagagatatcagtattttttaaatgtgacaataaagttaaaatacaataataaaagtagtcatgcttatttttaaacacatacgctagaatttatgtcttgggagtatcattcttgagtgtagttaccatgaagataatatttgaaatgtaaactatgtagctattggccaggcgcagtagctcacgcctgtaatcccagcaatttgggagactgaggcgggtggatcatttgaggtcaggagttcgagactagcctggccaacatggtgaaaacccatctctacttaaaatacaaaaattagccgggcgtggtggcgtgtgcctgtaatcccagctaccctggaggctgaggcaggagaattgctagacccctggaggcagaggttgcagcgagctgagatcgtgccactgcactgcagcctgggtgacagagcaagactctgtctcaaaaaaaaaaaaaaaaagccgggcgcggtggctcatgcctgtaatcccagcactttgggaggccgagacgggcagatcacaaggtcaggagatcaagaccatcctggctaacacagtgaaaccctgtctctactaaaaatacggaaaattagccgacctggtggcgggcgtgcctgtagtcccagctactcgtaaggctgaggcaggagaatagtgtgaacctgggaggcagagcttgcagtgagccgagatcgggcgccattgcactccagcctgggtgacagagcgagactccgtcgcaaaaaaaaaaaaaaaaaaaaaaaaaagccggatggtagtggtacgcacctataatcccagctactcaggaggctgaggcaggagaatcgcttgagcctgggagtggaggttgtgatgagccaagatcacactgcagcactctagtatgggtgacacaatgagaccctgtctcaaaaaaccaaacaaaaacaaaaaactatgtaactgtcactcagaacggtttttattattttagaaatttcgctcagagacatttacaaaccacagtaaaaagtaaaaatgttttaaactttatagcagttatgtttaacttatttattaatcttgaccccaaaagatttttggctgttgaagaaaattaaagaagtactagaggagtaagctccctgtagatgcctctcagtggtaacgtaattggaatagtcatgcatttgaaaaaggtgaccattttgagtgagatggtgtttgtatatagagaggtgtaattacggcagccattttaaagtcataaagttgaactttgaacctccacagtaagctttcagtgagtatttgatagactggcctttgatttctgtaatgtgctaagcttaaattttgtgttacacatttgtatttcttcagatgtagttacatgtctgttctgccccagctagactgtgatatactaaccaatatgttgtctaattcacggttgtgtcctaagtaactggcgaagactagcatatgtgttttatttaacagaattgtatgggagagaaaagaggtcatgggggtcaattactattgtaatagctttaaaaattttttttttctgtaatagccttttttaggggatgatcatcccttaattccacagttttatttacttcattcctaaaatacctaaattctgaatctcagtgtaacatgttaactggacttcatgggcttcttgctatgtagaaacacagagtgatgtttgtatgtatatatgtgtgtatgtatttattcatttatttttgagatagagttttgctcttgtcacccaggctgcagtgcaatggtgcagtctcagctcactgcaacctctgcctcccgggttcaagtgattctctgcctcatcctcctgagtagctgggattataggtgccagccaccacgcctggctaattttttatatttttagtagagatagggtttcaccatgtgggccaggctggtctcgagctcctgacctcaggtgagccaccacactggccaaaacacagagtaatttaaagttcttgcttagtagctaaattcctaccaaaatgtgcttcttgctgttaacagagctaaatttcctttccgatttttataaatttatatataatttgttgaaatgagctaggtaatgggctaaatcaagggtacagtacatcatctgaacattggcagcatacatacagtggaatcattttccatgattttcaatggttggctttgtttaaaaaagtcacattattgtagtaattgaagaagaacttatcctagcgcatgtttgatctgtcaggctgtaggttactattggatgttgatttcagtgttccagtgtacagatttgaatggatgattgaagtgacatcttgcatcctcatgagtaacatactggctgtcgtggtttcaggcatgtttatatatttgggtgggtaatcattttacatcaatttataactatgcaaatatttttacaaaatacaccataaaatgcccatttttgatcatgcttatttggagttaacatacttggagcctgaaatacttaatttggaataaaccaagccctggacattctgacttactgttttaaaaattatttgagtggccaggcatggtggtttacacctgtaatcccagcagtttgggaggccagggcaggtggatcatgagttccggagttcaagaccaacctggccaagatgctgaaaccccgtctccactaaaaatacaaaaaatagctggggatggtggcgggcacctgtaatcacagctactagggaggctgaggcaggagaatcgcttgaacctgggtggcagaggttgcagtaagccgatatcgcaccactgcactccagcctgagggacagagcaaggctccatctggggggaaaaaatttatttgagcctgtaatcccagtactctgggaggctgaagtgggtggatctcttgaagtcaggagttcgagaccagcctggccaacatggtgaaaccccatctctactaaaattacaaaagttagccaggcatagttgcgtgcgcctgtagtccccagctactcaggaggctgaggcaggagaattgcttgaacttgggaggcagaggttgcagtgagccgagatcatgccactgcattcgagcctgggcaacagaacaagactccatctcaaaaaaaaaaaagccaggcgtggtggctcatgcatgtaatgtaatcccagcactttgggagggcaaggtgggcggatcacctaaggtcaggagttcaagaccagcctggccaacatagcgaaaccccgtctctaaaaatacgaaaattagctgggcgtggtggtgggtgcctgtaatcccagctactcgagggaggctgaggcaggagaatcacttgaacccgggaggcggaggttgcagtgagccaagatcatgccattgcactgcagcctgggcgacagcgtggactccatctcaaaaaaaaaaaaaaattatttgagacaccttagttctcaacctgccttttaccactttaatggatttacctaactttgttgccaggctggagtatagtggcaaaatcgaagctcgctgcagccttgaactcctgggctcaagtgatctcccacctcagccttccaagtatctgggattataggcatgagcctctgtgcccagctttagttagtgaattttattttatttgagagaagatattactctgtcacccaggctggagtatactggtgagatcacagcttactgcagccttaaatcctgggctcaatgaccaccctgcccgccccccgctgcctctgcctcctcagtaattgggactacaggtgtgccaccaagagtggctaagctttttttgtttggttggttttagggtcttactgcgttgctcaggctggtcttgaactcctagcctcaagtaatcctctgctgaggttatagggatgaaccaccatgcccagccctgcagtaaattttagatagttgacatcatttactcatttatcgttataatcaggatttactggctttgataatttttgttctgttcaaataggacagatttcacatacatatgacagattacaaaaatttttattacttaacgtgcttaaatctgaataaagcaattgtgtgtttaaaaatgaacagttatcccagcttgcctggttggtggctattttcacagctggcctatctcaattttcacttcttgtggttaggaaagtagcactagccaaataaaggcaaatatttaaaggcattttaaattaattatattggttatagctcaaatttgccatcctgttaagctttattcatttatcttttttttttttttttttttttttgagacagagtcttgctgtgtcacccaggctggagcgcagtggtgcaatctcggcttaccgcaacctccacctcccgggttcaagcaattctcctgcctcagcctcctgagtagctaggattacaggcatgcaccaccacacccagctaatttttgtatttttagtagagacggggtttcaccatgttggccaggctggtctcgaactcctgaccttgtgatccacctgccttggcctcccaaagtgctgtgattacagccatgagacaccacgcccggccagtcatttatcttttgagacaccatatattcatttcaatctttgaagcgagttttataactacttaaaaatttcaccttatgccgggcacggtggctcatgcctgtaatcccagaactctgggaggccgaggcaggcagatcacctgaggttgggagttagagaccagcctgaccaacatggagaaaccccatctctactaaaaatacaaaattatccaggcgtggtggcacatgcctgtaatcccagctacttgggaggctgaggcaggagcattgcttaaacctgggaggtggaggttgcggtgagccaagatggtgccattgcactccagcctgggcaacaagagcaaagctccgtctcaaaaaaaaaaaaaagaagaaaagaaaatcaccttacaagagccccagttccctctttagaaatataagaaaataaattccgttaaatatatttactttaaattacatgttttcatttcttaagctttggatttgtagccaactttctgggagacagtctgtgttaatagcaatataggatatcagtgtttttaaattggcttatgaaaaagtacagatttttaaatgaaaattatttaatcagtatccattgatttacttaaaagagccacatgtattaagtgatagcattctttttagtttagtgttttttttgtttgtttgttttgtttttttgagatggagtcttgctctgtcgcctaggctggagtgcagtggcgctatctcagctcactgcaacctccacctcccaggttcaagcgattctcctgttctcagcctcccaagtagctgggattacaggcatccaccaccacactcagctaagttttatatttgtagtagagatgaggtttcaccatgttggccagcctggtttcgaactcctgacctcaagtgatctgccccccttcacctcccaaaatgctaggattacaggcatgagccacccgccatgcccggcctctttttagttttgctattagaagtgataacattctttttagtttcactattagctttccttgcattcacattttacattctctcattagcatttctatccttggcattgttgagtttctaatgcttttttgcgtgagtgttttacccattaaatgtttttgtttaatttattattttcaagctttccttttgtttccataatgaatctttgtgagattcctgtattttagccatttccaaaaagtgccattttacttatttcactggaagtatttaaccattccaaactacaggctctaagtagcatcctgacattttagatctggaaagggccctttaagatcactgtatagaagtgtaccattagagtgtctttgttgtatatatatttcgttgttaatttagtgatggctgattatttctgcccattaggacagggcttaattcaatcagtatattaatcaccagtgtgaaggataaaaccttttagaacaacatgggatctaaataagttttttttaaatgccactgttaaggaggtagtgttttgtttttatttttccccctaaacacaagagagaagtcagggaattgttacggaggattcttaacaattttatcagtttgggagaaagcagtggtgaatatagacagcttttaatctagtttttgttttctctactgtcagctttctacagatcaaaaaattgggttgccgggggcagggcagcaaataccagttactttaaatgttttaccatgatcttctttttttatagggaactgactcttttttggagtaaactgcaaagaagaattgacccttctttagatacttttttggagcgctgtcgtcagtttggtgtcatagctaaaacgcagcagcatttattttgcctcattagagttatacaaactgaagtgagtactttatgccttctctgctaactgtagctggaggaaagaaatgagtgggaagataacttctcaggaaattccctttaaaggaagataagaaataatgagttttaataagattaatggaattgaccacatctgactgtttctccagattgacttcctataattaatcagaaacaaattgatggtcaaacaagttaggtgatatttatttctaattactgtgaatgaagttgtgtctcctgtcacgttaagaacattttaagaggccaggcacggtggctcaagcctgtaatcccagcactttgggaggccaaggcgggtggattacttgagctcaggagttcgagaccagcctggccaacctggtgaaaccccgtctctactaaaaatacaaaaattagccgggcatggtggcgggcgcctgtaatcccagctactttggaggctgaggcaggagaatcgcttgaacagggaaggcggaggttgtggtgagccaagattgcactgctgcactccagcctaggtgacagagtgagacttggtctttttttttttaaaaaaaaaaaaaagaacatttcaaggtaactatagaacttgcctgtttaaacaattactttataattggccattagaacattttgttttgtttaaatctttaataaaggtactaattttctattgttgaataacatcacaaaaattaatacttaaaacaatgtccgtttttatcagttcagttttgtaaatcagaaatccagcacaatgtggcaggattctcttctaagattatcatattggctaaaatgtagtttgccaggctaagttctatcagaggctctgtggaaaatccacttcaaagcttattcttatcgacaggtttcagttcctgtggttgtaggactaaggtttctgttttctggctggctgccaatcagggtctgttctcaggtgctagaagctacactcagtctttacctctgttttcaagcagcaagggtgcaacaagttggtgcttgaaacctgacatcctccatctctgactttagttttcagtttttggttgagacaggtctcgctctgtcacccaggctgtagtgcagtggtgcgatcatagctcattacagcttcaaactccttggctcaagcaatcctcccgtctcagcctccagagtagctgagattgcaggcgtgtgccactatacctggctttttcttttttggcggggagcagtggtagatacagggtcttgctttgttgcccagactggttctgaactcctggcctcaagcaattctcccacctcagccttccaaagtgctgggattataggtgtaagctgccccacctgcttgaacttgggaggcagaggtggcagtgagccgagatcacaccattgcactccagcctgggcgacagagtgagactctgtctcaaaaaaaaaaaaaaaagcaaagattgaatgacttggctatatcctatgtgcgcttgcaacagtatgccaagtcactcttgatccctcaccttcctagtttaagacccaccaatttcttcaaaattcagctccacattgcatatcctgattcacatttattcactactcctttcagtaactttttggcatatctgttcagaatatataatagtatttctggttacttttctttgaaaaatgttgttagtgatttttcaaatgttaccatcccagccagattaggctgtttaagaaagaatggccattctttgctgtccacctcacagtcttccaaaaggagttagtaacttgttgagaaactgaattattttaaaatttagctgactttccccaagtcctctctgctcttacttacaaatgataaacttctatcacatcatcctaataagtcaagagacccatggtctagtcctgtggagccactaaagcaacatggcctgttttacttggactacattccaaatgagagggagaaacttctatattctttaggccactactgttgtgggaagtctgccactcacaacagaaccagatcctagctgatacaggctaggtaatgcctctctttcaaaaaagctagagtctcagctcgtctgaaaggtagggagttatctcaattgattgttcacagtcagttacagactgaactctgttctactctttcccccttctcactattacacttgactagttttaaagaaaaaaaagttggagtctcagtttgcaagggattctacactcactcactcccttttcacctaccagtccacatctcttctactcttcaggccaaatatcttcttttttttgagacggagtctcactctgttgcccaggctggcatgcagtggcgtgatctcagctcactgcaacctccgcttcccaggttcaagggattctgatgcctcagcctcccaagtagctggggctttgggcctgcatcaccatgcctggctaattttttgtatttttattagaaatggggttttgccatgttggccctgctggtcttaaactccatgcctcaagtgatgtgcctgcctcggcctcccaaagtgctgggattacaggtgtgagccactgtgcccggcctaaatgcttttaagtccttgctcctctgctcactagttagtgacattgggcaacttaacgttctgagtgttgggggttttttgtctataaaatgaggataatacgtgcaaaaaagtttatttcaaataagtgcctaggctgtagtaggggttctgtaaatcaatgacagtgatttctttgtgttcccagcatttagaatgaatgatgcccaacacagaattaaatgcctggcaaattgtttactgatttaaacagtggaatttactccattattttacattgtattctgttaaatagttacaatgtgccagcgttattatttcatctttataaccttaggaggaaaatctgttattaacattactgttatcattttaccaataaggaaactgaagtttagaggttgagaacttgtcacttgttgtgaagctggggttcaaaggcagtcaaagtctgattctaaagtctctgctcatagcagtgcgttttaagccactctgacatatcttgcttttctttgctcatgtcatttttgtattttatttcagcctctcagataaaaagagttatcttgtatgtaccaagcttttatcacatatgaccaggtcttcctaattttaaactagtttctgagaacctgctgccatagcaagatttctgatttctgttttttccctggaaagctgagattcagtacacctgtgacggtgactataaattaccagattctttcaggaggaaatggaaaggatcatttattttatctttgaagttttgaaaaatccaagtgttcatgatagagagaatttttttttttttttttttttttgagacggagttttgctcttgttgcccaggctggagtgcaatggtgtgatcttggctaaactgcaacctccacctcctgggttcaagcgattctgctgcctcagcctccgagtagctgggattacaggcatgcaccaccacacctggctaattttgtatttttagtagagacggggtttctccgtgttggtcaggctggtctcaaactcaggtgatacacctgcctcggcctcccaaagtgctgggattacaggcgtgagccaccgtgcccagccaaagagaatttcttaaattgaatttaatcttagactcacatctatacctgtgtttcctgttgctgccattttaaaccctgcccctctactcaacatcattctattttgaatcctccagtgaccttttttatcctgaatttctttggattcacatgcatttattgtttatgcattcggggtacagataaattccttggaagtaaggaactgctttaatacacagtgcctagtaaatgtacattgttcgtagttgtagcatctaatttagttctttgcatgttgagacaagaaatatctaaatgtaactttcatgaagaaagatttaagataaaatttaggaactctaaaagtttttacaagctaaaattccttatcagtgaaagttatataatctttctgtatgcaaaaaaataatttttttatcctcttttacttacaggcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatatgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcacccattcgttgtttactcataatgagctttcatgccacatgtaaactgaaattgcacttgtattttctgaaatatgccattcacattttaccccagtaatttttttatttattattagctaaatcattcagaacaaggttcttttttttttttttttttttaagacagagtttcgttcttgttgcccaagctggagtgcaatggtgcagtctcgactcactgcaacctcctcctcccaggttcaagttattctcctgccccggcctcccaaagtgctgggattacaggcatgagccaccgtgcccatcccagaacaaggttctttttatcttaaaatttttgtttttgtggaaagataattctgagattaattagctgcgggagtcaagatagctcccagaggatgtccagatgttggccgagtagaaaggagaggatatgccaacctagaacatgaaggacgtagcaaattcagagggcatgtttctaggaaactacaaataatttgatatgctggcaataaaaggggaacaagagagtgacatcattgtagagatagcaggaactaaatcatgaagactaaggagtttggatttgagtctataggcatatatcagttgaagtgtggagtgctcacttgatttgagaagctgaaattggaaacagtatacttgaagtaattgaggcaagcttggtgagtgtatttactgacaattgcagcagaaggcagagtagatgaagtatttaaggagacaggattttgggggcttggagagtgaaggaaaagatttggtactgatgcaaccattttaagtaggtatacaaagaaggaatgaatatttgggaagataatggaaaccaaggtgagtttggcttttagatgtgttgagtttcattggactgtgggatgtctgtctaatgaggatagcagtatatccttttaatacagcagcttcatttcctgttgcttgtgaagttttcaactactttcattagctagtaatgaagtgactcagacaactaacatctctttctcatccttgtggttagattttttttttttttcaacggagtcttgctttgtcgctcaggctggagtgcagtggcgcgatctcgactcactgcaacctccgcccctccaggtttaagcagttctctgcctcagcctccagagtagctgggattacaggcttgtgccaccacgcccggctaattttttgtatttttagtagagacagggtttcaccatcttggccaggctggtcttgaactcctgacctcgtgatccaccctcctcggcctcccaaagtgctgggattacaggcgtgagccaccacacccagtctattgtggttagaatttcaagaccttttctctgactcttaaaccttattttcttgttttgtcagctcttcaggaatttcattctgtcacctcaccctgagtctaaagcactcccataaccaagtcgtttattgtctcagatcccagtaggtaacagaggattctgagaaatccaagtgatctgagtaagactctgttgaaagaagtggcagaaacaaggatcttagagactgagaccagtattgtttctttggaatcaagctaatttcttcagtggctttaatttcctcacttacgaagggaggaggtagaggtgaaaggtccctttttgtgatatgagcatgagaagcacctgtaggcctagtaaaaattcctcatacgagagagatggttagtccagagtaagagaaagctactaagactgaactatatccattcaaccacacagaacttgtagcccctggaaggaccaagtgaggccattcacagtggaactaaacctagattttaagaacccaattaggccgggcgcggtggctcatgcctgtaatcccagcactttgggaggctgaggtgggcggatcatgaggtcaggagatcaagaccatcctggctaagacggggaaaccccgtctctactaaaaatacaaaaaattagctgggcatgatggcacacgcctgtagtctcagctacttgggaggctgaggcaggagaatcgcttgaacccgtgaggcggatgttgcagtgagccgagatcgcggcattgcactccagcccaggtgacagagcgagacttgtctcaaaaaaagtaaaataattcaagtataagcctaagtagttgatcccaagatcactgtctatcccagttagagcagcttgcatcatttgatctttattaaagacttttggctgggcgcgatggctcgcacctgtaatcctggcactttgggaggctgaggcgggtaggtaacctgaggtcaggagtttgagaccaggctgaccaacatggagaaaccccgtctctactaaaaatacaaaaattagctgggtgtggtggcagatgcctgtaatcccagctactcaggaggctgaggcaggagaatcgctgttggaccctgaaggtggaagttggagtgagctgagattgcaccattgcactccagcctggtcaacaaagcaagactccatttcaaaaaaaaaaaaaaaaaaagactttcctgtttaaaccagcatgagtgactatacgataatacagggcaaagggttatttttttagcttgtagtaatcattttaacttgatatctctggaatttgtcccaaccctggcacagacctgaaagcactgactttgttttcaaagctttttcaattcaagagtgcctccaaaatggtgagtaggaatgaagacttccagacacttctattcttgcctttacccagaattctcttgcttcagtgttttccccattttcatgagcccatgtgtgaaatagggtaaggaactgtggaggagaaagttttttattagccttcctcagggtattccattctcaatctatcctttctcagtcccaaaaggcctactgagctgaactgcctaagacataatcattcaccaaatatttaaatacacacatttaaagagatacaattccagatgcaatgggagacaaaaaaaaaaaaaagttgtcagggccatcaagaagctttcacaaggtgaagggagggctggagtatctcagaacattgttacttaaagtgtggtagtgggccagcagtataggtgtcacctaggagattgttattaataaaaatgcataaattcaggccctactccagacctactggaccaaaatgtgcgtgttagtaagatctccaggtgattcttaggcacagaaaagttctagaagcactggcctggaagtggaaagtactgtgagaattcagggtaattgtgctttttagcattttacataaaattatgttgttgaattttcataatcctatgaagtaggtgctgttactatatttgacaaagaacgagatgaagtgtcttgcctggctggcacaaatagaggtggagcccagtttccaatctcttctgactagaagaatgtcagagagggacatttagtgtaaaggaataacagatggaaagttgcaggtggtatttgaagtaccaaaaataccacagttctgtaatgtgagtgttgtttgtgaaggtgaatagtgggaaatacaatttgaagtgtaggtgaaagccaggttattcaactcaaactccacagtcatatggtgctgacatttcttcatttgagtatagagatgggaaacgtgcatatttttttctgtgaataacatgtaacctacgaaaaaggcaagttttcttttctgaaagaaacttactcatttttgttattttttgaggcgaggtctcattaggttgcccaggctgatcttgaactcctgagcccaagcaatcttcccaccccagcctcccaaagtgctggaattgcgggcatgaaccgctgcacccggccagaaacttctaaaactcagaaaagttgctcctcctcacctcctaccccaaggtaaactgtgatacctcctggctttatactactgattttataccctattatatagaactgtgtctagagagagtggcctatccctctgtgaccttcttggtctactcctgcaggagtggcttctgtgacagactgcatttggaggtttgattcactctggggaaggtaaccaggataggcaagagatttaaaaatctgtcagcatgtatttgacaggtataacctgaaaaaaaagaccagaggcgtaggaaagctatctaaatggttaagaagccaaatatttacaaagcatataccatctgctagcccctgggtggtaggtgttgaacaagactcatttcctgcatcatagagatttaagaatccagtaagggactgggtgcggtgactcatgcctgtaatcccagcactttgggaggcacaggcaggaggatatttgaggtcaggagtttgagaccagcctggctaacatggtgaaaccctgtctctactaaaaatacaaaaattagccgcgctgtagtggtgcatgcgcctgtaatcccagatactagggaggctgaggcaggagaaccgcttgaacccaggaggcacaggttgcggtgagccaagatcaggccactgcactccagcctgggcaacagagtgagaccctgtgcccccaacctccccacccccaacaaaaaaaataatccagtagggaagacagacattaaaacagtacaaataataaagtaaaagtgcttttaaacagggggggtggaggggcttatgagaaggggaccaaaaaaggacagcaaaagcttcattgaggataatgtttaaactgaaacctaaagaatcaatagaagttagccaggcaataatctgtagtcccagctactcgggaggctgaggtaggaggatcacttgagcccaggagttagaggctgtactgtgcaataatcgcacctgtgaataggcattgacctccaagctgggggaggagggggaagctaggcaaagaacaagagtaatccaattatgtgccaaagctttgtggttcaacagcttggtgtgttggtgacattgataagactactatagctggagttgaaagaacaaatggcagaggaagagaagacttggtaggtaagcagggaccaggcattttagtgccctgttagccatgttacagattttggattttgtttgaaagacaatgaagaacctataagaatttttcaaaggcggactgggtgctatttctcatgcctgtaatcccagcactttaggagggcaaggtaggaggatcacctgagatcaggagttcgagaccaatctggccaatatggtgaaaccccatttctactaaaaatgcagagatcagccaggcgtggcacgtgcctgtagtcccagccactcaggaggctgaggcaggagaatcgcttgaacccaggaggcagaggttgcaatgagctgagatcgcaccactgcactccagcctgggcaacagagcgagaccctgtctcaaaaaaaaaaaaaaaaagaatttaccaaaggcttgaaagtaggcattgcctaagtcagtaagtcctaatagggcatgatatggaagactactgagtggaagtgactgacagatgagtgggtggatgccactattaaaggtaaactgaaggccgagtgtggtggttcacgcctgtaatcccagcactttgggaggcctaggcgggtggatcacgaggtcaggagttcgagaccagcctaaccaacatggtaaagccccgtctctactaaaaataaaaaaattagccaggcgtggtggcacatgcctgtaatcccagctactcaggaggctgagccaggagaatcgcttgaaccccagaggcagaggttgcagtgagccaagattgcgccactgcactccagcctgggagacagggcgagaccaaaaccccgcctcaaaaaaaaaaaaaaaaaaaaaaaaaaaaaaaaaaaaaagccctgtttatatcctacctccttgctgggtgcagtggctcatgcctgtaatctctgcactttgggaggccagggcaggtggatcacttgaggtcaggcattctagaccagcctggccaaaatggtgaaaccccatctctactaaaaatacaaaaaattagccaggcgtggtggcgggcgcctgtaatcccagctactcaggaggctgaggcaggagaatcgcttgaacctaggaggcataggttgcagtgagctgagatcgcaccactgcactccagcctgggcgacagagtgacacgccagctcaaaaaaataaaaataaaaaatcccatctcctcacatttccattcaacctcaatacaactcagttttttttattatgtgaaaacagctgcaacagctgctgtccatttgaattgttggaaatgtagatctacactaaccaagagagaagccactagccacaggtggctatttaacttttttttttttttttttagatggagtctcgttctgtcaccaaggctggagcacaacatcagctcactgcaacctctgcctcccaggttcaagtgattctcctgcttcagcctcccaagtagctgggactacaggtgtgcaccaccacgtcaggctaatttttgtatttttagtagagacaagatttcaccatgttggccaggctggtctcgaactcctgggctcaagtgatccacctgcctcagcctcccaaagtgctgggattacaggcgtgagccaccatgcccagccaaatttagttaaaatgtaaaatgcaatctctgctgcactattcacatttcaggtaactagtggttaccatattggacatggcagataaagaacattttcattattgcaaaaagttgtactggacagcactatgctagagccagaactagccaaagatcagacaaagcaatatgaatgaactgaaaacccaggccggtgcctggttggttttgagtaagattcattggttgggtgagtgggaagcaagctgacctttggaacagtgacatcacaaagcacagctcacaatggctctggaatacctaggcctccagactactccccctaactcatatttagattcctgaagcttctgcacatgtagttcctagagctgctgcttattaaaatgtcaacatcttcatcttctagctgggacaacctcttagagtctctctctctcagcacagtatggaattggatacaagcaagttttttgggagagactagtgcacctcagcaaacaagtttgggactattagataatcttgctccagctgtgcaaatcatcttgaggatttctttcttgattttattgggaataggaatatatgccttatggaaacgaagtattcagtcaattcaggttatactcttttgttacaaacatttatatagttataaattgaaatttgattagttctctcccatattgctgccaccagttttaagatcatgcagatgtgcaaaggcgaacctttgtctcttaagttggcaaaaactaggttatccttgaaaatctccaccaattaggctttgggcataaaaatgcttttctcacaatggtctttggcttgtcttctgtaataaaatagaccaaacatgttggtaacctgaaaagacagccttaccctcaaaaatttttgatcacttattcatctttgagtgctactatgtttatacaataggcaccaaagtagctaggatcatgagtatggcctttcttactatgccattgttctgtaactgataaggaggcatatgtattaagtcatcacaatgtgttcattattgtgttttgacaagataaggctccataagtatataggagctctttggggagtaggaatttaactggctgggattgtgagagacaggattttacatacttctgtgtagtcaccaataataatagttgacatacaatatagttgaatgctttgagaatctcaaaaattccatgaaatggatggagattattttcacatgacaagtgaagaaactgaggtgcactgaggttcagtggaaacttaaggtgacaggcttttaaaacggctttcttagagtgacaagtttacttgataaatgcagagagaagttgttattggatcattttttagcattcacttattttcatatgtcactattgtttagtaatcatggtcacggggcctttctattttaaaccatcacaatcctgcataacagtcagggagagattatttgctccattttgtagatgagagaacttgattgctacccacccaagttcacatagtttgtaagagctggcaaaattggagtttgaatcgaatttttaggatttgaaattcagttcttctccaaaatctcatttaatgcaaaccaactgacctaaatcttgaacaggaatgtgtgtgtgtgtgtgtgtgtgtgtgtgtgtgtgtgtgtgtgtgtgtacgcgcatgcgcatatatatgtgtattgtgaggattaaagaagatattgtatgtgtaaatcttagcacatatattcaataagtggtgctacagtgaaaccccatctctacttaaaatacaaaaattagccgggtgtggtggtggcacgcgcctgtagtcccagctactcaggaggctgaggcagaagaattgcttgaacccgggaggtggaggttgcagtgagccaagatcgtgccactgcactccagcctgggcgacaaagactgtgtctcaaaaaaaaaaaaagtggtgctagttgttataataaggaacaagatgattttttttcttatcctagcaagaatctgtcctactatacatattcttttgttatttatttatttattttgagatgaagtcttgctcttgtcccctagtctggagtgcaatggtgcaatttcggctcactgcaacctctgcctcccaggttcaagcaattctcctgcctcaccctcccgagtagctgggattacaggcgcataccaccacacccagctaatgttttgtattttaagtagagacagggtttcaccatgttggccaggctggtctcgaactcctgacctcaggtgatccgcccaccttggcctcccaaagtgctgggattacaggcatgagccaccgtgcccagcatatgctttatttttattttttattttttttttatgttttagagacagtgtcttgctctgtcgcccaggctggagtgcagtggtgtcatcatagctcactgcagcctcaaattcctgatctcaggtgatcctcctgcctcagcctcctgagcagttggaaccataggcatgcaccaccaggcttggctaattttaaaaatttttttgtagagacagggtctcgctacgttcactatgttgctcaggctggtctttaactcctggcctcatgcaatcctcccatctcagcctctcaaagtgctggatgcagtggtccacacctataatttattttatataaataaaatatatatatatatacattaatttttttaagagacagggtctggctatcttgcccaggctgaagtgcagtagccattcacaggtgccatcatagcacactactcctgggctcaggtgatcctcccaccttaccctccctagtagctgggactatatgtgtgtgccattgtacccagatctctcctagtatattttaaaaaccttttccatgaccaagaaatccagtttttcagactactatgtcctaaagtgtacttggaagtgtgaatttctggattcctgtcctggctctgccacttccaatatataaccttggacaatgacagagttcaaactagaaggtatatagttatccagttgtgttttttctgcataaatagatcatgcaaaggcaaagttacttccagacattcagaaaatggttatctattattacaatcttgattaaatgcaaataataatcctgcctgacctgcctacctctccagtttgcagtgaaaatcaaaagatgaaataggtgtgaaaatattttgctaaggccgggcatggtggcttacgcctgtaatcccagcattttgggaggccacgatgggcggatcac

SEQ ID NO: 329 - DNA, 6229 bp, Homo sapiens
ggccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagaccttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatatgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcacc

SEQ ID NO: 330 - protein, 1882 aa, Homo sapiens [sequence omitted]

SEQ ID NO: 331 - DNA, 295096 bp, Mus musculus
  misc_feature (1)...(295096): n = A,T,C or G
ccttggttttcagatgagttcttttcagttgtgtgtgtcaagcagcggctcgcactgggttcggtgtatgtggtggcctcgggaggtgcctgctgtttctgcttctgatacaggtcccattatatttgcagaagttttctcatgcaaccatccttccagagtcttttgagatcttgcatgtcactattgtgctacaagggcaggcggctttggtctttgcttgcaggtcttaggtgggagttcaaatcctaattcagagcatatggtgcctggaacaccacctgagcatcacctgggacctcacgcaggcctgtagatcctggcttgcaggacttcgcatcagaatgtgccttgagaagatcctgatgtgatctcagcatcatagaatatgcattacaagatacgctgccctggagggaatggctttccacagtcgaagctgaggctggagactccaggcagggccccatgcttgccacttccctgcttgctgggcttctcaggcagttctggggcactgagagagaaaaattcttcaccctctggtttttcctggcccttctagaattctcagccttagtcttgcttacctgtagaccactggtctcacctggatgctctcgttttccccatttgagacaatagtcctggctatcctagaacttgtgatccccccgccccagttcttaactcatcttctcctttctaaaacatacttagggaagggcagtttgcagaaaagcctggcctttccaagaagcctagtctttgtatgttggcctggtccttttacctgtgcaatctgggactgtgattgtccccttccaggtaatagacaaaagtggtctgatgataccagcactccacctctcttgcatttaaaggcccacaaactacacttgtctgtttgcttgttttttaaataatactgtttttaaaaatcatattacttggaggactatgtgacatatcaggtaagtagtggacaaactgtgctaaattcccagcctccaaataaattctgcctcatttttcatctgggaggaaattgtaaatttgtacatgtttaaaattctctaagcaactgaagaaaaacttcgaacaaatttgtagtagtgcactggagtatggttatttggttaagctgtgagctagcaaggcaaacatgtttcattatcatgacacttaaggttccctctaactggctaatggagttttgccccatctctgctcctgggtaggaaggtagatcaacagctgtcttgtgctaggctttctccacttttaattcccaggacacctctgggaagtacatgttgtccttatacttttatagatacttggaaaggtggagtagtttggctgaaggcacagagctaagaaacgggagacctggggtttgcatctgtgtttgtggaacccaagcaaggcaaactcttgaattgtgtgtgtgtgtgtttgtgtgtgtgcgcgtgctcacgaattcaagtgagcgagggaggggagagatagaatattagcatatgtgtctatgagagggaagaagggaagaaaaagagacagagatagagacagagactgaagagatagagacagactgattaattgacctgtacttgagcatcctggaaataccctctggttttttgcgcccttactgggttagttttcagaatgcgtttctttgtttctaactaaccaagtgccagctttccttgagggacttttccttgcaccagctttctgtctcattgtcccttaggatagctttctgaatacagtacccacttctcaggtccacttctgcttcatggctgggctcttgtgtcattgacctgatactgatgaaaacagttgatgccttggtcccagcataggcagatgtttgctaagcacttcatgcaacacactgtcttttaatatgttctgggtggtgggtataataaagagacaaagcctgtgcctatcatgtgtgtggccctacacaaaaataaacccctaaactttcacccatggctcagtgagtaagaacactggctgcacttccagaggtcctaacttccacatggtggctcacaaccttctgtgatgggataggagcccctcttctggtgtgtatgtagataaagcccttatgtatataaaatacataaaaaaataaactacagaaagttaaaagatcagtcattagcatttaacctcaagagttcttatggggataagctaatatttataacatataaagcacataaatagtgtataaatatagatgtatttgtgtaactatgatagctcaacgtattaaagcatataaaagctaataatactggggaaatgcaggtatgtttatatctgtcatatctacatacataattcagtgaatctaaggactattgatcattcctaagaggactttaggttttcaggaggaagcagtttcttactcattgcatactctctttattgtctgtccagtgctctttgtacacaggtccagttggagaggtgtcctctgtcaatggctatcccttgccttgatttcatgatctctcagaaaagtaaagtaagccagagtggctccttattaaagactacaccagtgttgaccatgatcttgttactcttatgtgacgacggcctggtcccagtttctacacgggagaacgtctaggttctgtcagttaacatggaagcccttctggtgggtgattcggacctttctttgcattcctttctgtctatttacctggctgtcagtttctgacagtttcagtttgcttgtttgtgtacgtttttgctccatttttttttacttcagagtaccttcccgagcctgccttctgcccacatctcttgctttctgtatatccaaacaaggctcagcataaacgtccttctccgttcttctcttttccctttgtgttgttgctatctcctgtggcccagctgcagtagtaccccacatgtacttctgtagctgcccccctctctgatggccttggcatgtgctaacttaatttatagttttgtatgtacagattagacccttctaccttgaattctcttcaaggatatgggacatgtataagccattcttctactaatatattgacattagagccccaagcatttgagcacacgaggcatcagagcataggaggacccggttgcttatactaccagatttattaactctgtggctctcagaagggctaagcctttctgagcatcaatctccctaactataaaatgtaaggaataaaaaaaccaacctattttataggtggcaagatttcatcataatttaaaaaccgtatcacagctagaaatcaatcaactaatacataatcattgctattttgatgtgtattaatgtgggcttgagacgtcttccttttctttaagggaaaattgatgtaagtagaatttaatttagttcccttatcttggaaggagtcacacccttccttgtcccacttgatttcatttctataatcaaccctggacattttattagctttgatactagagtcccaaaccaaattcttctgggttagtgctgactcttgcttcatttaggaaataaagatttagggaatggctttaggaaaatcacacagatggataatcagagtacatgtcatttaatgcggttggctgatcttcttggtgtatcatctactttagataagaggtgttttgagttgatcccaactagatctggaagaatattacgccattcatttttggcagtgacttcataaaatatatcccctccagaatattccagataacacacatcctctgaatatcagcgcatctctttccactggaggctaggatccttctataattggaatcaagcatcctcaggatacttcctttcaagttaacaagtcttcattaaaagggccaggatctttcttaggtattgtccagtgtggttgatcgccacctagtgggcacaagtagcaccttgcaacacagactctagatgaattaattctttatgtctggttctgagatacaacatagtcttccatgctgattcatagaggggttcaggatgtaaaatggcatttagcaaaaacactatcacctttcctctccacagctaagtacactagagtgtctgtaaaacactgtgttctgagcctgggaaagcttgtcttcagtgtggtttctgtaagaaggactcacgctctgagaactcttagactgttgacttgaggcttggggacgtgttggggctggcatgtggctgtggttgcatcttagtttgcttctagtttatctcccttggcccttggtggaaagttttgtttaatgctcctgctgaaggtagctctcccttcagccttgtgaaagttgtccgcattgacagtatgagaggaggtggtcccatattagtggtaagcacattccgtatacatcaccctccacctaggttcccattagtcagaaagcttttactgacctactaaatctcctatcgtcccccgcctccatccaacgtggagttgggaagtttaccttcagtgaaagaatccctacgtctatctgtcactgttccttctgtgactcttgttcaccgccaggcttgagctgaattttagagcgctaagggagaggcgtcaagggacactattctgtttgtgtagaactcacttctttaaggcatatcacagagttacaggaactaacaccaagtttctatgaaggaggatttgcatagtattcatgaagtcaaaaatagggtcagatttgggttggttagaaaagccaacgaaggcttcttgaagaaacctctgatctggagggcagagtggcaggaactgtcccgtcacgggaactgagattagccggtggcagctcacatcttcagtgtttttcaagcctttgagagggcttctagtctcctctctagctctcacaaggctgacagagttgggtggagaacttgccatggaagtagatgtagggagagcagcgaggaggctggggcaagcatgtaggccaatagtaatatttatttgggacgcagggcattgaaggcaatgggaagaactggcaaaattaagagccattcagcacagattagacaggcttggagacaggcactgtgcatggggttgacaaactggggtcaacatgtgtggcaagacagggaggcccttcctcacctttggctgatcttcttagaaaagggtatatgggtgtagagtttgaagttgactgcttagaacttcacttatgggtgaagaggaagagtaaagagtagtccttcaggatctctctctctctctctctttctctctctctctttctctctctctctctctctctctctctctctgctcatggtgggtcttctctggtgactctcaggtacctgcatgctgccttgtgctgctgcgtccaaacaaggcagcacagcatagtagtttggaggtgactgcctagggacccgaggcatcctttgtatgttatgagatgaaatcactgagggaatggcttcggaatcatcccaaatgtagggtgatggggtggaggaggggaaccttagcaagcaagacctaaggactttggtgttgagctttctgtagccaagagggcaaatcctagcaagatcttatattaggagtctgcttttaggaactacaatcactttctactttctggagagaaagatgtgactaatggaaattcctaacatagttagatgcaatttgagtgactttgagggcacagaaatacagcatatctactaaaatgaagtggaattataaggttactttgagttccttattatgtaggtgtgtacatgtgtgcacagttatgttaagttttacccaaggagagagattggattgactgtgatatcactgataaagtgaaattaaggtggttttctacagtgtttggaaaataacgacacattttctgtgctaaggcagcaccgtgcttgtattcaagcctcttgattgctttgcacaggagtatttgctaaggcagagcttggcaccctccgaagggaagggcaccgtcctctggcctcactgagcagaaggttttgggagcagtttctcaaacgtccaggcttgaagctgctttcctgcccttattttcctcatctccttgaaggtcttgtattgcttggatgtaggcagtactcattttgtgctgccctgccagcatcctgccctcctggaacagcagttatgcaaagtgaacattaccagcgtatgcaaagtaaacgttaccgactctggctctgcgctgggtcttgtgctgcccgaacatgaaccagcaaggttatatgagcagggactgagcacccagccccagccctttagcccttcttactggactgtgcatgcttgagtcctgtttacatggaagtgagagcgccagcaatctacctttagagagctgtgtacccagagtgttgagtgacaccaggatagctactaagaagcagtgaatttgagtattcttactttctattttcagcattgttctaaatgccacagaggggctaaatcaggggactgagcagtatagagtccccacatactgcagggacctcagtccagaggatctgatgagtcacaagtatgcaaaaatgcttgtatagtaggtctccctcacctgtgggacattcccaggctccacccaatgactgacattttatgtctcatctggggtcagttaacataggtaatctggatttgaacccaggatccagaggtggttggagtagaagcaagagtttaggactgatcattctgtaccatgcatctcaaagcatgcaagcggagaagggtagttccctagaataaactaaaggtgctgcgcttcaggccaggcacagattccaagcaagccaaacagcaggtgtctccactaggtccaaggtagctcatttccaggttccaggctctggaattctcatggcgttcagctttccgctctggcctagagccctgtattgacttcagtgcatctcattacctcatcttccaccaggcccagatctaagcctctcatctgctgagggccaccagacagtgaaatcaggttaccctgtgcctgtaacctggcaaggcagcacgccttcagaaggcccacagaggccccgttgttcggcacaagctgatccctcatccttgatgtcagctgctggcagcatagcctttcaggtgcaccctggaagctttccaaacccaggctgcctttcactctctactttgttggggtgattgtcagcataactctttcttgtcccactggggaggcagaggagtgccatgcagaaagtgaagaaatcttactcacacactctctgctcaggccttatttcgtgagtcctggtcgagggcccgtttggactaaactgtgtgtgcagccacactcaaaattgttacgctgtgctttggggctcccggggtctttctcttccactttgaaataacttcctttgtgtttcctctcttgcctgtccagagtcttgagtttccttcctccccgtagtgttctgactttgaggcttgccaggagtgaactgtgctctgaaggagaccctctgtccaagaggccggttctgagagaagcctggttcccggctgctgtcatggttggaccctttatgaaggagtcttccatgaacgtgtctgtaccagggagtgatttgaaactgatcctgtgttcctttccaccctaagtgcctcctattgtggagtagaacacagtgctttgcctaggacccatgtcatctgagctgtgggaagatggtctgggatctcttcagtagcacgagccccaaactgagaacagcagcaccctctgagccctgtgaccctttactaacagctctgacttggaagggaccctaggggctgggtttgtatatcatgccccttcatcatttgtttagcatactccaggccgatagcgctgcacatagcaggaaaagagacaagccagtcaaacgatgggagccgccagtcttaaccttaagggagaaagggggaacaaaagagggaagggctgagggtctaggatactttaagaaaaacagttgtgggagccgggcgtggtggcgcacgcctttaatcccagcacttgggaggcagaggcaggcggatttctgagttcgaggccagcctggtctacaaagtgagttccaggacagccagggctacacagagaaaccctgtctcaaaaaaaccaaaaataaaaaataaaagaaaaagaaaaacagttgtttcaaaattacaatgtaattatttcattttccccttccctctttgcccttcctccattctctcccatgtgcccctccttgttttctcacaaatttatgacctccttttctttaattttatccagatatagagatagagatagagagagatagagatagagatacacacacacacacacacacacacacacacacacacacacacagatgtgtgggagtctgggagggttggagaacttgggccttgtctgtctttagttggaggaggaagccgggtgtgtgtgtgtgtgtgtgtgtgtgtgtgtgtgtgtgtgtgtgtgtatggggtgtgtccatctctgaaaaaaaaaaagctacaaataaatctacggtatgacctagctatcccagtccttgggcatatgcccgaaggccctggcgtcctatatacactccacagatactttctcaaccgagttcattgctgctctgttccataatagctagggaatggaaacaacctaaatgaccttcaactgagggaagggaagcttctgtttagcaagtcacgttgatccggagagccagaccctcccatcttattagatccaggcctcgttaccacttgtgcctcctcttcccctccactgggagtttgaacttaatgccatttccccttcaatgtgggaagcctggatagatggtaatttggatgattaacctaatctgcaggaaggctgcatgtggaattaagttaagcagtcctgtctgtcaggccacttaaatgtaccttggtgattttctgccctgaacagaagctgagggttcaggaaggatcgttagcttttattactgtcttaaaggaaagtttagtttttaaatttgacaagggccccagagagtcttcattatagataccatgtgtggggttggcttcttaggaaaatcccaatagaaaacattggtagggcttcgttctcccggtggctatggaaactgactggaaatttgtcaagctgtggtctaatgagaatgggtctgggagggtcagagaatatgggcctgtctgtctttagttggaggaggaagccaggcacgtgtatactttgagacagggcagcacaggctcttcctgagttctcttggatctacaggatgggttccagagtcacacttgggggcagctatgctgaccacatggagcgtttggcggcatggacctataggttacagggaatgatgctgttgctaatgtcgcttctgagccaggcttcctccctggtctcctgaagtggtgatattcccaggtgtcaaatggagatgatatgtctcagtgtgtggttatagaaagcagacataggattaaaacatacatgcattaatgcatacatacatgcatacatacatacattatggtgtagggaatcaaacctacagccttgtgcatgctaggcttgcacttgatgactggactgtatctccatcccataagattttaattgttaaagcaactgcaataaaaatgttaacttctagagcaagttaatactttatacataaaacattaactatttgtataaagtattgttctgtaaacaggcatttactattttgagttaacatttgtcctgtgaaatggtctaaggaacaaaccttgctaagtatacacaggaggtcctagaaagggcaatgagtaggaaggccaatttaatgtcagtaatttgtgttttcctcttttttttttttttttcttattagatttgtcttcggcaaagcggaagtttgcagattccttaaatgaatttaaatttcagtgtataggagatgccgaaacagatgatgagatgtgtataggtaagtcacaaccttactgaagatgagaacatttgccattcactccagcaagccttttcctgggctaggaagcccataaaattagtaagagcagaaattctgcagatcatgaagagcacagatgtgcggaacgggacgggctcctccctgcactggcctcactcactgtccagtgcaggaggaagctagagtttataggggatgctcccatccaccttccttcagggctcttggatcttgacatcccacaaccccttaatccaaccatggcactaaggacctggggcaagagtgaatgcagtggtggagagtggatcaaggttatacaatgtaagctaatgggctgagataagactggcacgatgttttagttgactttttacaatttcaaacctaattagcatgtcagtgaacttatctcaagttcttttggttttttgtttttgtttctttagcttttaaattttcacaactttgatctagtggctttccattctggcctggtaacaggaggctggagccatgtaactgtcactacctgcagagtagaagcagggctaagtggctagctccatgtgtctccacctctttgtagtttccttactgagaggctgaggtgagcttctgtgtatcaccgtgctgccctgctcccctctcccctgttccttgctttcttccggaggcagttttgcacagtgttggcatggtcaagactcaccactttgctaggtctcaatgtctattcttttcccttacattgggcatcttaattgatgccataaagggaagaagaattaagaagaaaatagagctgggattgtagcccaagggtagagcatgggcttagtgtaggctctgggttcaatttctagtaccaaagaactgaaaattgagaaacctaaggttgttcattagcccattaggttttgtttttgagtctgttgccaagcagaacagcaggatttgggtctgagcaaaggcagctggggagtagctgagtgcagtgcaaatgtatccttgttgtaagtcagcgttgcccaagtatcctgatgatttgggctctgtcattgagtgcctgttgccttcatgaaagaaggattctggcaaagactgtctgtgtttgactgctgtgctgcaggctgtatcctatcaatgagtggcttcagaactcaaggtgaaggaaccaaaggagatgccagagatgtggcttctgttgcctacagaactatttgtttagttgtcatgttccccccactcccctaaaaaaggttggattctgatgcaaaagattgaaggttaaatcctggacaggaaatctttcaattccttagtggaactctgccctttccagcctcagggctgggagcctgccagcacctccttggtcctgggaactctcaggaaagggcggggcttttccttggagaaatccttctggctggtgttccaggtgcaattaacccacatttctgggtcatcctgcctttagtggttaatgattaaagatgagggagtctgaggacagcagttgacgttgggtgtctctgtataaagggattgaaatccctaagttgctcttgtgcaaccatcatgattgaaatcattaagttgctcttacacacccatcatgattgaaattcctaagttgctcttacacacccatcatgactgaaatctgtaagttgctcttgcacacccatcatgactgaaatccataagttgctcttacacactcatgactgaaatccctaagttgctcttacacacccatcatgattgaaattcctaagtgtgctcttgcacacccatcatgctacttcacctaatggcctctttctttttccagcgagatctttgcaagaatttgctgctgttctcaggaatcttgaagacgagcggagtcgaatggtgagtgtcctgggctgaccgctgggctgctcttgctcccagacagtctgggtacactgagagaacaaggaatttgctgtcagaagactctgcctctgtgaacttgcaggctgtgagcctttgcagaatttgaagctctctgtgactgttaaagaattactagtgcataactttggatgagtatcattgtcctaaaaactcactgtatacctggggatattcacacattataccaaaagatggagggatttctttaaggccggcagaggccctcccttttgtgactgcttcctgtggtttgcttgaactcagattggtctggcagtggcagtggcagtggcaggtgtggtggtgggtagttgggggtgaagacttgagtgtgcacctgctaatgccgaagaaaggggaatggacctgctgagtctgattcttggccctgccaatatttggggccagggtatagtaagcaaattgctgtggcttgtaatgggagaacaatgcttggattctacctctgcaaatttatcattgctctgtgctgtcttcatcagaagcctcttcccaccctgggagagctttaccatcagttcagctcagctcagctcagctaggcccagcaaagctccaccctttcgggggagccatggttcggtgagatatttggccatccattgtgttatcattcctcagattctgcacttaccacgttcctggacaattactacggggcactgcgtggctagtaagcatgagttccttgtgggcagagaatggctttctctgtgctccaccatcagtcccgttactccttactgtcttcagtctctcattcgatagatgagaacacagataagatagtgcttatagtcccagatgaggatttgccttgctttccacatgagcaactgagtgctggcatattctgagtctccctaggactagaagctcagcatgggtgcctgctgaaataacctgggggtggggaagtacttcactaacactgaggtctgggaccaggaccagaggttgtgttgttggtctaaagctggcctggctcctgagatgcgtaaatgatctctcggggattctcacgtgcagctgaagtgggaaaccacttatccacgggctcagcacaccttttcaagcttcagaaacttgcaaatggtttgtaggaaagacttccataaaagcattaaacagtcccagctagcaataaaaaccagagaagttcaattctgttgctacactgcagcgctgacgtgcactctgccaagggaagtgctttcaaaattaagaaacaggcagatggggataaatagggaaaccagcccttttctgtccctcccactgtccggtccgttcttcactgtgtctgtcaagagcctctggcatttactgtgttgcggttgtgaagggcatgcatatgatttagagaaaataatgctttgttgaagtgagattcctgaaataattagttgagaggcatgtgagcaatgagtaaagattgtaaaatattgtgcctctttagagaagactgtagaatcttagagccagaacagtttagccccctcatccttcggattaggaaattagagcccagagaatttcaatgttgtgttcatggtcacacagttggcagcttgtcaagaagtcattcattcactctctaggtcattcagaaagtgtttgagtgctcctttgtttctgatttcttcaacactttgggaacactggggaatgagcgagtatttacagggtgatgtacatgtgtcagtagatagtactgaaccagtatgtggtgtatgtgttctgaagggttggatttagagagagcatctctgaattgcggttttggaggtcagggaaggcctctacagagaagcaacctttaagctgaaaccttgattataatctgtacaaaaacatcagcaggaagagacggaggcaaaggtcctgaggtagccagatttggtacatttgaggtccattgccgtaacagtgactcagagtgtgggaaccaatggctgagcactgtaaaatgcaattgggaggcagccagcggtcaggaggcagaggtctcaggccccagttaattccctaggcaactcatgatgcttgaagggtcctttccataggagatgtccaaaggtgtttcgttttcaacagggactcactactgatatactttgcctgaagcttgggtgaatggtgaacttacatcgcttgaaactggaaacttagactgcctctgttaccaggtccctccaactagtaaatgttttgcctgccatctggattcacttctttgaaaccttggaaggctgggttgagatgattgtgctgggctccacagtgagtgccttcaacaatagtaaatgtttcacaggaagatggttgcatctggagcttctctattagacacggattctctattagacagtgaagcatggggaggtgtgggggcattggtgaaagagctgctataagtcattactgaacttgcctctgccccttgccctctgcttttccttgtcagatcgagaatgccagcgaggtgctcatcacacccttggagaagtttcgaaaggagcagattggggccgccagggtgaggattttgtaaactttgttcatgcctgaaaaagacagtgctccccttaggaaatctaagggcaccacaccctccgaagacaagagagcctggttcctctgcactttgcaagtggttgaggtgcagctgtctgtggccaccatcaaccaccatgttagtgtctgttacctgattaattggttcacaaaccacataaggtaacggtatcacctccgtgcttggtggctgtatgcccggactgttgactgactagtcagcctactcacttttgtgtaactatggagtaggatcaaaattgcatttaagcagagttatgaacagggctttggggacacagggactcctcgtaagcctcattaagcaaagcacatttatttaattgtatgtgtgcttgtgcatgcatgcagacatatggcatagtgctcatgtagaagtctgagaacaactgtcaccatatgggagctggaaaacaaattcaagctatcaaggttagtggccagtggctttgaacagttgaactatcttgccagccctcagctcatttcttgttatgtatagaaatgagcatatctttgctctctttttcaattcttcaagagaaactgaaaaaaaaaaccaacaacaaaaaaaaaaccaaacaaacaaaaaatcccaacaacaacaaaaaagaaaaccagagtcttttgggacattcccagtgggcagatattttaagagaatacatatccttagtctaggtggggctcatgactgtaggtctgctttagctcagaggtcaccatttgttaccacaaacctagagacacagacaccaaacagccaaatgtttctttctttgtaattttaatttttattgaaaatacttttttatcatcatattctgatcatgggtttcctttccctaattcttcctggattcctcccacatccccatccacccaaatctatactctttcttactctctctctcactaaaaaacaaacaggcaattaaaagataaaacaacctccttaaacccccaaacaaacaaactagaataggacaaaacaaacaaagagccaaagataatgcagaagaaaatgcacatgaaacacaggcaggtcacacacacacacttgcacactcagaaatcccataaaaactcaaaagcagaaaccaaattacataaacaacctctaaggttgaaaaaatgtccagacaaatcattatgagacaaaaatccaaaataaaacaaaaccaaccaatcaaaaaaaaaaatcctccaaaagtaggattgaacttcttttgtgttggctatctagtgctaggcatggggcctcctcttaagtgtggtttgtttcccagtgagacactgttggagaaaaccaattcttgtactgttactacaagagggcaaagggaagcctgttcctctccttaagttaccaactaaactagctggctgacattcagcagagtgttatgaggccacctgcaggggagatatttttattgtaattaatggtagcaaaagactgtctcatattttcctatattctagagttatgaatgaattcaaacacagccccttgtaccatctgcagtggggtcgaggcctcaccacacaccataggttttactttgaaaactaacctggagaactcattaagagcttggttcttcctctccctctatccccctctgccttccagctgctttctagaaatagacatgattactgaaagggatgatatttagtcaaggctttcaagggatatgaaggaaaagaccaagaaaggatttttctcctggcttacaacagatttgtatcagtataagtgtacatttaggaaagaaagaaagaagtacacattggctttgtttgagaaatgaaagaacacttagtggtacttagtcttctgctaagcttgttcaagactgaatctctctgtgctttttgagaatgtatggccagtgtactctctcagtggtccagggagcaactgtctcttgagtggcctgggcctgtgttgtagtgtccagacacacatggcagaagtttctaaggagctgtggcagggggtggggtgagtgagtatttacaggggtggtgtatgtgtctgttgatagtacagactgtcgtctttagctgcttctgagcacagacccccacacacgctggcccttctttgtaatgtttgcagggttaccacagttaccagggaggagaagcacatttccctctggggttgatgtcacagtgatcctatgtcaggaacatgcacctttgccaacagatgggatgtgtgtcactactctaaggttcccccaaggcaactgagtctcctagtcacaaatcattgataattaactttgatatttggggtgatttctcatccctcttcctttgttatttcttattttcttttccagtattttccctcgacacatacatttacatcatagattcatgtaagtttaagagaaaacaaacaaagcttaaagataactcaagaagcagcctcagagacacccaagtagccaccagggctctttgcctgtttcagtcagtggcttgttccggacctccacctatttgatgctaaaattactttactcactgcctgttctctgctgcagcttttgttgctataacaacctgttgcacaggggtccttgtgaaagctcccaagaaggggaatttgtcttcctttttttttttttgttgttgttgttgtgatcaaataccctgacaaaggagagaaatgaaccctttagggagaaagggttcatttcagctcacagttccaggatacagtgcatcatgagtcacatgggtacgtgcttgagaaaactgggcaggtcacattcacagccaagacacagagagcagtgtaccctgcttcttctcctcggacctcccagtactgtgcagggtcctactctgacaggtgactcccacagtggaagggtcttccctgatcagttcacgtaatcaagataatccccccataggtatgttgaagcctgtcttctaggtgattctagatttttgtcaagtccacagttagcactaaccataacaaggccttagaactacttgtgctagaggctgttcaggaataaagtgtgaccccagatcttgacataatagtggccctaagcttatgtttctagatagagcaggttggctttttctgcacatgagatagagttgtaatgctgtgctttgtattcaaagtagaacggacacttgagcgtggtggttaagagttgacctagaactaggctgtgtgttctaaatttcacttcttcaacttgcctgtgaacttggtaaggtttctaaccccccacattcctatttcctcatcttaaaagggagatcataaaaccttaccctgtggagttcttaagaataaatgagcgaattcatataaggtacttaaagtattatgtatccatggctatttgaacggaaggacagtgttcgccattcagccattcactcgtcgttatgacgcgagctacacactgagagtagacgagaaaagctgaagaggtggttcagtggactagtgcattttctttcccagaggacccattggtttgctcacaactgccggtaattccagctccagggtatctgatggcctgtaaaccctgcccccatgcacacttttaaaaataaaaccaacacaaaataatatatgtgagagttagggttggtggctaacaagcagatatggttcttcctgcaaaagagaaaggcattagatacaaagctatagacaaatctctagttccaaattgtggtatgtggtcaaggagggtttctttcatcacgttgatatgtgcaagtcaaatgttgcatttgatgaaagggaagtggttgtggatgacaaggatcttaccatcatcagcactaccattgccaactaccaatatcaccgttgcgattaccatctctggtgagaatagcagcagcagcagcacccactaccactagcattatcaccattaccaccgttgtctcagttagcatttcagtggctggggtaaagcaccatgatcaaagccaacttgaagaagaaagggtatcaccaaaggaagtcagggaaggaactcaaggcaggaacctagaggcaggaactgaagaaaaagccacagaagcgcactgcttacggccttgttcctcctggcttgctcagccttgctttcttgtagcacctaggaccaccagcccaggagcagccccaccatccacatcagtcaaggaactgtaatgtaggtcaatatggtggtggcattttctcagtagaggttctttcttctttcttcacaaatggctccagcttatatcaagttgacctaaaatttgccagttcaaccattatcacctccaccaatcatgactaccaatactaccaccatcataacaagtgccatcatcattactatgacagttactaccagcagcaacaccactggtatcaccaccagtactataagtggcctctgtgacctccattatcacgacatagttgctattggcacctcagtaattacctcctcaccatcatcaccatgccgtggatgtagtttacttcactgaatccaagtgactctgtgaaggcagaatgttcttattttattgcagagttgtgatctggaagattaaacttgagtgatggtcttgtctagtcacactgtatagagagaagaaccctagaaagagatgcttagaatttgccacgctagagtagaaattatatatattccaggatccagaccctgttctgtatctgtccctcagtggtgtcactctctggaaggtagagacttccttaagtcctaagtgcctaaataatgcacccacctggggactattaccttaatgtgacggttaatattgactgctaacctgacagggtctgaaacttccaaagaggtggtcctctgggaccacctacatgtaggcagtggtatatcctgagctaggaacctgggctacagaaaaatgagaacgccagggtctggatagatggtttaggctgtactgctctcgcagagtaccgaggtttggttactggtacccatgttgggcagcttaccatctgtaacttcagctgcaggggatccttgaaggaaacttacgggttctttggaaagtagttggatggtattttgctgggacaaacatgtggaagaacatttagttgaggtgggcccaggtgcaagactaaggcagccttgtgaaggagtgtttccctgaagcagttacaggagacaggatgttctgctaatgcaagcatgagaaaggacatgcgatgaagggttcttggctaacaacacacatgtattggtccacctcacattgcatagttgagatgcatttgttgggactccatagagaaaattgcaccaagaaacttctggtgtgctgcagtttcatgcctcctcggactcaggctgattggcagagtgatgttgcttgagatagatgcccatgctgaaagaaaacccgtgctggggcaagacccgtggagaacacgtgatgtttagaaggcgtataaaaaggacttgatggacagtgacggaggccgagctaggcatgctggtacagctggctgtgcaatgcttgtgggtctttagtctctgctgattttcacttccctgagagaggcacagccaagagcgcctcctgttcctcctggtccctcctgctgactggtgcctaggctaggtagagagtgccactcctgctgatccgtgtttgctatcctgactctacgagaccggactgctggaggatctgtgaaatgtttgcgagtggattgagctgccgctgctgatctgtgaacagaactgccagttcctgacaacacagacaggagttgctccaaagaaccatttctaaacaggctcccttccctgtgtcctgtgtgctttctttttcactacctgtggtgggtggtgggctacaagggaggttaaagcatttaagaaccatcattaagaataggtttaagaaaaaaattaaaagttacggatcctactccctattctggtctctttgggcacctggaactcaggtgcccattcatatgatgtatacatacaaaataaaaaataaaataaatattgaaacgtaaaaggggtggtgctctatcttagtagttaagggggacacacatcatccttccagagggcctaagttcagtttccagcatccacatcagacggctcttaacaacctgcaactccgattttagggcattcagtttctatctcctagcttccaaaggcacctgtgcttatatgcacgtagccctagatagacgcacagaagtgcacataatcaaaataatatttcctcaagaaggaaaagagaaagctagctgagctccagcactcgctccctctgcatcactaactctggatgcagcgtgcccaactgcctcagacccctagcaccacggcttatgtacttgctgcactggaagtaagccaggataaagctgtgctttctgcgtttgctctcgtcgagtgtgtgatagcagtgagacaggctgctgccatactatgttttaggactttccctgcaagtccactgtctcatatatggggacgactgctttttctttcctcctgtctctctgctgtcttctctaattatggctctccattgaccatggaccgtggaggctccagtcccctgaaagttacagaatgacagtgactcgagtttcctggccttttctaagctctggccagtgacactgcctggccctaggatgctctgtggggttgctggccactgggccggtgagagtggatatgtgtgatatgagcattgagtggaattggaatccagccccaggcttgtgggttaatggacgagagttgcttgctgggacctttctcagacttggaggggaaagtgtttctataagtcttctcttcattcgtatttgacgcttcatggtttgcgtatgagtaggctcttaaaccaacctcagatctatagaaatggattcatgcctgctaagtaggtatgtgaccattttctgctctctgggatgcttaggatcttgctgttgaccaggtaaataagggtgcttaggagaacttggctcagagtgttctaccctaaggcattagcactgtttgtggccctctttcctggaaagccaaccccctgcctcctcaggtgttgagcaggtctcagcttacatcttcctcttcccactgaggccttacccttttatcactccccccccccccacccccccttaagctnnnnnnnnnnnnnnnnnnnnttgcagtgtctgtcattatattgcttatttgtttcctggtagctgtgtttctcttcctactagaatgctcccatcatgggagaggagaagtcactgcctaaagcagagcctaggacggagtgactgctcatcatgaatttgttacatggatagtgagatggcttctttatttggctggaaacacctttttcttacaggctttagagttgcacaaaacatctccctgagtcaaaagcaggactgacactgagttaggataactgagcattggtgtaggaccagagtggcttcttatcctctagcttgccctgcccactgaagtgtggagagcaaggagtcagcctgtgactgtgtctcaagtgggcagagcgtgggcagatagtgttagcttgtcgtcagctctgtcattctctgggacattttgtaaattggcttccttctgagtttccttacctataaaatagggagtaaaaatagaacgttggtgactcaagagcttggtgggagaacacaggttgacatgtatattattaaattatttttcatctttagacaataatttaagccaataaaaacttctcaatggaaggagagagtttccatgtcccatttccttgactcatagttatgtgagccacaacagtttgtcccatgctgtccctgctctccagtctgtcctatgcccacccagttacactccctgggtgtccgtcccccacggttgtcatcacaggccccatcagtgggcagcaggggtgcttctgcttttggtctgggagttgcctgcctcagtgtccatctgaggagcactcatcactgtgggtagagggagcacacagaggtcctgagggatccagccacctcaccccagtaacctcttattctttctcctccccttctccccatccccaggaagccaaaaagaagtatgacaaagagaccgagaagtactgcggcaccttagaaaaacatttgaatttgtcttccaaaaagaaggaatcccagctacaggaggtaagggagcacagagctcctgcgtggtatcagctacgcatggtcctggggtacatgctaattgttatttgtgagccagtacctggattggagatctgagaagctagcccaagcctcctccggggccacgccctccttgccccaccctcttctgtgctctctaacctgccagtggcagaggagctcagtgctgccccctgtctcccgagtggctgtgcctgtttctgagtgcctctccctttcaggctgggatctgtcttgctcttttcttgcccttggactcaaggctgcactgtcacccatctagggcaatcttgatctcctgcctcgtatcagtgacttacaagactggcatctgaaacacgctggttacgtttccttaataatcacattttattgtttcaatacagtatttgatacttaccttttcctcttttttagtttttacactattttagcctcatatctgtattttaagcattgttaatctttttttttaaagaaaatcttctttgattgagcatggtggcagaaacctgtaataccagtacttgctaggccaagggaggaggattatgagttcaaggccatcctgggctatgtaggaagggaccctgtctcaaaaaacaaagggttaggagtgtaagcttacagaacattaagaccataggtagctctccatgcaccataaaaaagaaggaaaaaaaaaaaaaacattctctggcttgctcctgggttccttggagttgaatttaaaagaacaccattgaaaattcttttaaaaagtagttaatttggaaagaaaactcagcttggcatccacagagctgcctccgttttccctgtttgagtccattaagtccatggtgggggggggggggggtgggggtagtttaacgggcagcagtgtggaatgatgctgccatctagtggacaatgatgatatgttaaaaagcagtgtgttcttcaatgactaggaagtttgcactcaaaaaagtatctgttcttcaactaatatttacactctctctctctctctctctctctctctctctctctctctctctctctctctctctctctcatatggcatagtgttcagtatgttcagtagcttaccatttgtcttcagtatcatgctgtttgatttattttaaaatttcacctttgtatatattttttcccctggcattgtgaactccttaggtaatgatttggtttcctgttaaattctgtcgtttgcaggcagacagccaagtggacctggttcggcaacatttctacgaagtatccctggagtatgtctttaaggtgcaggaagtgcaagagagaaagatgtttgagtttgtagagcctgtgagtagctgttttgttcatctgaactagccagcaggtaatgatgctgtgcaccctacaggaggaggttgagcagcccagcccagggctgtgccttcctttcagggccagagccctgtcactttggctccctggactcttcccagctcagtgatggagatggtatagtcagcatctgccttgcctctggctacctactgtcagactatttactctgcagagggaaagtgcaaatgggagtccagggaatgcctaccacactgctggaaaataatcgctgtctaacctttctgctccgtcccactcttccatcactaatccagatgtaggggtaactgcaggaagcagtggaatggacactgtagtgacctcatcctgcccctgactccagagcccctctaacccagtcaagttggatataaggtgatttttcacagtagatttgttataagcaaatagaacagcacagattcgcgtcagggaccatgatggaattcagacttggccaccatcccactgggcatgaaagagtgccatgtggaaagagtgtgacctttaggttgtcccgtcatcattatggtttcattcagctgtggtgccactttgcctacagtgggccctgagcatgggttccacataaggaaaacttcatggagactccaggccaacaagagccgccacttaaaaattatcaggtctttgctgctgtctgccgcaatacagcctctgatttagactcaagcttagggtgtctgtatacattaaaggttttacttttccaggttgtccaccaaaaacccatagacggtcaagcttgtcagtgtccctgcatggggcctcccagggcacactcctaggtgggaaaccacaggtagtcagtcagcagttatcaggggagagcatgccagcctttgtcaggctctctggtagattgcccatgctggacacctctgactgactcagtagggagtgtgtgtgtgtgtgtgtgtgtgtgtgtgagagagagagagagagagagagagagagagagagagagtcagagacagagactgtgtgtatgtgagagagagacagaaacagatagacagacggacatgaggagttgggagaatgatagggaaagggacaggagagagaggttgggaagggtgaagactgaaccttgtcaaaatgcattcatgtatgaagagtttttaaaaattagctgtaaaaagacctttctaaaggtaagaaatagtattcttaagcaaaatatgcttatttttggtgactattaattccagccagcccatctgacttttgatttgatcttttcagtaggcacattgagccaattatgtatcatgcctattagtttgggttgattggcacccacaaaccctcacatacaataggtgttgacttctcacacgtttgttgcctgctgcataggcttggcctgcttcattcggctgaacttctcttcttcctcttttgctccctcctcctcttcatcaccatccatccttacatttttgttaaaaacaaaacaaaacaaaacaaaaacatttgcagaggcagttccagctctgctgcttactaggcgagaccttgcacaggattacatctaagtgtgtctatgtgtctccctttgaaaagagggataaaaccagtacatatcctcacaggtgtatttaggatggagtcatataatgaaggaagaaaagtaaaatcatagacttacttcatgttgtccttttgtacaatgtattttcaatagcattgcacagcaccctgccttgggggctcactaaaatgcagattacaggcccagcccttcagggttcagactgggatagaagaggacagttgcatttctaacacgttgaaagccactttgtgagctgggatggcttggttcctcactgtgaaatggcatatgactgattaccagcaggaaagacactacaagaatccattgaatgtgattgctgagtacacaggtgtcagtcactgagcatttaggttccctggagggctaacctatagacatattgaccatgttagcttgtttcttagaaaataattcaaagtcccggtatatgtatatgtatatgtatatgattggccttagatagaaaaaacaaacatagggcgtggggctgtagctcagttgataaaagtgattgccatgagggcctggacttgatccctaacactgcagaaggcagatgtggtggcacacatctgcagttctagcacttgggagggagttcgaggcaagaggatctgaagttcacagtcacccccagttacacagtgagttccaaggaaggaaagtggcactactgagatctaattcatctgtccgtttgtccatttctccccggctttctcctccccactctcccgtttgtccttccttccgtccgcccatctggtatgtgtgcctgaatgaagccggtatcttcttgttgagacatcccatgttctagaggtgtacgttgcagacacctgatgtcatgaagctgaagccgtgttctgtctgtgccctgagattccacacctgaaggttggttagagcgctcgagaagttgtcccactggtctctccacctcagagttgtgtcacaagtacttgcaccactgtcttcttctcctttcccattatttatcccattgtaaggcttcattcttccctcgtcgcttgcttcctatagggggcttccccgcccagcctgtccccgctcatagcagtgtgtcctctaacacattctgactgtctctttatggaacagcttctttacactgtatggcaagcccttcccatctctgattgacttccgacatccctgtgaaataatacataccattatccttcctgctgaagatgggtgaaaggagttgtgtgacttacccaaaccagctttgcctccctcggcagctcgctgttctctatccttggtaactatgctggtttgctggggctgctgtaacaaagtactcccaatgggcttcctttccgtagaagttctggatgaaggaaggctgagtgaggtgttggcatggccatgcttctgtggaagtctgtggggaatgtgtctttctcttcctctcctaactggagtgacttgcccgcaacccttggcattccatgatttagaaatgcctccctgtgttagggtggaagcattttttggtggtatatctggtccttgtgcctcctgtggagagggatatagagagatggcagggggaaatgctgtgaggggagaagagagggcccaaatgacagcacacaaggaagattacttttatattgtatttattattttatatttttatataagttagttaatatttcctataaaaataagaccaatggaagtgaaaaccaatataaatcttagccatccacccctcttctgcttcaacaggacttggttgtgcctaggttctgctatttgagacagtgtagacactcagtaagactggtcctgtttactttcagtgaagggaaggctcagctcacagcagtgactgtagcttatcttgggcatcagtcttacagagcctaagggctggagagatggctctgtgctgggagcactggctgctcttttagaggacccaggctccacttccagcacctatgcagtggttcacagccatctgtaattctggtttcaggagatctgatgacctcttctagcctctctaggcactgtgtgtacacgatgagtagacattcatgcaggcaaaacatctatacacataaaacaataaaacaatgaaaaatgtaaacagaaagcaggctcttagggcttgggagcagtgtggggcccagcctttcagctgtacttgcagggaggaaggagagggaggagcggccttcactgtggatacccagacatcagcagagcccatcttctctatttctgaagttgtgtggaaggaaagggatatgtgccttcttctccttgaagctctcgttatctctgaaggaaagagttcagtactggcctttggtactctagggcattaatgcttagttactgacttaagttatcactagatattttacagacagagagcccaacaatgcctcctccttgacctcccattagaatacaaagggacaaaacagtgagaagtcacactaccattttaatatgacttctggagttgttagggacagggcctaggtttgtttgtttgtttgtttttgtttattttctttatttacatttcaaatgctatcctgaaagttctctataccttccccctgccctgctccccaacccacccactccagcttcttgaccctggcgctcccctgtactggggcatgtaaagtttgcaagaccaaggggcctctcttcccaatgatggccgactaagccatcttctgctacatatgcagctagagacacaagctctgggggtactggttagttcatattgttgttccgcctatagggttgcagaccccttcagctccttgggtactttctctaactccttcattgggggccctgtgatccatccaacggatgactgtgagcatgcaatagtgtctgggtttggtggctgattatggatggatccccgggtggggtagtctctggatggtccatcctttcgacttagctccaaactttgtctctgtaactccttccacaggtattttgttccctattctaaggaggaatgaagtatccacacgttggtcttccttcttcttgattttcttgtgttttgcaaattgtatcttgggtattctaagtttctgggctaatatccacttatcagtgagtgcatatcaagtaacttcttttgtgtgattgggttacctcactaaggacgatatcctccagatacatccatttgcccaagaatttcataaattgattgtttttaatagctgagtagtactccattgtgtaaatgtaccacattttctgtatccattcctctgttgagggacatttgggttctttccagcttctggctactataaataaggctactatgaacataatggagcatatgtccttattaccagttggaacatcttctgggtatatgcccaggagaggtattgctggatcttctggtagaacaatgtccaattatctgaggaaccaccagactgatttccagagtggttgtacaagcttgcaatcccaccaagaatggaggagtgttcctctttctccacatcctcgccagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctggcgttcctctatactgaggcatataaagtttgcaagaccaaggggcctctcttcaatatctttccacgaatccagtgtctctgcttttatgtggaattatttgatccacttagacttgagctttgtatagagagataaggatggatcaattctcattcttctacatgataaccaccagttgtgccagcaccatttgttgaaaatgctgtcttttttccactggatggttttagctcccttgtcaaagatcaagtgaccataggtgtgtgggttcatttctgggtcttcaattctatttcgttggtctacctgtctgttgctgtaccagtaccatgcagtttttatcacaattgctctgtagtacagcttgaggtcacagagcctagatcttattgtccataacatgtaggtttgctcacccatccttaggatgccagttaaagcagaggtcattgggaaaggaacaaataacagttccagtgaacctgcctcctcatgtccgtctttgaggccctgagacaaggtttaggtttaaatagaaggtaagaggtatgcataactaaatatttccggtcgaggtgcaatcctgctcataactgcctcagctccagtctgtcctgcgattggatgggttgtcaggactgtgtgaaacaggtttgtcctctgtccagccccaggtttcagagatatgctttccttctcctggcttgagatcctggggaaatctgttccagttgtctggtagccaaaggcaggggtgcaagcgacaattcctagaatgtactcctgccattgtggccacactggcataaagttctttcattggctgggctgggcatgcggttcatcctgaagctaacactccccctccagtgcgaatcgctcctgccaggagcaggtgcacagagcacagagtgaatgcagtcccttcccaggcctccagagaaccgcctctccgaaaagtggagtgggggaaaatacgtacagctgtgtacctagaacagcacagacgacaacagacgcatttctgaccaacgggtgtggcgggggctctggaggtcaacacacccaggtgtgccctcagcagcccaaacagctgtgatcgcaaagaatgcaggtccttcccagccctgttctacccttctccatgtcaaaactgaaagcaggcagtctggcgaggacttggtaagagcctggagggtcatgtgtcagctttgtgaagaagtacacacttgtggttgctgtaccttggaaggttgttgaggatatgaaaaatcgtgtgagaactttggtgagcatgtgtttccaccgctcagcatgagggagacgagatcgtgagcatgcttacccgttattaaccttagggggtgtcttagtcagggtctctattcctgcacaaacatcatgaccaagaagcaagttggggaggaaaggatttattcagcttacacttccatactgctgttcgtcaccaaggaagtcaggactggaactcaagcaggtcagaaagcaggagctgatgtagaggccatggagggatgttctttactggcttgcttcccctggcttgctcagccggctctcttatagaaccaagactaccagcccagagatggtcccacctacaaggggcctttcccccttgatcactaattgagacaatgccttacagttggatctcatggaggcatttcctcaactgaagctcctttctctgtgataactccagccgtgtcaagttgacacaaaactagccagtacagggggtttaaatgagagtcaaggcacccaggatggcataagccagggaggtgtatagtcatgtcatagaggggttcttactgtttactgtggggaagttgaagaaagtgcacagaactgccccttggccaaagcctgtcctgggcgattttctgtgatttgactttgctcattaggttacaggctcagagcacaccagcttccttatcacgttctgacggcatgtgataacctgatgttatccatgttctagaaggcagccaaggtacagttccagcctttagttcctaagaggtgatgctcttaggcagtggtaagcatttggtgccaaggagaacagagttccaatccctgttgacactcactgtgagttagggaggaagttactagtctctgaggtgcctcctcgctattaaggtgggtcctgttagtgcctaaagtggtgtgagcactcagtgacgcagcaagggagggcagtatccttcccacagagctgcccggtgtgtgtgtgttattaatattgcctgttctgggcctcccagacagccttggaaacccagatccttctcctctcgtccggcctctgtgacctctacctttttccccctctctgcagctgctggccttcctgcaaggactcttcactttctatcaccatggttatgagctggccaaggattttggtgactttaagacacagttgaccatcagcatacaaaatgtgagtgggggcaggggcagaagcgggaagcaggagagggtgtgtttgccgcagagcttcctctgttggcattggcacgaggtgtgtgcggtgaggtcccggctgggttcagaggacagtgaggatctggcgtttccagaatgcaagctagcccaggttcaagcagcagttctgttcccggaagcgtcgctgctggttatgtgtgtttttcatagaactgtcaggatttcctttgggagtggaaatcccagttcagcccagccctgcctagctgctttctgtgcaagcagctgcctggccaccctaggccttacgtgagtgtccaggagtaggaaagggagttcaccttaagctcaaataatgtgttctttatctcctcattcttagcaagaccgataaggtgtctaagtcagtgcccacaaacgcagttgcctctctggcttgaacatgggaattttgggtgcagagttgatgagggtgtttgggccctaagtcatgaggcaagctctcttctcaaactttgcaattgatcacaggtctcaaggtactccagtgtaggaattaggtccaggtatttctgcatggcttctacttcgtggcctttagatgtctggagctcatgtgtttctttgtggacttagagaaaagttgaagtatggttgaaatggttttatgaagcataatcccaccccttttattcaggggatgaacacaagttcccatacgtgctaggtaagctgcacgccagtcctaggggtcttctgagggcaggctttgaaacagagacccccaggcagtaaggaactcagtgcctcagtggctgagcatggagtgtcgtgggccatcggtccatcggtccatgatgcagatgcacctgaaggctttaggctgtgcctctggggttctgagtgggcctggggagaagccagaggtttcagactgctcttcctgggggaaagacctagaaagccagcagcacccctttcatgcgggtggatctgtggaccatcaaccagctacattccctgcaactggaacggtgaggaccagaatcctaaagatgtgtaatgagtgggccacctgttctggaatgcttgtttaaaatgcccgctcctggtccaagagccaccacttgctctcaggagataggctgggtgtttgcattctttttaaatttcctcagtgatcttggtgatggctagagtttgagtcattcgggtatggaaccaaaggtatactttctatttttcatttttttggtttttcgagacagggtttctctgtacagccctggctgtcctggaactcactttgtagaccaggctggccttgaactcagaaatccgcctgcttctgcctcccgagtgctgggattaaaggcgtgcgccaccatgcccggccccaaaggtatacttttgcaactgactatttgcccacttcctggaccattcagtgccccttattttcgatctaaggctgatcttctgaattattaagagatttcagctttccttcatttgatcatttgagtaaaattcctttcatggcagacaagaaaccgctttgaaggaaccaggtctgaggtggaatcgctgatgaagaagatgaaggaaaaccccctggagcacaagaccatcagcccgtacaccatggaagggtacctgtacgtgcaggagaagcgtaagtgtgtgccgaccgactggcacggtgggctgtactcgcagccgtgggcaggcgttgcttctggaggtgcctgcagatctgcgtccacaatctttgacacctccaagtgataagctctgtttcctctgtgccagggtttcttcctagtgtcactctccttgtgaacctctgtgcctcagtgtgcttgtgcaccccaccccaccgcatgggcagtgcagagctctgtcttacacaccacaccttctcgagtgccttcctatttggtgattctgctttccatcgagagtaatcatggtttgggctcttttcttcttaattcctctcactccaatactttggttttgtgcaaagtcaaagcagaagtgagaggcaggaagacccatcttctcgttatatagtgaagggaagaagtgctggggctgctactcgaatgcaggttttagtaaggactcacaattcataccttaggccttcgggaaggcttagagggatgctaaccagggtagcacctccaggtgtcaggaatgacgtattgaaattttttttttctttaatggtagcctacacctctccttcttaacaggatcttgctaagtagcccgggctgaccttgaactcaggatcatccggagttctccttctgagttctatagtcacacatctacctgcatgccaccatgcatagcttttccccaacatgatcttagcaggatatattacttctgatctgtgctggttttgtgtttttctctgtggtcctcttaggcagtggattcactcctgaaagctctaggtagagtaggctagaaacactttgttttagtgatcatctacttagtgctaatgttcacacataattgcttaggctcaacattgttcccttctgaccatggagactgaagtgggggtggaagtactggctaccataagggttttttgttctttattctttcagcagtgagcttgaggcagtttataggaagcagaagtcgcttcatttgtatatttcattccctccttgccctgtggtggactccctcactccattcccactgcccattttcggaggtaccttagaaaggcaaactctcactgtgcccctggaatacaaaggctgttactcttcttcacgcatgcatgtggaatcacttttgcacgactctgttcaaacattccctttgacactaatgtgctgcttttccttagaactgtcttttggtttcctacacattttcaggcatttcattaggatacagtatagttctggaacttactatttatgatcatttccagcttacagaaaacttgcaagaatggtgtaaagaaagcatggatccaccgatataactccccggcactttgctgctgcaatcatctctcctccttcctgtgtgtgggtgtggagtgtacaacactctcccaaacactaaggctttcctgagctcttccgctctaatgctccaccatggcacgcattactccctgatggtggttttccccaccatccagtctagacattgtgtagtctctccactgtgtggccactgttttccctttgtaactaactagcattctatgggagtcaccttacaataatgtaaaaatggttctccttgccccatgtctctcctcagagttgtggtctattgatccttgcctcgactgatctatgttgtgatgggactttcctattttagcccgtgttgccacatttattatttctcccctaccccatccttcttatctgttcatctgcacatatgtcggtccatccgtccatccccatctttccactgccaataaaattgtaagattcacatttcagtcacaggctgtaatctgtcacattactttaccttgacattcacactgtctaagtcaaagtacttcccaagtctgagaatgtttggtttgtttgttttctttccttctttctttctttctttctttctttctttctttctttctttctttccttcctccttccttccttccttccttccttccttcctttctttctttctttctttctttctttctttctttctttctttctttctttcttttggttttttgagacagggtttctctgtgtagtcctggctgtcctagaactcacttgaaggccaggctggcctcaaactcagaaatccgcctgccttgtggtatttttaaaattgcctttaatgacccaatgtaaacgctaatgtattgctttctgtgtgtgtgtgtgtgtgtatgtgtgtgtgtggggggggnnnnnnnnnnnnnnnnnnnnttatgtgtgcctatacatgtggtggccaaatattaacctcaggtggtggtccttaggtgacattctgtagcgtgaaatattaaaaatgcaccacattactgtcagcaaggcactggcagactggctggcctgttctcagcccagcagaccttctgtctcagagtttcaaagtttttccacccagctcgctaagttcctgtggagggctgttgccacattagcccccacacttccaaactcttgtggctggctagggtgccccaccaccataccttttctctggaactcagttgagtcgcttcgtgaaggaaaacaccacacaatcttagtttagaatcgaaaggcaacgcaattgttgggcacagcagctaacatcctaatgttgtaagctattttaagttacaaatcctctgatagtggatcctggaggacccgccacctgaaccaggggcctccatctgctcctgtccaccagccaagtctcttctctcctccatccctttctccaatccggaagtcctacttactcgtccagtgattggttccttgaaatctttattcttagggaaggttcacaggaagtcacctgagtcactcccagtctcaggcagctcttatggggaagtggaattagcatcagaataggaacaacaccaaggctatccataacgcattcaccttgtagttctttggagattttcttgttggcctgaagttcactgagtaggctcagcagactggctaacaagccccagggatctgcctgtctctacctttccaactgtgccccactaaacctggctttttttttttaatgaatttttaatgaattactttttaatgtaggtttctgggatctgactcaggtctgcaggcttgcaagacaagtgctttattagctccgctgtctctttggcccctgtgttgcttttccaggttattaaatgtatccaatacttggaatttggcagtcacgtgaaaccattagtaactgttaagtgactgctcgctctatttacaatgacgttgttaattttgatcattttttaaattttcttaaaaactctaggagagtttgcctcttttcttaaattttttattatttaaattcgctttacacatcaaacatattaataatttgaatattttgaggagcaaataataaataaaaattttgttcaactttcatatttatattctttcatatcttaaaaatatcattaatgaatatttagtactatccataactgaggatcctatatctagtgttgagtcctaaattgtttcaaaacatataaaatattctttgggagttaagcatagtaaaagagcaaaaaatatttaaaatgaatcattaagaaatatattcagctgggtggtggtggcgcacgcctttaatcccagcacctgggaggcagaggcaggcagatttctgagtttgaggccagcctggtctacagagtgagttctaggacagagaaaccctgtcttgaaaccaccatcccgaaaaaatatatattcaaaagcccctatatgatatcacctgacatagagagactatttaaaacatattatatatctgtatacattgtctaacaatcagtttacttaaaaaagattatcagtgtttctaggagagaaattattttatcagtaagtatattttaaaaattttaaaatagcaaaaactcattgaagttaaacattaagaaaatgctaatttcaagcacagtgaggaaaattatcaataatatttccacgatgtttgttgaacatgattttaatattttcaactgttgatattcaacaaagagagttttgatcatttctgttgtgtgatctctgtgaacatctaaaaccagtattgattgaagtcctggtaggtcaaagatgtgttcatcttctaatagcaccttgctcttgaaaataaaggaactggccaggcactgggtatagtcagagactttggtgggccttggtactctgatgttgtcctctttcctgagacagattgcattcagctgctgtttagtcacttccagtctgcatctctggtgtttctgaggtttccatgtctgcttttcagatctttttgagttctgctgaagtaaaaattaggggtttggatataggtcagaacccctgaggttaggcactgggcagctgtgtgggaggtatgacgaaaatggtgattgacacttggaagagcatgtctgtgctctttcctcagtcacctcagtcagggaagagaatggaaacttcaaatggagactaatggtgggaatgtgactccattttcccggggaacccatacttcgcctatatttgaagacccactggatatagcgttattgggagtttggggtcctgtctatctgtgtggggaaagcattattttggtttcactttcggccttgggatcagatttctctatttcagtatagctgtgtatcattaccaccccccaggcccctctcccccaaaatgcatcagggtggacgaaagcgttatggctgagcattgcagcccacatctgtgatatggccgttaatgatgtgtgtggatgtgtgtggatgtgtatagatggctaataggcaatgttcccttgcaggtcactttggaacttcctgggtgaagcactactgtacctaccaacgggattccaaacaaatcaccatggttccatttgaccaaaagtcaggaggaaagggggtgagtgctccgtgaaaatgccttgcttggtttgctcagtgagcagataacaatcgtggtacatggctaagagtccagcgtttcactgtaagactcttaaattctgtgcagtaattccaggaggcctcttgccctgaaaatggctagaataatcattgttagcttacttatgtagctgtaattaagagtcttttattttccatgtacacattattaaatgtgttgcacagcaatgacttactagaaagtcgtggctgattgacgaccttctgtgggactgatttatgactcttctgctgggtccctggagttgccagtggacagtttagataaattaagttatttctgtgttatcaaattacccctatactttgcagctttcaaaatcatagcagctaccttaataattctgcatagcctttgtggatcaggaactcggggaccatctgatgggtaggaggctgaagcttagttcagtctaacagcagtgtggatggaatctgtggacttgagagcttaaggctggccagacatggctccttcctcctctaaccttctctctattcctccacctgcccctcttctttctgtggtcttggactttgtgggatggaagatactcagtgactgtgtttttgaagagactgccaggttagagcaggctccctggcactgctgttggtggctccttgtattctccagggtgcttccctttatagaactctactgcctcttgtctacctcggacagttgtctctgctgggttctcagtatagagatgatctgtgtctcctctgggctgtcttcctacccagcttctccttcgtactctatatttcgtcatgtcctaggatggagggttttttgtttgtttgtttgtttgtttgtttgttttttgttttttttttaaagctgattgcttggaagtttttgttcaccttggatttatggttttacttgaattcagaactggaaaaatgtctttagttactaactttgaattttacctctccctaatttttgctattatttccttgtggttatacttaactgttttaataagaatatttttgtttttcctcttctgcccatccatttttgtaagacagtctcactttgtagcctaggctggcttcaagctcatgtgtagtcaggctggtctccaaccacagtggttctgcctctgttctcagcctgtatatttttaatctttttgaatatctggaatacattttgaataatttatctggttctatctttggtttaagttgttttttgtttcagttgtgtctaatatattggtaagttagcactttgctagccctcctcgcctggccttctatggacatttttgtgtaccaggttgagttattgtttggagggcattcaagtgaagaagtggaaagagcacagatttggagactagacatgcctgggctagcgctggacagcgctgtgctgtgctgtgctgtgctgtgctgtgctgtgctgtgctgtgctgtgccgtgtgccgtgtgctgtgtgctgtgctgtgttgtgtgctatgctgtgccatgctgtgctgtgtgccttttgctctcttcagctcccagcttttcttccaggatctcttcttttacttcagtgacaataaagagttttatcaacatctctgttcattccttatatccaggcagtaagacagctctttatttttctattattattattattattattattattattttggcagaggtggtagtggcttacaaattatctcaggaaaacacacatgttagcagacagagatagaagagagtattacaaattatacctaagtcactaggagtcccctggttttcatagaagcaagcctgctttgttcggtcatggtcttggtcctttcctacctgtcactccttccggaaaccagctgactggctcattcttgtccacagggttggctccaggactcacatcttacgtgtttccaagagtttaaagaactcagttgcatctcacagttcctatctcagtgaagggtgaggctatatacagtggtcagtgtttgggtatctaaggacttctgtgagatcccacagagtagcccagtgggttgtcagtgtggggcagggcctgagaaggtccgcttaggaacttgctactgtaacaagtcatcctcctagccctaactggctgtatttatgctccatttcatagtggcctgtattcttgatcctcttgggttgtgctgctctttggttgagctttccccttctcacaaagggagaaactggggatcggagagatcagcttacttccaaatgtaaacccgttgagttccagagtgagtagactaacctcccagtctggagttagcaactcctgcttcccaagccacatcttcttctgatgccactgtgacctaagttgtccagtagaggaaatgggagcacaactgtctaggggtctggaggtgaagtgctagcagtttgggcacgtcatctttcatttagactgttttcctttcaaagtgcctacactcctttctaccccagcctcaggcttgattttctgagcagatttgctccatcctcttgagaccagacctcgtgtatggttaagaatgtctttgaatcccaccctccaagagaggcagcccctgaagcctgcagtagccagaccaggcttggtccttgtccctggctaccctttattactctcctgacccttacgggatgagactataatcccagcctcgctggctctcctcagcctcctcctttctttttttgcctcttaccatgggcttctggctatacttccttccctctgtctgccctttgtgctaatgcctgatgggacttaatagatctccgttacttactcttttttcatggtccttaatctaagccttcataatagaagccggcccatagctattgaatttgaactgtagttgaacatcaccaaggtcaaatttcttacatttgggtgagtacactcatcaaaggacagagctggaagcatggagttgaaagaggttaatgactgtattttcagttctagaattaggcatcactatttcatagaactaaacaagtgtcgggtaaggcaagcagcagactttagttttaaggcagaggaaggcttaagaattcagaaacagcacagaatagttggtgatttcaaagtgatttctctggtttgggagtgcaactcagtgaagagctcttgcctagaatgtaggaagctgcaagtttgatcccccaaactgcaaacaatgataacatgaaacttatttattttataaagtgggtacaggagactattcagtgggaaatatccagttgattaatatcaggcaatttaggttactccatgtgtgtgtatctgtggaataatcgaggcagagaaaacttccgttttccttgctaattgaagtaaacctgtttgagcaattggactgttctctctcatttctggtttcctgggagataaacagcttagtttcatgatggagaatatttgcttgggtgactccaggttgaattttagtctatttttcctttcaggtccaatgtaggaccttagtctaaaacagtgtcccctgtgcgacgctgggtctctaatctaaggtctcccatataccaggtaaagactttattgcagagatagatcttcagcccttgtcttctgaggtagattttgctaagttgtccagactgaccttgaactcatgtagcccagactggccatgagctgaggagactcctgtctcagcttcacaaatagctgggattgctagacaacctcgtgcagcttttatttaacacacttttgcatcttacagagtgggtaaagatcaagtctcaatccgtgaaactaatctttgctctctagtaagtaggtatagacgtaaggcatatgaacaaaaatgttttcttcctagggctgtgtttgtctgctttgctgattttagtgggtggttacatccaccctctgaagttacacttcatcttatgttggcaaggcaggtgaatttgttaattttacccttttagaaaaacatgggagaaacagaagcattaatagatttttagtgacaggaagaagttgcagtgagctcttgctgtgtttctggacagtcagtgagttctgtgagattgtcatattccacacactacctagtagtaaaaaacccaactcttgatatgcacagcatggacaagccacagaatactcatgcttaatgaacgacccagatacttactctgtgtctgcatttgcataaggttatagaatgcacacaaacccataagagcggaaagcagacccaatggtttcttggaggtgatctagaaggtgggtgggtcaccagagggtgtgtttggcaggcaggggtgggagtgttgaaaaagtttatctcagattcatcaatagcttgatgcctatctacagatgtcacagtaacaagttgtacacattaaacatatgcagtttatcacatcttattcatcaacaaggccgatataggttgaacaactcttctatccaggacctaggaggactcagaagatacaagagtagtaagtaaagaccacaagcctctgtccttagggcgcttgctgccttgtgaacctcccatcagacttgatgggaagacgttgttttattctgtgtcttccgtagcagactgcttttgctatggttagtaccagtgggacggagaggtagttggcgccacctgagcacttcttagggatcttgacctgtttcttgaagaaatgatgactaaccaaggatcacagtcagtcagttaggaggggactgtggtcttcatctcttgtcacctctgcaaatcaaacctggttgaaatagtagtactagatgtgcactgtgtaatgcagcagcacccatcctctacctgtgtgactacgtcctagggcttcaggtcttagctgtagagatgcatgcttgagacgctcaatggtcagcattccctctctgtaggttgtgaccccacagattggagaagtggaagtgtcattctgtcgatatgccatgctcgtcccagagtcccgcagacctgcctgctggcctcaccttgacagtctgtgtgttcccaccagggagaagacgagtccgttaccctcaaatcctgcacacggcgaaagacagactccattgagaagcgattctgctttgacgtggaagcagtagacaggtaagaggcttaggcaatcttttcaggagcagattattagtatatttggatttctttcctttcccttaaggttcactgtttgtacccctgcccccatcacactcttctgtgtccagttggaactggatgctaggtcattgcagaaggtcagttcagcctccggttgtttagttcacgtctgaatcaccaggtttgtttggttttactttaatgctagtcttccatgctcaggaatgtgtgctatgtctccgggaggtgggatagatatttaaagaaaatagtctgtacaacatgatgatatcaggtgtttggttgtttttttcctttaaaaaattaatataacaaataagaattgggaatagaagttttactcaaataactttttaaggcttataattaattttcgtttatacccagaaaatacaccaagtcacttccttaatcagccaatagatagagaaatagacagacagacagtgagcttatgtgtcttctttcacatctatggttcaacctctcactcaaatgcacacatggtactaggcttgttcaacacgattgcagttctttgagacactttccatggcagtggattctttcagtggaatccgtatgtggagcttatctgagctgcctattccatgtcagcaggcttggcatcggggcccttaaacctcactgcaaggcccacacaatgccaggaagtctctttcctaattaaaaaacaaaacaaacaaaacaaaaaacccaaaaaccaaaactaaaaccaaaccaaaccaaaccaaccaaataaaaaagctctatgctgcttaccagaccgcctgtgttttccatgtcttcagaagactgcctgggtgttaccttagggacagttaaaatcctctcagatgtcaactcttgatgataacacatccaagaaccctcgttcatcatgctcataaaaacccttggcaagccaggcatgggggtgcccacctataataccacctcttcagaagatgaagccaggaggctctcttgagctcaggaactcaagaccagactgtgttgttagtaagaccatgcttccaaaatagaaaagggagggggggaggctttgcaggccattctgagccaagagtaagtgtttcatactcagcatgcagaatagacccggggcagtccttttcttctgtcacactcctcagcggcttgatacagatggcgtggggaggatccagaaggagactgtagagtctccacggaggagcaggtggattggtaggagggtgactcagcctttcctttgtgttcccaggggacctcatggattaggccacagctcagcattgcttgtcgccccttttgtttgactctggtgtgttatagactgctcacatacccacagagtgtgaggtggggcagtaaagcaactgtcaacatgacccctccattattaaggaagatttttattgtatgcctatagagagaatggccagaggcttctagaagagtccagagcagagagaaaaagtagactgagcatagccagcaggttggacatggccagggctagggaagtggagaaaataatgtggctaataagataggaagacatagagaatagtgcatagtgagagcagtgagggttgggggagacagacagacagacagacagatagacgcacagagagagaatagtggtttctaaggagggtgagtagcaggaatagcaggaaggagactgggataggagctttaaaatgtgtaacaggtactgtgatactaagggaccctaccccccaccccgtactggatgggctttgatacccagccataggctgtgtcctttgatttgtcctttctgctagaggtaaggtgaaatgaagcctcttggcacatgggaactggttttacaagttcccgaggaatgctggctcttatctaactgccagaaatcctcctatagtcccggctgagctcctttctggatatttggacagcctgagacctgacattggataagaagtaaaaggtctttctgtgtgctaagtgacacctgcctggagagctttactgtaatcctttttctgagggttcccaccccatgcttttcaccagtgcccatcagcagggaggggctgccggtgctagagtctaattttctagactgtgcctccccagagtgctctgtcttgcttgctgtgtctcggaggcacctaggaaatgaatgcaaaagaggaactgacagaagggctgaaatgttcccagagtgcgttataggaagattagatacactactatataataagttatataggagctgctaatgtggtaatttatcaagatgcaagtgtgatttatattatttagactatgaaaatatggtgtgaaatatcccaactctgtaatatgtggtattaatggttagttgttagtatcagcttggcacatttttgaatcatctgaaagaaagtgtcatggaggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaggaacagacacagtgagctgagctaagcatgcatgtgcacagtgctcttggcttgtacaccctgcatgcagtgtgataagtttgccttgagcagctagagccatgacttccccacgactatgggatgtaacctggagctatgagcaaaaccaaaccctgtctcccctaagttggttggttcagggcattttttttttcacaattacaggagaagaaatgaagacaggccctgattcaccatagctggtatgctaggtagcagggagttacagatccataagcaggcacacgcgtagagaaatacccatgaacccgaagacagaggacagggagagaatgggactcaagtaaagaaacacccggctgctagcaatccaccaggcagggaggaaggcatggagtaaatttcgtggacttcaggaggagtcaacttccccaacaccctgccttcctcctgtgtggtgcttcatcattgaggtgcagggagctggcgtagtattgagcagggaggacctgccagcgaggtggaaggacatcccaccaaggccttttaaatggtggccattacgcaccccctgagtccctacttcatgaaatagaccatttgcatcagctgcctaatcttttctgctgtttccttccacccaacccttccctctccttttcccatccctccttctcctctcccgcccccctttcttcattagtagcttcagttccgtagcttaaaaaaagcgaacattacctatttgtggtttttgtatcatcatgctacagccctagcttttgaaagtttatattttacatgggttaattgactggctttaactttctttccccccttgaagtgggtcagctcttccgtgcgatgcttgggttaaaagtgggcatcatggaagagcagcctttcttggtagtcagatgtggatcatgaatactaaccagcgtctgtgttcagtcacttgaataattagctccatcatgaactatcttatggaaattagtgagcaaatgtagggaaaatgtttacttacgctgaagaatcacgggggagtcacttgccagcgtcctttggattagtttgttttaaagaaatgtctcacagatgtaagtgacacatagattttctccctaatgttctccaggagcggccactagaccatatgggaaataatagaaatagaaactaaagggttcttttgattcactgagtcagagtagtggggtggggggtaatgtttatacttggggaaaggaaacaattagaatgctttattttatttatttatttttttaagactagctgactccaacagaaactctgttaaaagcttctttccagcactgccaaatgcacaagtgtggcaaagacagatcgctagatggcggtggtagggaatgacattggggacagggaactggggaccacaggtggcacagagacacctatacccttgaacttctgtctcagcctcccaagtacatgagactacaggcctgcaccccaggcgcagcctagactcttctgacagatgtcacacgtaggaagctttaccagtctgttggcttttcttctgtaaaagcctcacctggttctttgggtaattctgaagttctcctgcaaatgctgcactagcagtagggagctagctttcctgagcctttctcagcgttccctaacgcacaccctgccagttctgtccctgccttccccacaagtaccctgcagtagccgggcaacaaagtttctttgtattggttggctacctgttcagtttggaatgtcttgggtacttctgttttaattctgtttatctcagatgatttgcttttagaggcagaaaaaaaaaaccataatttcttgtagccttgaatatagtactatgtgtatgtgattgcccaatttaaactttttatggtgaagacagttttgaaagtgcattatttattttttttccctttgggagtttggtgatgaatctagagaacattagttagctgttaattaaattaaagctcaagcaggtacacacatgatttgcttttgtgtagcgatatggtagggtagttgaagccagaatagcagaagctagacatttatggaagatctgaattaaaaaacaaacaaacaaacaaaccatcagtaccctccagtcagccagcaagcatctttccaagttgtattttcatagaagttttgcaaattgtaggctaaataaaagagagagggagccctaggtttgaatggaggacttgactcttactagccatagggacagtagtattaagatggagttgattgtgactgtcaggattgttttgaagatgggaatatagcagtatgcctttttgatggtgtcccgtgagtgcaaatgttgtttttgtatgctccaaaccatgggacttatgttttcttatgttaaaccttatctttgccagaagttcttcccacacctacttgctgcaagcttgcttcttttcccctcgccttgtcgattcctctgcaatatgagagtgaatttaggcacaggaagggcccccgtgaagaaggcccaccagggggagattgtgggtgcagtgctgtgcttcataacttgattgccacaaaagagaaagttttatgtccacattcagtttatgatctccccaggaaaccattctaattttaaaggaaggcagtttatggtctggcttggtacgagtgtgtgagtgggtcgttttgtgtgtctttgggaaactgtgtgactcttgagattgttttccaaagagaatcgatcctcttacgtaacggacagtttgactgttcagcctctagatggcagttttgtatgtgcattggttgctcttgggtccagttgaatggtactgtcatttagagactggtgatccgaagacagctgcgtgtgtggtttctgtagaagcggcagttatatatatgagtattactacttaaggcagagagtactttcagtgactcaggttttctctcgaagctccttgctctcgcccttttcacagatcatccatacccacattctggtggcagctagctggcctgcccagttcgtcaggcctctgaatattgcagtttagctgggtgaaccaaggtgctaggttctttgcttcgggataatgcatgcgaggacagcagacttgtccttctgtccagcctgtgctgagaaccaggcttctccatccagttgcagcctttatctcacagagccacagagcggatgaactgtttttcctggtttggggctttccgcccctccccttctcgtttgcctgtttgaaatgctacttgactttgccttcctgcccattgggttggagtgctggtctctatgccattgacctttcaggcaggaaatggcttttccttcctcagagggtgttatgctgctctgacttcatggccaggggtggggtggccagtgggggatgggcatcattctttctgaattgcttcctggctcttagggatagatagcaagccgtctgagaagttcttggactctcaagttcacaaagtcagaacttactcgagttttgggggctttgttttgccttctaattaagtggaagcgctggctgtttgcacctgtcttaagtaggacgggctttggcggttagtggagtgcatgagaggacgacctaggcaacctgacttctagtctctaatcagtgcagtgaaatttgttgggagtgcacacatttatctggtagtttctcaatacaggacttaaactcaacaccaaaaacttgctattacagaaatcccaagaaagaaagcaaggaagccgcaaattccacctgttctgttcatcataagactgaaacccccccccccaaacaaacaaacaaacgaacaaaacaaaaggaaaggacaattagaaattgtccaaattaatactttggcaatctggcagcaaccgatgctatttccaaattgactacaaagaaaacaccccatgtttatcatgtgtaattggtaattgctagaaaattatgtgatatgtgaattttaaaatgatgtaacattttatatacttttaaaaaataaaagtgggttatgagaggttatagagtagaatctatgatagataacattataattctttacaatggaaacattaaaagactctcaatcagcaacatataccttgttaatacgaaatataaaaataccccattgagcagtctctatcaagtcaattcactatggcataaatatgcatatatattggtgaactttttatatgtatgagtttttttataccttttgaaattcatgtatatgttaaacttgggggggaaaaaaaagactgaagagcccaaatggtgcagagggtggccgatgaacctagggagagatttgcttagcttgctgtcagtagcagtagcaaggattcacattgaccttgcgttgcacccatcccattagttagtaatgctttctcctggtgcattgtggtagcctgtgcctgttgctgtgcctggcacacggtactcacttagaagtcagtagcagttacattcatggcccacaaagtttagtatgctagaaattcatctgttgctctaggacttgaaaatcttttaaaataactctgcgtgaaactgtccgatggggttggcagtgtttattctctggactctttctactgccagggccctcctcattctccaacctttgctctcagaaggtgagtgctgtatgctgttgttggtgatgatccattcattcattagaatcagattctttccagatcattgattagacgctgcttcggaaaacctcttagggagtgtgtggaaggaggttactcccttccttcctctgtctaagctgatagccttcttggactctaggcacatacactccttacagataaggtcactgcagcattggttgagacttagtgtaggccttgttttagtttctggcccacctggatacaatgtcagagttagcccttcatagcaacgtggtatctttcacttttagaaagagtcccaaagggctgaagatgtggctcagtggtagaagacttgcctagcaagtctgagccccaagttcattcaccagcaacacaaatacacacacacacacacacacacacacacacacacacacacagagtaaataagcaactgaataagataaagggggcccaattattttcacatttaattcatatatttattgtgagaaagaagtgatagttgataacatccttagcacagtgtttgacatgtaataatctttagcatagtgtttggcacatgtgggagtcaccaacctatgacctctagtttctctcgcctgtgatccacctggggagtcaccaacctgtgacctctagtttctctcgcctgtgatccacctgggtaccttgatgggtggcagctgcctctgcaacctgtacttgctccgctctttcttaattcacacgcctctgttcacaagtaaaaatgcagaagagatgcaaggctacaggttttagagaaaggaacccagctctgtttccttgggggagtaaagagcttcttgcctggctccctttacctggctgcttgcctgctttctataaacagatgtggggttggtcgtatctgtgcagactttccactgtggaggaagtatcaagaagcagttttcgaggcagggctccctctttctgtcatctgatgagcccctttcacccaggattagagagtccaatccccaaggcttcgctttcccaacttctaagagcacagtgggacacattttacacacaggctatagtaagttctgtgggtcccatagtccttcctttcctgtcagtttgaccctaagtggtgtggatgggagttaggagagagctcatgccacctggagatttactattacgaatgagtaagccctagatctttggaggttgatttagagagaacagtactgtgaggttctggttgtgtttgtttcagtggggtggagttagtcctcgcgtttccttgtccaataggaagtgggtacattgccaaaccactgagatcactgttgttgactctgattcatgagtgagattagaactagaaagctctcgaggaaccccagaatcagccatgggtgtgctttttgtgttcttggctgatggacagagggctttgatggaccctggtggtcctagccttctggatataatcctctcttggatagtttttgatctcttttttttttttttaactttcttttgtcagcttgacattggctagtgttttctggggagggtaacctcagttgagaaattgcctccatcagattggcctgcaggcaagtccacagggcattttccagatgagtgattgatgtgggagggcccagctcactgtgtgtggtgcagcaggctgaactagccaggaggaacaagccgctaagcatcttcccttcacagcctgtgcttcctttcctgtcaccatgcttctgccctgagttcctcccctgagctctccttcctcatgctctcctcctcactgacagagcctaaccagaacacgcaaatgctatgtatgctgcttctctgggggctctttttggaagccagccccagaagagacatggcagttggtagcagcttgccttgagataagtgaggactgtctttcctttattatccttaccatgtttaaggatttcacatgcactcacaggtgcacatgtacacacacacacacacacacacacacacacacacacacacacacacctgcatcattcttatgacgagacgagagtatacagcgttgagaaactcgcaggtccttgttcgtgctccccaggctgccccagctccagcactaacaatgtgttcctggtgaagaaatgtggcttctgaggagaagtttaggggtgggctccaggaaggatctttaaatcacttgcaccctctctcatctggtggctggagggaacgtctctagtggaggttctcgtatttgccggagacttctttgcccctctcagttatcaggcattagttttagactggagtcgcagtctactttgaagctgttactggggagggaaaggaaatagccatgatgtcagggctggtgtttgcggtaggggcgtgattttcagtctgagggtgtgggtcgttaggtggaccacagtgccagcacgtggttcctttcctgtttaaataattctcctgcccttctccaggcattgctatgatgctctcccatacttggtatcatccttcatttgcccattgggattgactaagtttctggagtatttactttttttgccttccacttggaaatgtatgatgcatttctttgagtttgcaatatagtcaaacatgtaactctgccaaccccccagggaaaagcaactggacctctctatctggcttccagaacatgtagtctcacatccaaagtgttatcaagaggttgtaattcttgtacagttaaaacaagttcttaattgaggttccactgtaaaatctacatatctcaactctatgtttatgactatgcataagtcaagtctgagtatacatagccatacatacatacatacatacatacatacatacatacatacatgtacatacttccaaaggccctgatcaagatgaacatttatagccttgaagttttcttcatcctcatcaccatcctcatgccgtaccccttcttggaggtaaaataactcttctgtcttgtgtgaggtttttaagggtttgaacactatgaaactccagtcattcagtctgtagactttgcctcactgtctgtgaggttcatacctaaccattccgtgcagcactggttgccgtttgcagttgttgcctggtttcctagcgtttagacacacaacaatttgtgtgtcctctttcgttagacatttttgttgctgaagttgtggttattatgaatatgatgacaggtgaccttgactgtgcgtggtggacataggcacacatctttcctggtgttatatatgggagtagtatgtcgaacgtgtggtgtttagttctaggagatactgaaaatgtccttattcatttaatttctcaccagcaaagcctgagaatcgcaacactaaattactaagtgaccttttaatgttcttcattcaggaggtgctaggtggggctcattcagcttctacattacatcccctcaatgaggagccatttgatgtctgcttcttatatccactggccagttggatctccccttttcattttttattcctctctctctctctccccctctctcataaaggcagttatgtgctgcctgacaataggcaccatgaagtgagctggagccttctgaagaagtcttaactgctgagccaactctccagcccttagatatcctctcttatgaagtgtctattaagattttaattgaattttgttgttaattttctccgtttgttagcattcttcacatatctggaatatggatcttgttggagatacatattaaaaacattagctctcactttcattctcaatttttttttgatttgagatttatgttttggggacagggactcatgtagctggctttgaaatcactgaagatgactttgaacttctggcccttctgcctctacctcccttgcggtagaactgtagctgtgttccattatgcctggcttatgtggtgctgggatctcaactcagaacctcatgcattgagataaacactctagtgacttaactacactcccagcctctgttttcattctcttaatattatcttctaataaatgcatcttttttttttggtaaggtctaacctaccagtgtttattttctttatgatagcacctttaattttaaattaaaatataattataacacacacacacacacacacacacacacacacacacacacacacacacacacacatttccttcttttcctttcctccagcccttcatgtatgttctcccctatcccagttcatggactctgtcctctttttcatgttgttacacacatgtatatatttcttaagtatataaatacagtccatataatgttacttgcatgcatatgatgattccagggcagagcactggtattagataaccgactggggccgtgttcctcagccttccttactagcggttagttctttgtctacggctggtccccgtgagacttacctcttctttgttagcgtgtttgttgttgtccttgttcaggtcttgtttaggcagccatgctggtgagatttcatgggtgatgtttccctgaaagttttaggggataaagtctcaatggctcttagaatctttctgccaacagcacttgttttgttctattaaaaaaaaaatcagggcctctctttcactttgttgtcttgaggtaaaatgtgaagagccactgctgctgaaagtcatccgaatcccgagcggtatgactgtgttctggaggaagaagagtatttaggaagcactccggtttacagcgacactcatcactgtcacatttgattccacgctggggctcttgggatccttggtccgttttgatgccagggaattgggtagtacacacaaattccccaggggctctggtgcccccacaccgggatggtatatctcataccagggttaggagttggatcttggtcgcatcctggccctgtagcttgctgctgcaatcaaatcagagtttttacccctctgagtctttgttttcttgtcttttaaataggagtaggaagaatgcatttacctcctgtctaggcaccaagactaatttattgagtgctcagcacagccagtagtgtgctctgctggactaaactgttgttctcttgttacaacgctgctggagcacaggggtgtatagaaccaggaacatctccagccctgcaccccacttctctttcattggtttatatttcctgtccatgtcccacgcatcctctcctttctcccttactccttcacttttgctatgaagaaccgacacgcattccagtcaggagctaaatagatatgctataagagaaagcctggaagtttgctgatatgcagagtttcatgtcacacaaatttttttcttgttttattttgtttggggctatgctaccaatctaggagactttgagaaggtaattatgagaataaattattgtttgattctaaaataaagccaacccttttatcttggcctcttaggaaagtcctaagtaagatttatattagtatttttaatttaataaatgaaaaaaatggatatttctacctaaaaagtacagtgctgtatccagatgtacatatatgaagctgagaaagttctctgagcttggggaatacaattataactaaatgtgttatatctactttaattactatccatcatccagagtgtcaccccccacacacatgaaaaataatttgcattttttttttcgagacagggtttctctgtatagtcctggctgtcctggaactcactttgtagaccaggctggccttgaactcagaaatctgcctgcctctgcctgccaagtgctgggattaaaggcatgcaccaccaccgcctggctataatttgtattttttatttctatttgaagtaaaaacagtcatattggcttccctagttactagtacccaataacatgcccacgcccttactgcctcttgagttttttgaacttcctcttggtggctttgggtggaactattatgccataggccatgaagttgatgtgccatctgtgatacctctgcactctcggtgtttgggcaactcttgtgtttacaattgttttcttgcaggaaggggactggagttatgttggctgcttgactcccagcatagagaggagggtgataacactgctagtgcagagaacccagaaggaaaggcgagggggtggagctggttcagggcatgagccttaggcataaccatacaaacatagaacatcatctctcctctctgtgggctttagctctgattttctaggcccagcccagaagtttagtttcagtagggttgggttagatggggaatctacatttttaaaatttttaattaattattttatttatttaaatcccaaatgttatcctccctcttagtcttccctcccagagttcttccctctctccaccccctttgcttctgagagggtgtccccctaactttttccctggggcatcaagtctctacaggattaggcacatcctttcccactgaggccagacaagttccctactacatatatgccaggggagcccgtatatactctttggttggtagcttggtctctgggagctccctggagtccaggttagctgataatgttggtcttccctgtggggttgccatccccttcagttccttcaatccttctcctaactcttccataggggtccccgacctcagtccaatgcttggctataagtatctgcatctgttttagtcaaatgctggttgagtctctcagaggacagccatgctgtgtgtgcaagtacaacatggtatcagtaatagtgtcaggatttggtacctgcccatgtgatggatcccaagttgggcaggtcactggttgaccattccttcagtctctgcttcatttttgtccctgcattctttaagacaggaacaattttgggtcagaaattttttttttggtccacttttttttaaaaatattttttattatgtattttcctcaattacatttccaatgctatcccaaaagtcccccataccctccccaccagttccctacccacccattcccatttttttggccctagcgttcccctgtactggggcatataaagtttgcgtgtccaatgggcctctctttccagtgatggccgactaggccatcttttgatacatatgcagctagagtccagagctccggggtactggttagttcataatgttgttccacctatagggttgcagatccctttagctccttgggtactttctctagctcctccattgggagccctgtgatccatccaatagctgactgtgagcatccacttctgtgtttgctaggccccggcatagtctcacaagacacagctatatctgggtcctttcagcaaaatcttgctagtgtatgcaatggtgttagcatttggaagctgattatggggtggatccctggatatgacagtctctagatggtccatcctttcgtcacagctctaaactttgtctctgtaattccttccatgggtgttttgttctcaattctaagaaggggcacagtgtccatactttggtcttcattcttcttgagtttcatgcgtttagcaaattgtatcttatatcttgggtatcctaagttttgggctaatatccacttatcagtgagtacatattgtgtgagttcctttgtgattgtgttacctcactcaggatgatgccctccaggtccatccatttggctaggaatttcataaattcattctttttaatagctgagtagtactccattgtgtaaatgtaccacattttctgtatccattactctgttgagggacatctgggttcttttcagcttctggctattataaataaggctgctatgaacatagtggagcatgtgtccttcttaccggttgggacatcttctggatatatgcccaggagaggtattgctggatcctccggtaattgctggatcctctggtagtactatgtccaattttctaaggaaccgccagactgatttccagagtggttgtacaagcttgcaatcccaccaagaatggaggagtgttcctctttctccacatcctcaccagcatctgctgtcacctgaatttttgatcttagccattctgactggtgtgaggtggaatctcagggttgttttgatttgcatttccctgatgattaaggatgttgaacattttttcaggtgcttctctgccattcggtaaatttaaaggtgggttggtattcccatacctccactaggggccctgtttaactagtttcttcaggatccatttccccactgatgggcattttggctaaggtcacccagtttgagtcctgggcgcctaccccatctgatttctgaggtccagcccagaagttccatctcagtagggtggagttgggttgggaatctacattttttttttaaagatggtttgcttgactcaaataggtggtgccagcaaagaaagcacaacaagccaataaggaaaagtagggtagcactggagaaggggagctggggcttgcggactttgcagcaggctctagcttcttgggcttttgatttcaaagcaccttgtgcttggttttgaaaggtgggaagggaacatgaaatctgctctttctccaggccacaggctcagttctatggaagcacagttgtgagcagtctgcaggtatatggggactctggcatgtcacaggggctgctggggagaaatggtcatttgagtctgaggagagggggagggccctggcagatgctgtggaaagaaagtgagtctgtcctggactcacctttctcctatggtgctaatgcccagtgtggcttcaaggaatgacctccttctcaggagtcagtcctcaacacacctgcctactctaaatcttacatttccccccccttctgtctgcctcggtggaggaagacgcgtgcggacatctcctctcctcccctctctcctttttctccttcaccccatgctcctcgcatccctgacccttgcttttgattgtgatatctttgaaagtgtagatggaaggcactgagggacagtggtgaaaaagacacagctgtgtgtttaagcatatatgggacatctgtcctactgactgaaccatggaaacaatgggtgagcagagatggtagagattggcaagatgcttgctgtcttggtcctaggcttttagtatcacactgagggcatgtggtcacaaaggcaactgaactttagttcttgattagttgatctctttttgtctcctccaggatttctcagactttgaagatgagggtttaaaagagttattcttaaactatatatattatatatacgtatatatacatgtatgtatatacatacatatttatgtatatacacatgtatatatatacatattatatatatgtatatgtatgtatgtacacacacacacacaaacacacatatatatatataatttattgtttgaggattttgtacatatacaaaatgtttttatccattcaccctcggaaccgtccctctcctctgggccggttcatatccccccacgacttctctctgacaacttcatggacacagtctaagccctctgagtctagtggttgaccactagaacatggacaggctatcaggggccacatccctgtggggagaggggacaactccctcttccagcagccatcagctgccaataactccttagctaaaggtgggatcaaccagtgctgggacttttgagggttgctgtgctctttatcaatttgatagacattaaattgtttcataagaatgtacatatgtctggaggggaaattgtttgtgggcaacatgggaccaacactgagtaaagaaactacctcgaggagtgtgtgacatcttctcacgtcattttattgcccggccttttctgtgaggagtgctatttgtaaaggaagcagggtttgatgctgtgtgaactgtctggagaggttgtgctcattgtgaatagcaagtagatttctaggagagcttgcaaagggagcagcactgggcttctggcctgtgggtagtcattaaaacaatttacatacatttaatctaattgtaattacaaagccaactcactacatggatttggggacaaaagcggtttagaaggcactggatttgatgctaagaaatacaaagtattcaatatgggtatgtctctctttatgcacagtcaagcaattcactttagaaaatactgcattccctccttatacaaagcaccctgttaagcaaatgggttcctgttcatggaacaattaagctggaagggaaccaggtagttcagaattcttgtcctttacctctagctctttagagagagagaggcatatgaaaagaatgtgaggaggtggttttgctttctgagataggagggtggcaaacaggagtagagggctgtgcctctcttcatgtcgttagtttcagcattctctcccactgataactggatatgtcttaaatattcttaagaaaacatttaagaatattgccactgtctctgtgtgacacggtggtcatgcctatgtctctcctttctctgtaggccaggggttatcaccatgcaggcgttgtcggaagaggaccgtaggctctggatggaagccatggatggccgggaacctgtaagtaacaattcagggaagtagaacaataaagaccctgagtagtgctctgctttcctactgagagggtttgctgttactctaaagcctttcgtctttgaaaccaatgtcccagaggcatttttaattcatagattgatgtttgttcttactgcagtttcttctgtgtagatgtagctcccgggttttggccttggctcctaagatagaagttctgtatggtacagcagactcaggcatattgtttctgggcctcttagagaggcagcactggatggctgttggtcatatgttgctttcatgaagtataatgcaaagcgcaaggctctggttgattttcatgggatagacagttataaaagtctacataggaggtagagcatctttatcactgtcatctagttaggtttcccactgcgatggtgattcacgcctcatggtaagcagtgggacattatcatggtagatggaagcagttaagcctggcgacgtgatctctgttcccatttcagagatgctggcctcagcagggttctgtgatcttgtggttgttatgcaacatgtggcatgtaaaagccatctgagagctctggggtaagtcccagagcagggctttttatcttgatgctgagaatctcaactacagttttacagtattaaaaggtcacaaaaatcctgagtatagctaagttccatcctagaagatagaaagactctacatggataaaagcatgatccaaagggggagatgtatgtttgcaaaggcagatcatggcgtctgctgcttagagaacacaatgaatcaagccattgcctcttgcagatgatctcagctcctttgtggctctttcctagcccatgctggtgggatggtacggctgaatagacgaatgtgctgttctacccatctgtatgttagactaatacaggacacaatctagtcgacaaacaaaaaacacaagccagtatgtatataacctttagtaatatagattcacattccagcaactacttaaagttgggccaaattggttaaagtataaagaaatagctgtttaatctgaattcctttcttgggccaaaagataagataacctcaattttccttatatacattgttatccatagaagcaagcccaactgagaactgtgcgcgcgcgtgtgtgtgtgtgtgtgtgtgtgtgtgtgtgtgtgtatgtgtgtgtatgtgtatgttttacagatttagcatcttaaaacctacttatttcctactgttttaggaaatatgtgttgtgattcattttacagatgagaaaacaggtttatgaatgttaaataattcactgcaagccttacaggctatctttatatagaacatgccaagatgctatccagtgaagagacacagtagcacatgtggagccttacaggctatctttatatagaacatgccaagatgctatccagtgaagagacacagtagcacatgtggagagaagtgggtgtggctggcagagctcttatttgagcccttacccagcatgactgctctgttccctaacccatggtgtcctggattcggtcattcccctgctccagcatggaaatggaattggaatcatcctgggaaaacattgtgaagaacttagaggtcacgtgctacttccattagtagacatgacgtggccatgtctgtcctcagttgaccatgaggaaatccagatgcaggtaggcagccgttggccctgccagtcagtgcctagcaccctccagggaagaagaggagagatggtgctgtgaatggctggcagggccgctccagtgacacagctgaggtctatttctagatgtatttaggtttcatctcacagagatatattttcagactgtctcctcgggattcatgctcagtggcttctgcattacttactttttctggctctcttgaatgactccccaaacgcatagaataaggactcctgtcattgcatgatattattggtatgagttcaaaaatcaaaatgaaacagaaccataataaaacaacaaacacctcgctcctcactgcccccagctcagcttccgatactgcctttccaccgtttcaggcttcctcttccttccactcctccctgccacgtgatatttgttctgccctgtgtatggttggcctcttactaaccacttcagtcttcccataggctaacacctggcctctgcagatgaaagtactcttgaagagaagcagctttttgctctagaatgtacacattaataataagtctaaacaagagatagttctgtctctaaacaaaacgaaacagaaccataataaaccaacaaaaacctctaaacattccataacctgttctcacagaggaatgtatacctcgtgctggaaactacacctctgtgtgcttttcagcatcctaaagggacagataaatacagacaaacgagggctatgtaattgacagtaacatgaggtgtaattttgtctcccactgctgagagcacagtagacaattagcagctccattttaatcacctcctccctaattagttaaatatgtccccttgggagttttggctttgtctggttggcttttccacaagctgatcttagagtaattcccgaatattgagaggctttctcatgtcagggagatataaagttgggcacctgctggcttagaatattactcagtattatgatgttcttagaggtggtgcaggggaattttagtttcttttctttttgttctttcattgttcagtaatactttaggatgactggtgggggtgtctaaataaaccgcagtttagttgattttgtagcatgttaattattacataaaccacagattttggcctatagtcacagtctgtcttaaagacatgttgaccattttcatggtattggtgggtatgtgagagaggaagaagctgaagctgtattttaacattaaacattatggattttatccacatatcaatgagatctttcaactcaaatgaaggggcccctgttcaaacttgtttgagaaaaaactgatggtgtaactgaaaacaccacagtgtagtatatttcggcccatttgaatcagttacataatgttcagagttggctgcttttctgctagctttattttctgatgtattctttccacatacagcaagagggttcttaactattctaggtggatatctagacatatatcataatcaatcataatcataccatcatattctttgtcatctttattttctgagatgttctcactgtgtagttcaggtttgcttccaatttgcatttgtgtgtgtgtgtggtgtgtatgcatgcgtgtgtatgcatgcgcatgtgcgtgcacatgatattggagtttgaacccacggccttcagcatgctatgtaagtgttctactactggtgtactggtatttctattcactacatcttattattaggaatttgtgacagtaaaatttgtgaaactgaacagacagtatttcagactccgtgggccaacatagtggctgctgtagtttttgaagtttcccaaatttgttcaaaagtcgtcaaaggcaggataccagtgaatgagtacagtcgtctttcagtgagattttgcttacaaaacaaagaagttgcgtctgggctaagctttttggtctatacaaacattggtaagagattctttgcaaaataacttcaaaggaattccatatttgagttttagtgaagtaagtgctttgtccagaggatgtagtagatgaagtgaccagacttgacatgctcactgaaaccgttgtcatcatcactaatgatgaatgttgacatcctctggagaaaaattattgcagcatggcagaggagagcgggcatgagattgggaaaagaagtggtttctttactctgagacccatcttctaataacccttctcttcagagagcctactctttgatacttgatcacacatgcatcactagtgtcacacttagcataaaagacgaggtgctgtccaccaagactgggacagacataggttcacctctcattcagctgagtcccaggagtcccagctggtgcatgagagcaggaaaacagtacaaaggactgatatgttggaaagaaagatgtaaaattgccgtattttcatatagcatgattatctatttaggaaatgtttgtcaaaaacaaataaacaaacaaacacccgccaataagcactaggaattagatggtaaggtctccgagagggtgttagattctttccctattccatcattatagttttataacctagcaataaataaatggtatccaaacttacaaacacattgtattcacaccccccgcccccccaatagtgcctaggcacagatctaagtaagcactggaaagtgtcataaaagcagagccaaaaaaaaaaaaaaaaaatggagagtgtactgcacccacagatcaggggaatcggtttgtaaaggagtcggctctccaaacagatctgtaggtgtaatgcaattcctatcaagactgtggcgaattctctctaaaatttatatataaagctgcagaaagcagtgaagctaaagcaatttaagaaaagggaatgaagtgagatgatttattctactctattttaagacttcctttatagtgacaataatcaagacattgtattgacagaggatagacacctagatcaatggaacagaataaagaacccagaaatagacttccacagacatgcgcaattgattttagacagaagtgcaaaagcaattcaataaagaaaaaaagctttctctctttctttttcttttttttttttttttttttttgagtcaacagaaaccacacaaatggtacttttcaaagtaatagacaccataggcaaaaacctgggacctcaacttaaattttatattttacatatgaattaattcaaagtgagtcatagataaaatataaaactataagactaaggtaaaaatgtttaggactatgtggatttttaaacatgacactaaaaatatggtccctaaaatttaggaggaaaaaaaaaagaaaaagtctttcttcagcaaatttaaaacttttgcttttgtacacacacgatcctgttgaaaagaaggaaagagaatctctagaatggatgaaaatatttgccaggaatttttctgtgaaaggacctgcttctaaaaatctaaaaaggactcttaaaacagttaaacacccaattaggctatagacaaaagtgctgtgcttaaaggcatgtggggtccgtgacattatcacacacatggacatatctggccacgccagccactattgcagtttactaggctcacaggtgagtaagactactgatgtctcttcctccacccccggcaggctacacagcacctttcagtactgtgtatggaaattcagtacttagcactatgaaaattagtcagcagggagggagctttctggtcaggagtaacttgatttttctatgtcctgtggtcagtgttcatggtgtgttcacaaatacggtcctaccaccaagtgctgatggacaactgggagtggtggcagtactctgtattatttggctgtctcagggcatctcagaccagcaactgtaagggagttatcacactcctggcactgaggctttgtgtttggcaacctataacttctaggatgggcataatcttctgtgtgtgggtaaatccaattaaatacgcgtgtatttgtatatatgtatatatgtatgtatatatacacatatatatgtatatatgtgtgtatatatgtgtatacccctcccacacacatatgtacgttataagacagtagatttatgtattatttttgcatcttccttagtgtcagttatccctctcccccattttctcctttacttaccctctggcatctccttcttccctcctactctccctcactctcctaccctctcacccttcttcccacctaaacctccttctccatcatatcccttttcctggtcatataacttgtgctctgttgtataggtttgtttttttttctccacaaagctcttatcaattactttagtaaacctttagctgtttttgatattcaagcttgtctttttcagattttttattattataaacaacaatgtaatgactcccttatggacatttcaccactttttggtaggatacacatcaagtggaattgctaggctgcattatacatatttattttaataggtatcagcagcttatttctcatattattgccaagttggtcccttactatagcatgattcatactttaatgctatgtaaacataaagtgtgattcatgctgtatgcagtagtgtgattccttttcctctgacctagagatggcactcatcagttttctcagctctgccttcaaagcccaggacatggtcctagcttttccactggtctctccttggctgaccaagcttttctattcatttttgcagctttctctcatctcctagtatcccctcctgctgctcaggtttggaacagagagtttttgcagccagatgggcacatcttgtacctgagctgtgcttctcctagccttggctacgggatctgaaatgggacctgtggaccacctgctcccgtgtgctctggcagcagtcaacattctgctggggtgtcccaaggtctgccagagtccttcaaaccttccaggagagagagaaagtggttcctccttagggagcttccattgctgtggggcctcatgactagaactctcagtccctaataacccatgacatgtgatcagtcagcatttctacctggagcttcatccaatagaagacatggaagatgccatcagtatttgcatctcctctgtaggactgctgttttgttaactatatacccagtttgtttgctccataattccttccttcaggtttgtggcttaggctattgcccagactttttagaggggccaacatgaacgaggctgtaactccaagggtttctgtcatcagttcttcatttgaattaggatttaggctcatataacaatcccctgatttgcttcctacatctggactatggcatgttggcaaatcaagaatttattggagcttctggctgtgtatgtattaaagtgttaattttttttttaaatcttaaaatcttttgagacttaagtattacaaagaattccagaacattctttacctagatagcctaaatattaatgttttatacaatcttataatcatagttatataccaaggaaattaatattaacacaatattatatatttcaaaaatcttcgcttacttattaattcatgtctttaccttctagactgctgttcagtctaggataacacattgattttagttatcatatcacttcaatgttatttgaccattattgtgtgactttccttggggacatgtgaatgaacacctgttcatgacagatagagcatacactactgatcaaagaaaaaaatttaacccaagtctatcttactgatcctgttactttattgggtttgcttacagaagtgtggttgagggctacctagtttacatttggtcactgtgataaacgtttggttgcacgtccaaaaagcaacttggggaggaaagggtttgtgttggcaacagcttgtgttgagcaaagccaaggcagggtctcaaggcagagactatggaggagtgctgtttactggcttgcttcctttggcctgctaagatactcttcttaaatggcccagacccccgggaagggtgccacctacagtgggctggtcccttatatatcaattggcaattaagaaaacaccatcagacatgctcataggccaatctgattaaggcaattagtcaattgcattttcctcttcccaattgactctgacaaacactctccagcacaaaggtgttacttaaggtcttggtaactcagtgagaagtgcatcactaaagcgcatgctctcatggacctgcagctagccttgctgaagaagtgtttcctctccccagaaagggtttcctgcttgcacagtgacaatggtgaggggctttaaaaactttctgaacttcctgagtctcagaaattccattagctttccaagtcttatgagctcttctcttagccccaacccccagaagggtgtgtgtcagttctgaggaaatagcagcgcagtaatgcttagagcggctagccgaccagcctttggaagggacatttccactagccgatatgcacagagttgagtattcagactgtattccacaggtagaccagtcaggtttctctgtcttccagaagttccctgttgtgtattctgtctcaggttcttaaatcgccttacagtccatcttcttcccgtatagtatatttacctctttttaaaacacatcttaatttttgtctaacaatcttgcatattttggggcaacagtgtaacattttgaaacatgcatagtgcttccagatggtcacatcagagtgattgatgcccccgtcgccgcagacatttatcattattatccctgtgttagcaacatccagagttctctctgctagctcttttgaaatattcagctaatggctgtgagatagaacaacagaagcctttcctgctctacagccgttctcctggatacagccgttctcctggatacagccgttctcctgaatacagccgttcttctgggtacagcggttcttctggatacagctgttcatttagagcatttgtcttttaccctgtctgcccatatcctatgtttagccttgtgcagtttgctaagtttagtgtgtgtattatagtcattctcttagacacccgaatccatagatactagacattctatgtgtaaccctcagctcaatagttgtggtagcactgtctgtcggcatccttgcagatgccacaggagtagttcatggatagggagtattttggttgtttcccctctgtgtgaaaggccagtgatgatagagcgactgtgttcacttaaatgaatgatcagtgtagatcttctgtctttttctcctacactctgtacactcaagtgtggtcatatgagctagtgaatctaattaaaggtgatacttaaagcagtgtgttgacagaagacttggaaccattctgaattttagaatgtaaatggggttgtttgctttgggtccaggtgtggagcaagataagcattagacaaacaaacaaacaaacagcaaaccaaccaaccaaccaaaactctgatttggattgctgaaccagcttcaagtacagcccagtcagaaggctcccagcacagttatcacacgccttttagtttcattccagaaatcatgctccacaaccctagaagaaaacaccagaacaagaaacatagcccgaacagagtcatttcctaggatgattttaaaagctctttcttaagcgctttaaaaaaagaccatgtgaaatgtcaacagtagatgcttaaacaagacctgaacaatgacaacagtggttgacatgctaccgtggatagagaatggcacatggggctccatccctggatgaagagcttcaaactatggagatagggagagttaattttccccagagatgagcacccttcatggttgtgtaataccaagtggtcagccctaaaatgttatacaattatacatacaagaaatacaaaatggactcaacaggttgcatttacacattgattctctctctccctcttccctctctctctcacacacatatctacacacagtatacttgcaaatatatgtgacgatatttaacaaaaggctgtggaagggcgacaggattgagaggggcaattgtgtaattacattttaataaaaataaaactattaaagtatttttaaagagataaaagggagttcatctttgtgcttatccagaaaacagtgctgataacggtgcttcagtgttcacagctaacagaggggcaggacttgagccctcagctctcagccaaccaccgtagctcccacgcactgtgtggtcttgatccgttgcccaggaactcgagcttcccccactcattacctctttatttttaaaagcaaagtaggacaaggaagggagtggaccagaaactgagtagaaacccctctgggcagaacacaccctttcacagctattactaattagtgattttattagaattttattttcttcattgtcttagggttttactgctgtgaacagacaccagaccaaggctgctcttataaggctaacatttaattggggctggcttacacattcagaggttcagtccgttatcatcaaggcaacatccaggcaggcatgatgtgggaggagctgagagttctgcatcttcatctgagggctgctagcagaacactgacttctaggtagctaggatgagggtcttaaagcccacacccagtgacatacctactccaacagggccacaccttctaatagtgccaatccctgggcagagcatatacaaacaccacagccataaatcttacaagctcagttagaatgtagaaatacacattgtttgggagaatcaataccattttcttgggggaggtagtatggtagtagtgcctagcatttgaaatatatatttgagacagagcctcagtatgtatagcacaggctggcctcaaattcatttactacatcaagtttctgggaatcctcctgttctacctcctgagtgtctgggttataagcgtgggcaggcccctggcgtaggagacatttttagctttgtttcttggaaattctttgatgagataaagactgtctttctcctgtaggtgctggtcaggctagacattaaggggaattaagagactttttctctacttagtttttctctcttcttgttgatatcctgggaggatgtcaagttgctgagggcagggactggtcttgtcctgtgtgtcttatgaattccatgtttgtggggcttagcagccagagcactgtgaggtgtccacagttctctctgtaccctgaatgaacttggggcacaaagtgagaaggcttctgctagtcagtcccaggtaaagttcttccattgcctgtcttgggttctggccactattggactgttctaaatacaaaccctccaaggcaagggttcttttttttttttaccagcttgctcttcaccagatctccacactgctcaggacttctgcctcgtttctcaggattggtggtatatgatagcccagtgtgctgccccagggaagtctcaggtcagaaggtgtatgaagactaagtaagggtcaggaattggttaaaatcttcccactggtaaacatgaaatcaagaagtattctcgtttgctttctatggctgtgataaatagccacgaccaaatggagcttcgagaagaaaggctttatctcaccttacagcttacagtctgtcacgaagagaagctggcgcaggtactaaagcaggttagcctggaagccggagctcaagcagaggccatggaagagtgctgcttactggctttcaggctcatgttcagctgcctttcttacacctcccaggaccacctgcctagagtggcaccatctacagtaagctgggcccttccatatctagccttcatcaagaaagtgcaccacaggcaagtctaaaggagacattctctcaattaaggtttctttttctcaaatgacttgagtttaggtttattgaatactaaccaatacaggagatgtgtgcacaatcatatgaatattcacacacacacacacacacacacacacacacacacacactcacgaggcatggcctccacgtgtgctatccccagattaaatcttgattgggtgatttacctaatttttctgtgcctcaggttactcaagtataaaatggtagggagtgatagttctggtgagatttaaagcacttacacattgctttacctaatttgagtaatgttaatttctcaattgacagtaagtcctattgtctctaggttttacacatcttgcatacagactgattgttgtttagagagtaacgatggctgcagagtctgctgtctgcttttggactggtgttagtcgaactatgatttattaaagacataaaatggtatgtctctgtttctttgaaacttcgaagtggggcacaagaagcaagaaggtaataataatggtgcccatacgtaaaagtctcaggatatttcttagggacatatgattctgaaactgtgaggctcctggataactttattttcacatgagaacagtaagcagagaaacattccatcaggatttatttaatttccagagagaggtgctttggtgtaatgcttgtcgttctttgttcaggaaggcaaggagtgagcatagttctcggagaatgcccaagtcctagtccttactagttccagtagtaacctgtgacctcaaagctgtctcacctattgcttcctaaacctaatcacgaagacgattgcgtttctgctgttctgcttttatgtcaatatttctcaatgtggaccagtttttgtaggtcaagatcaactgtgtagcttgagcagggcagtggtggccgcatgcctttaatcccagcactcgggaggcagaggcaggcagatttctgagttgaggccagcctggtctacagagtaagttccaggacagccagggatacacagagaaaccctgtctcgaaaaccaaccaaccaaccaaccaaccaaccaaccaaccaaccaaccaaccaaacaaacaaacaaacaaagatcaactgtagcaacaatgcgagctatgttggggtagatttatcaattgcaaatcttacttgggttcaagactactgattatagtgtcttaaattcagctactatgttgctgggctggcctattatcatcagactcaaaatagaattggcaaaagcagaggaagtggatatggacaacaagttcagaggtgaagggaaaggaagttagctggaccagaagtgaatcttatggatttggagaaacatggcacctcactttggtatttatggatagacagggtagggttaataaatattattaaaataaatatttggagtaatataaatatttactgttcttaaaatcagtaaagtaatagcatatttttccttctgggacatttgtgaatttgaggagactttggaagttttagatgcgtatatttgtctactgtctgcttcctgtttgagcttgcccagtgtcttactttgttatttagtgttttagttagagtttatattatatagagacaccatgactatgacaactcttaagaaaaaaaaatttaactggggctggtttacagttcaaaggtttcgatcattagcatcagggtaggaagcatggcagcatgcaagcagacatggtgctggagaaggagctgagagttttatatctggatgtacaggcagtagcagcaggagacaataggccactaagcttggcttgagcttctgtgacttcaaagctgtctccacccccagtgcacttcttccaacaaaagcatacctactccaacaagtgccactccctgtgggcctttggggaccatttttattcaagccaccacacccaggaatacaatagatttccatctcagatgagttaaagagtggagagacttgttggagaactgaggtagaggccgaaggagtacaggcgaattgtggtggtgatgtcattctgactttcagcatcacccctgttgatcttctccatttcaggtgggatgtaccagtgctagttacacacttcagacctaggtctctgttagcatctggtctgaactgtcaccttgagagctccaagcaacatgttcctgtgttctgtatagatatgagctagggaagtgtgctgtgaacctgagggtcttttggcaaaggctttggaaatagtccatgttctatccctgaaggccacctctgagagtactgacatgactgtgggctgctgctaaagtctgtggacagccatcacagcgctcagctcactccttctgagaagaagaggaaaggtcccatgggagttgtttccatgactttattagaccatttactcatgaagagcccacctgaggccgtacttgtgtgcttggctcctgtggttggagtttttagttgagcctgcctgtgttcctggcagtgtccctttgccgttggaaatttccaaggctacttcttctctttgtataagtatagatactaacaagttgacagctcactgtctcgtgtcaacaccaacccttctggagtcctcattttctctcctgttcagtttctttgtcagtcgcagctttccaaatttcacccagaattgcaccacactcctgctttgggaacatgctagttccctgtctagagccattacttttcccatggtatgtatctggcttactcacatttggtaaatgttggctagtgtccagtggagatgtgacgtcttcttaaatgtatttcaggtgttttgatggctaactaactagacgtagtcctgtgttctcacaaagacactgatctctctctctctctctctctctctctctctctctctctctctctctctctctctgtggcagttgttcagaaaattacagtataccttgtaaatgagacatttgatacaggaccaattcttgcattgtttaaatggcctcaatttaaaggcacatcatcaatttaatagtcattttcagaatggaagaaggtaaaattttattaaatatgggcaaagattacaagatgtaccccaatttttcaggggggaaaacccaatgttttagaatcctggaaaacagggtccctgtgagttctcagtgatgtgacagattagtctgtagggaaattacatgcacagaaagttctttggtagaaatatcatcagactcctttaaaagccaaagaactagggaaaaaaatgaatgtatctaccaaatgaactttagtttagcattggtaggaacttaaggattcatgaaacctccctagcctgcaaatctctggcaacaagcatcattgaattgcatgtccttgtttgaccctgtcagggagcctctccaaatgactgagagtgcagttttgtaatattatatatcaagggccttgtttagattattttcaacaagacattctttaggtctttagtagggaaaatgggaagagacaatgacaaatcatagatgttagtccccttgttacctattcccagaaaggacacatttcgtgttgtcgcctgcagcattaaacaccaccagagaatcttcgctacgctcattgcctgcttgcctttgctcccttggaatgcctgagttctggctacagcgaggagtggagtccagccagcttgatttcttttttagaacagtctctggaagttgctttcacttaggatttttgaagtcaacagaagtttagttgagaaggcttaagcccacattgtgtaatgatgtcacacttggcggtcagcacagatatggggaaggggccttcattaatctttgctgccattaagtgaactcctgaatttttgcactcacattctgctgaactgcagtctggttaacataatcccaactccagccgtagtcccctcggtcaatactttgtcctgctatcctggggttagctccttttgtgctcatctgtctttaagtggcaagccgaggctccagggcagggcaaggagcagcacaagtaatcttgcagatgacgcgggatgtgaggatcagtggtattagagtggcgttagggatgctgatgctggtctcagagtacagcgagtatcccatagttgccaggagagactaaggcccagaactcagaagcaggggaaggggtatgatgtggatagctggctttgggaggactctgggaatgcagaactggctctctgctagtttcccaaaagttaccatcatagccccgtcctcccaccaaataatagtctgaaaattaaatctaaagattatctttatagcattactgttacattctgcagtgaagtttgttgaaataacaaattttacatagacttattttgatttttcattttttattaaactaataaaatttattttaaaatatatcactcaatattgaaatttttaagtcatcaaaaataatttataatagttaattgcttcttaaatatacatgataccttctaaagctaaaagtaatatgcactcaaccagtttttaaaatctctttggaacattaaacactatagaagtagaaaaaaaatctgttatgaagtcatctatgaaggaaattgtgacaagttcctgactagacagaaactgtcccatatccaagggagaatatgcagtgtaactgtgataccatagaatggattggggagtgttccttctgttcctattttgtggaatagtttgaaaagtattagtattaggttttctttgatggtctgatagaattctgcattaaacacatctggtcctgggcttttttttttttttttttggttgggagacttttaatgacttctatttctttagggactgtttagatggtttatttctttagggactgtttggatggtttatctaatggtatttggtatctttctagaaaattgtctattttatccagattttccagttgtgttgagtataggcttttgtagtaggatctgatggtattttgaatttcctcagtttctgttgttatatctcccttttcatttctgattttgtaaatttggatactgtctctctgccctctggttagtctggctaaggatttatctatcttgttgattgtctcaaagaaccagctcctggtttggttgattctttgtatagttctttttgtttctacttggttgatttcagccttgagtttaattatttcctgccatctactcctcttgggatttgtgaccttatatggtcattttatgttcaattttagagaaggtgccatgaggtactgagaagaaaatatattcttttgttttaggatgaaatgttctatatatatctgttaaatccatttggttcataacttctgttagtttcactttgtttagtttgtgcttccatgatctgtccattgatgagagtggggttttgaagtctcccactattgttgtatgtgaggtgcaatgcgtgctttgagctttagtaaagtttcttttatgaatgtgggagccttgcatttagagcatgttcagaattgagagttgttcttggtagatctttcctttgatgagtatgaagtgtccttcattatcctttttgataacttttggaagttgattttattcgatattagaatggctaccccagcttctttcatgggaccatttgcttggaaaattgttttctagctctttactctgaggtaatgtttgtgcatttcctgtatgcagcaaaatgctgggtcctgtttaagtatccagtccattattctatgtctttttattgggaaattgaattcattgatattaagagatattaaggaattgtgattattgcttccttttttttttcctgaggcaaggtttctctgtatattccaggctgtcctggaactcactttgtagaccaggctggccttgaactcagaaatctgcctgcctctgcctcccaagtgctgggattaaaggcgtgcgccaccatgcccggcacttcttgttacttttgatgttatttttatgtttgtgtggctctcttcttttaggtttgttgaaagaagattactttcttgctttttctagggtatattttccctcctgtgttggagtttgccatctattatcctttgtagggctgtatttgtggagagatattgtgtaaatttgtttttgtcatgggatatcttggtttctccatctatggtaattgagagttttattgggtatagtaacttgggctggcatttatgttctcttagggactgtataacatctacccaggatcttctagttttcatagtctctggtgagaagtctggtgtaattctgataggcctgcatttatatgttacttgaccattttcccttactgcttttaatattctttctttcttttgtgcatttggagttttgactattccgtgacagaaggaatttcttttctggttcaatctatttggagttcagtgggcttcttgtatgtttataggtatctctttctttaggttagagaagttttcttctataattttgttgacgatatttattggccctttaagttgggaatctttgctctcttttatacctatgatctttaggtttggtcttctcactgtgtcctggatttcctggatgttttgggttaggagctttttgcattttgcattttctttgactgttatgttaatgttttctatggtatcttttgcacctgagattctatcttctatctcttgtattctgttggtaatgcttgcatctatgactcctgatctcttttctatattttctatctccagggttgtctccatttgtgatttctttattgttcctatttcattttttaatcctggatggttttgttcaattccttcacctgtttggttgtgttttcctgtaattctttaagtgatttttgtgtttcctctttaagggcttttagttgttttcctgtgttctcctgtatgtatttaagggagttatttatgtcctttaaaaagtcctctatcatcatcataagatgtgattttttaaatcagagacttgcatttctggtgtggtggggtatccaggacttgctgtgttgggagatgatgatgccttggtttctgttgcttattgtcttgcctctcaccagctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagggattcaattaggtggctgtgtgttagcactccagaggcagcggcaggaggatgtggagtttgacctttgcctgagctgtgtatggagaaggcacataaggcaggtagtttaatatagatttctagatctcctccctgtgaagtctctcttgagttttaatctctatctatgtgcaccactcttgtttcctgctgccccctctcacgtcgttctatgcaccgctttttattgtcttgctcagcactctgtgctgtgactcagagttcaaactaagtacagagagttgaacagttgaacagacttgtgcatgtcaaaacaccgcaagccatttgctcccaattccttttcctttctcttctttcttttctccctaccccctctttctctgcccatgccattctcttccatggctccctctcctctctctcacctcctcctgcatgccagccccctccaagatcactctgtcatttatacaagcttgagttttccacccacagaggtactgggtagccagagcctttggaatatactgccagccccttttctagaggggccttgaatccaatcaggtttcagttaggaatgatgggaaacctgagtgaagctcatatacatttgaaatatcaagggaaattgtataaggctcttttcttctgtttattttaaactgtaaatcagtagtgaaagattcaaagaataggtatgcaattttcaaaagacttcaaatatgtgtagttaaagaactctttagggctgaaggtgttttgagacatatctcctcggtccatgatttggccttcaggttatgtcttaaataaattttaagatcatgttaacttagcttttgtgtagtcataaattccttttcccccctgggttttttgagacagggtttctctgtgtagtgctgactgttctggaacttgctctgtagaccaggctggatgtgagctgacagaggtcctcctgcctctgcctcccaagtgctggttttaaaggtgtgcactcttatgcctgactacgctgtgataaattctaaaaggcctaaatggttaactacaagattgaaagtctctgggacgtggttataactagaattaaaaataaatgcaccaaccacatactgaatatatttaaaataagtaagatcagcaatttatttttttcagaagctacccttaaatattatggccttgaggcacaggtgtgctcatgtgcagggcagagcgagtgtcattggaaaatgatacatagagaaaagactatgcatgcctgcttttagtttcctttttgagtatatagaactgcttaaatccacatataggaagggctagaagaaggtttggcaaccatgaacatttctctgattcataggaataaggtcacaggaggaaaacgaattccctaaggcacacaggtagctggtggtgacacagccaagaccagaacctttactcccaatgtcatgctttgtttctctcttgaaggcatggtattgtgtggacatggacgcaatgatgcagtaaatgctcatctgtgtgtttgctgacacctggcagccttactagatgcctgtctcagcttgcacatgagttttctacctgggcaaccaactgtcaccctaacaggtagcttttcaccctgtaacccagtgtcttaggtttcggtctctgtgataaaaaccatgacaggatgtagttttttgggggtggggtggggggagattgtttgactcatgctttctgatcacagtccatcattgagggaagacaaactaagaactcgtgcaggacagagacctgaaggaggagctgaaggaggatcacttcctagcttgctcttcctagcttcctcagcctactttcttacatctcccaggacctcaagagtgtcactagtgacagcggtctgggaccttatacttcgtcaccagtcaagaaaaggccccaaggtctcacctacagacaatctgatggagccatcttctcaattgagattgctcttcccagatatgtctaggtttgtgtcaagttgacaaaacccaaccagtagaccttgaacttgccatcttctttgcttgtacctcccaagtgctataattacagacataataccagtttaaaacaacccctgtttactgactcttggtctgtagggctggtcttcttttggtttctaatgacttcatgagggaaattgcttttgtacagtaacatctgttatagaatgcttacacttgattgtagaaaggcaaagtcctgaagtttggcagccaggaccacaggatgtaataagagaggaattgttgatagaaggatgaaaagaaacagatggttttttttagacgaagagctacaattaacagttactgagagagtaagaatcagccccctgattggttatccaataccaaggtgtcagacctaaaaacaaatacctacaggtaacactgaaccaagttgtgtttatatgtaagtgtaacaacagtggttaaagaaatggaggccttgaatttgggagagaagaagggtcaggggagtgacatgggaggggcatgagggaggggataaatggtgtaattatattttaattagataaacattctatgtactcagtttcagaagagggagtctgtgatatgtgatagtccagtgttgtctcatcacataaatagaatggctagaaagggcagccttatcaccctcttctcttccccagcatgccaggcactttccacttagcatttaccagtcagtctgagatgctgctgtttcttaagttttagtccccacactgttcagtttttcacgcatctcagcctaaacatccgattctcagccttctcccggttgtacatattatccccacctaacttctgatggatacttccagatcggcttctggtcttctctacagttgaccttgtttgttttcctcctctatgttgtctctgtttgaacaaaactatctgtagactcacctctgagttacagtatctaggaagagcagggcagggcacatgtagactcttggatgtttaaaaagaggtccagataagttgaatgttctgttgtcataaagggcaaccatatcatcacaggaagtcctactaagttttagtaaactgtagcctacctaccctttgagcgattggttctcctaattgccagctcagcagtccggttaagagtggcttgatgaccagctcaaggtcacatggttaatctcattaagaaataagattagctccctcagtgctggataattttagccattgtctcataaggacttggtctctgttgtactcaacttttagtgttctctgcttttaaaaagaaaattaaataaacaatattcttccaattttaactatttccagtctagtctttatacttcatatttctttacatgtagattctattgcaatattttaatttttcagtgtcaaaattgatggcagactcatctcctgctataaattgtatattgcttgaattccaaagagtggtctgaactctggtgtttgtttttgttcagatataaatgggatgggaagacagctcactgggtaaagtggtggccattgcaaacatgagatctgaatttgagaccccagcaaccaactaaaatctggacatggtagcatgcatctttaacctagcctactatcttccaaaatcgtgagcatcaggtgtagtgagagacccttctaaaaaaatggtggagagtgatgggggaagacaccctgtgtcaatttttgcccttatgcacacgtgtgggcacatgtcacatgcatacagtgtatgcttacaaaaaagaccattgactttgaaggtcctgacatgggtaatatcaagattgaattacgagaagctccaaaggttccagccaagcttcagacttgagtaaagtgaaggaaggcaaggcttaggaaatgatcccagaaggccacttgctctgggcttgtctgctatagatggaaacagatgcctcattctttactgaagttcaagggaggcttgcttcattgggcaagatgcatgtgaatcttactgtgaccaattgcaagaagccctgcatattattgttgacttttgtgtttcctacatcttaacatcccttcagtctcaatcttgagttgtcttgatgcaggaatcctgatgtaccgtatggctgcagttgcttatggcttttattacttgatgcagaacaacaaaggataaagtaaaaaaaaagaaaagaattaaagaaaaagacccagtgaggcagtgctcccttccctttgccaaccaagtatttatgtcacctgcctcatcacagtgagctatgcttacactggatgtcagccttttccagctctggcccagctagcctgaagctcacagattttccttgtttgacaggcagctgtaaatggtgaccttctttgttgtttgtttgttttgttggttggttttaaagtctctggtgataaaattcaatgtacaattgctttcccttcacttggaagaattaacagagcctaaaacagccagatgaaacccaagcagggagggactcctctgtgtcctcaggcagggtacttgctctgagtatttgcctccgaatagcagtttgtttaggagggtagtataatccatgtcagaatgagtgtccttatccctggattataaagggattgctattgttctagtatttaaaatctgcagcatgcttcacagaccatccaagacttaacaggtaggagctgaaggctccacccattctgaatcattaaggattaagaggcaattggaagtaaagacaaagttaagtcataatgactttcaagtggatgcccggatcaatgaggacaatcaagataaagcaaatatgaaattctatcttgatgatttaatgtatctaaatgttttatttaatgggtagaaatctgaagagttagactgttggctttatataggatacatggcaaataaaataaaatttattaaaatatttacccttttcctgtaagagtaaggatgcatcagtcaggctgaggaaatcaagactgttaaaacataaccaggatgaatgtaaaaaagctccagattttaaattttgattattttcctatcacaagtgtttgctcagtattttcattgattcattttactgaaaaacattactttaaaaataagtgcatattctaccacataagtcagttttacttcctatgtaattaatccctaatatcaaacaaaataaaactacattttgtatgtgtgcacatgtgcatgtgtgaacttgcacaccgaggccaaaggttgacatgggttgtcttccttaattgcccttcacattgctttttgaggtatggtcttagggagcctggagctcattgatatggctagtctgccagggcagagagcctgtctccacctcctcggctctgggatcacagtgcctctatgcccagcctttcagtgggcgtgggggcatctgaatgctgatcctgatgctttactatctgagccatctcttccacctatatttctaagactatatttctaagttgcaacttgatgcctttgcttactaaagtctttgaagttatgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcccctcccctcctctttctttcttccttccttcctttctttctttctttctttctttctttctttctttctttctttctttctttctctttctttcagcagttagcacaactcttgaggagcccaccacagcttgtaggcacagttggggctgtcctgcttcttcagcttttgttcttcttcttcttcctgttcctcctcctcctcttcttcctccttctcctcctctccttctctttttcttaagatttactttatttatatgagtacactgtaactgtcttcagacacacacaagagtgcatcagaccccattacaggtggttgtgagccaccatgtggttgctgggaattgaactcaatgtctctggaagagtggtcggtgctcttaaccgctgagccatctctccctgtcctgcttttgtctgtattagagtacagaagcttaaacatttgttctgagggttatgtaagtgggtctgctgaaataccctgacagttgacagtgactggagaaaaggctacaaatttattaccaggcatgtgtgtgcaaaatatgaaactcacataagggccagacagttgtggttgagactttgaatgagtcttctcttaggggagagggaagtggaggctgtagggtgtgtgtgtgtgtgtgtgtgtgtgtgtgtgtgtgtgtgtgcgcgcgtgcgcgcgcgtgtatgtgtgtggtataagtcttagaggagagggtgggtgtaagtaagtcttagagaagagaggtcttgaaaaaccagaccttagtctgggtcagtattcctttgggctttgggtgaggtgttgagagttagtctcttcctctgtgatgtgagtttcattcctttggttaatggaattttagcaggcagatttaaaggcagttagtttctccagctcaggttcaaccccttcgacaaacctctatctcccaaaatattcacattatgattcctaacagcagcaaaaattacagttatgaggtaggaacaaaataaatttctggttggggggtcgccccagcatgaggaagtgcatgtatccagggccgcagcattaggagggctggctcctctagtcaaagccttggcctctgtgggtaggagatcttcagggaaagctcaccctttggttctctgctccccacacactctcctctcgctgttcttatctgagccccaaatgctagcagttgtcaggtgttagacaacatgctaatagcaagtgcgactgctaacagatgatatcacagaatgttggctaggatatttttctcaggctgtgacactgaatccaaggtacaccccagtcactcttgcatggcattgtgggatgctgccttagcagaatgctgctgaaatccttaattcttaattaatttatttatttatttttttgtcttagatactagcaatacagccacatctttgaaagctatgtagtataaataagtagagcattgtttagtaatttcaactaaactgtatcttgtgtgtgagcatgcacgtggaggccagggcgtggcctggggttcttcattatttgcttttcaccttatttttgaaataggctcttagtgaacttggaacccattgtcttggcaaggctggctggccttgaacagtcttctcatctcacctctccaactttctagctttccaaacaggctggtaaaacatgtgtggtttaacccttagtgttcatattttctgatgccctactaggtactgaactggggcctcgtgcatactttgcaagcacttcgtcataggcctgccatctcggctctgttcttacatatttctagtagaagccttttcttttctctctcctcatttctccttgtatttagggacagtgtgatttctgccttgccccatgccccacccctcaccgagaataccaattactctctaagattgggatggtggagggaagagcacacaagaaagccaaacactggcatgtatgtgctttctctttctttgcaaggactcggcttccagtggagtcacaaatagaaaaattgttgtaatgctgcctataaggtagttgcaggcatgggtatatgtgcagaaaactctcagaatctttgtgggaatgacccttaggcctctgtagctctaacttgttcctgagaagggttcgtttttcttgtttaagaatactttaagagatttattctattttgaagtgtgtgtgtgtgtgtgtgtgtgtgtgtgtgtgtgtgtgtgtgtgtgtgtgtctgcctgtctgtctgtctgtctgtgcacatgaaaaaaaggaaatcccttggagctgaagttacaggtgcctgtgagccacctgcttgggttctggaaactgaatctgggtgctctacaggagcagtgcataaccttaccccgtgagctgctgggcctcattgctgtctgttcacctgccttctgttggtgtgagaactttagcaaagaagagaaatattccttaaaagtttgtggaaagagtcggtattagcctcccagttgcagagagataactaggcttggctttgatctgctttctttccacagtgtgagtaatgaaatgttggtcatttgcatttcttttttttattagatattttctttatttacatttcaaatgttatcccctttggttatttgtatttctttcttgaaacttttataatagtcatctgacttaaaatcctattttttcatagcattggcttgtctcattgctcaaaattatttaaaatctctaagtaaaatgataaaagtttggaaggccattcattaatgagctgtattttaaactggaaataatgtgtgcttttaccagtgggacaagtatggtgagctactgctctgaatgtctttcttgacattacaacaaaaatactgagttaaaaatgtttactctgtatatggaagaagtaatatgagaatgtatgcatactatgattacaaatctgtgtttgtataaatgtgatacaattgaattgtatgtatttaatgtcatccacctacttacaagacaataaaacagctgctgtcagggttgtgaattttttttaaatcttattattggtgtagttagtaagtatttggaaaatatgttatcagaaacaaaatacagatatagaagaagaaaaaaaagaaacctaagaaccaactctgtatggaaacaaatgctaacaaaataaaataaactccagttgtccagaggaatcaaattatgactctaaacaaagctggtgaagttcaaggctctggaaggcaagtgtggtttctactgataatgttctgaccacagatacacacctgcctggccagcctcctacacaatgcctggcttctcatcattttcttaagggtaaatgatgtgtagttaggatggacgcaaacagctttctacaaacacaaatctataggtagagtctcagtatatgtcatggatagggatgtagcatcatatggaggtgtggaatatggagcatggatgggttgcagtggctgcgaggtggacagactgcagcatgggtgggttgcagtggctgggaggtggacagactgcagcatgggtgggttgcagtggctgggaggtggacagactgcagcatgggtgggttacagtggccgggaggtggacagtctgcagcatgggtgggttgcagtggctgcgaggtggacagactgcagcatgggtgggttgcagtggctgcgaggtggacagactgcagcatgggtgggttgcagtggctgcgaggtggacagactgcagcatgggtgggttgcagtggctgcgaggtggacagactgcagcatgggtgggttacagtggctgcgaggtggacagactgcagcatgggtgggttacagtggctgggaggtggacagactgcagcatgggtgggttgcagtggctgcgaggtggacagactgcagcatgggtgggttgcagtggctgggaggtggacagactgcagcatgggtgggttgcagtggctgcgaggtggacagactgcagcatgggtgggttgcagtggctgcgaggtggacagactgctgggactggggatgaattggagtttgatgaaaacttctgctgtctggagaggcggagctgctgctctgagaggaatggattcaaacaatggccagaagagtttaagccaagcatgaacgtgggtgttttcggatgagggtccttgtctgtggatagtgtgttatgtacggtcccgggagcctccctttctttctcttcccaccatcttctttattaccagcttgtttaatcatcgtgactctgaggcaggccttattttctccaggttgtggttttggaaactgaggctcatggggactgtgtacttttcctaaaggcacaaagattacagggcagaggcaaaatttgaatccagactatgtagtatgagagccagggctcttaaaaagccatataatcacaaccgtagttccaaattgaaaataaagaccaacagcttcttccccctcttaaaaaaaatcacattggagttctagggtatgtatatgtttcaaaaaatgcttaacataggaatatatactcaacagtactcaatgctataaggctggctactgaaactttttttaaaaagatttatttatttattatatgtaagtacactgtagcaccagatgagggtatcagatctcattacagatggttgtgagcaaccatgtggatgctaaaatttgaactcagaaccttgggaagaacagttggtgctcttaacctctgagccatctctccagccttgctactgaaattcttactgccagtgatgagcacagggaacaggtcatgcgcatgctctctgtctctctgtctctctctctttgtgtgtgtgtgtgtgtgtgtgttaactctctctgtgttaacaggattccataccttcatcatttggtacttgtttcttgtctatattgcttttacagagatggcacacagatgtagtttatgtaggtgtatttgcatgcatgtgcatgtatgtgtatgcatatgtacacgtgtgtgcatgccatggatgtgtgtctgtatatctgtgtgcacatgctaagagactgttccacatacggctttgctccagtcctttctgcatcgctgtcagagaggtcctcccacggcagtgagtctgagatgcatgcacccctgcagccctgccatttgcttttgggcctctgctttctgtcaaggcccctgcatacgatagctgcttatgttccccgagtcatgctgaatccctcatcttgaggtgtgatccttaaatttctgacttttcaatacagactctctttgctctgatccacactgttataaacaacaccaattccttgtttcatttgaccgtttatttctttttaaggcggtctcattattccaggctggcctccaacttttatctgtttgctttagcctccaaagtccttgggctgcaggtgtgtgtacctgcacccagcctatgcttggcatttatgatgagccttggtgtgctggcgagctcctagcagggtgaagaggaagctttgttaccatggagcagggtagatgctgaccacttctctgcttactgtaacagtggagacagtcagtcactggagaaatgattcccttcttaaaggcttcatttcagcagcagcatgacaaagcttgggtttctgttgccttcttctttggggactctgttgtaggtcaacagactccagttaaataaagtcttgtcctttctttgagtaatgttcacttttctaagttagcaggggagaccagggggatgctggggatgtgaggtgtaccctggggagcaataccactcaactttcctcaggcctgcacactgagtcttaggagaggaaggggcctaaggttagacttgctgcccaggactctctcgctcctgttctcctgccaggctagctttgctccacatgtgatgatgttttcttgaccttactttgaaaaccttggtggctttgtattgcttttcttgaagtgcatgatgccatgggtattcacagagttatctgtgagtcattgtggacagagaggagaatgtgccattgtgtttttcagcagtgtgtacagccaccacataggcacttgtaaaaggaccattagtgacattaagttgaaggagagaccacaggaagcactcgataaagaggaaagttggttagaggtaaattcctccacgcctggtgctgcggtgtattgcccacttttgaatcaggtctctgctagattatggggtcagatagtaaaactggaggatttcctagttaataatgattgcggccaaggccaggggagactgtaatatttggaaacggcctctcactgaatctggtaggctagtgcccagcaagcttcagccacccccctgctcccatagcactgggttacaggtgcacgtagccatgcctggccttttacatggatgctggggacttgaactcgggtcctcatgtttgtgcagcaagcacttgtaccactgagccatccccacagctctgcaagcaaaactttattagtatcatttgctcccaaatgccagaacctagtcaagttaaaactggaaattgagggctcatgtatccgaacactgcagagacaggctgaatccttctgcttccgtgtgtgttcaccccgttctcaggaggatgtacctttttcctggtgtatgagccacagccagacacgccatcggtggtggctgcatgcttactaccacctgtactgccagcactcctatcgaaaagacctgctttcctcctgctgtagcaacaaaagacttcagtttatgtggcttctggcttcaggatattatctcgttgggttttgagtggtcacaactgcgaagttggaacaacacttgcacttccctctttgaatcatgcagcatgtgatgtattctgggctgaggagtggtccacagtaaggactccaaagtaggctgtgtttcacatcagcagttgcccaaagcagtcagtgtccattcgttaacttgcttgtaattttttattctatattttacttcatatgtgcgtatatggatgccacatacaataaagtgcccagcaatgccggaagaggccatctaatcacctagaactggagttacaagtgccagtgagccattgtgtaactgctgggaaccaaaaccaaacctgcaggtgctcttaattgctggcccacctctccagctcccattagtttccttctcatttagaggcaaagaaagctcagcctaggagggaactggaaggacaatagtgaggggttgctttaaaagatgattagtccttcgggctgtgaaggcatgctctaaaacctttgtgtagttacttacaaagtaagtatttctgtgtattagacataaacttttccaagtaaattttccttttattatgtcacattatagtaagtttcaactgatagcatttcctgatttggcatgggtttaacgaggtgtatcccagcccttccagtccagaggtcactaactgcagatcctaagtgttcacagtctcttaggagaaatggctgcactggtttgcagtcccaccaacaatgaatctaggatccccttttcccacatcatcaccagtatttacttctgagttgctttgttgatttaagctattctgaccagggtgagatgaaatctcagacttgttttctttgtatttttctaattgctaaggattgtgagcactctatgaaatattcctaagccatttgtatttcttctatgcacattgctttgttcatgcaaaggtggatcatgagtagacagattaaaaggtattttgagtagtgctcttctggttattggaactagtgccacctctcgtcaggtatgtacagcagatggtcattgaccacaattcgcaaaactgtgagtttccgtaagaaaaggaccgggtcactggagacagccaaaaacctgtgagaggcatgagtaatttgggtaaataagaggatgtttacgaggtctgtgcaaatgctctttctagtatataaatgatttctggggatgatacccaaagcaactacagccactggggaaagagaacaccagtccttaattaaagtaaagccatgcctgtgtgtctaggaagtccttatgtgcttttaagccatagacgatgccctttcttctccctctcctcttctgagctttctgaaactacaggtagttattccattgattttcaaaatgtaggtcagaagcaaaccaatgaggcacccctctgttagttgagggcagtgtgtgtgtgtgtgtgtgtgtgtgtgtgtgtgtgtgtgtgtgtgtagctttacctccttgcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccctcttcctggtggctgctggtgtagactggtgcacatgctgatcgtgttcttgcctgttttctcctgtcctagacatacctcttattctgtgtattatagaggttgcttttcagatatcaaggtaattgggtgtctttgaccaatgtagtgaatggagcttttcttaactgttctgtttctagtatctgagatggtataatcaagaaccattgagcaagagtcgtctgttctgacctctccatcttcagcctgaaaggatgatgtctataagcctcctactcaggtctgaaatgcccaggcaagagccctctgctcctgtgggcttttcatgggagcagatgaagtcctatatagctactgcctaatgccttaagttttagagtgaagttgagattttattaaagataccttaatagaggcttaaggatgctgtgaaaacaccacatatgcaatggtttgtctttcaaaggttaaaatctttacatactgattaagtttgtttgtttgtttgtttgtttttaatgagtatgcttttcccagaacttaagtcacaataccttggctatagccatttttgtcactagaggacaaggaagctggactccagcttggagtgcttgctccatcaccatacatttgcaaggagagggagtatgtggcaggctttcatctgggaagatgacgctcacttctgcttggctatgtagcttttatggtgtttcctcctcttttccatctctatttcaaggccttctactgagccctgcttgccccctttctacccacacttacctccagttctcacattcctgcttcctccgaagatccgaaagcagccatttccactgatctgtgccacacttgactttcctgtgaggtcattccagaagtcttcttgtctttgtaaacctagctctgatcggatcaagtctcagttagctctttccacatcgttttgaacgagcacatccgacaccatgggtgatgggtagatggggaggcagttctgtaatagaaacagtgcagactgagtcagggttctcctggttacggcatcaccactgaacgacacagcttagaaaaaaatggcttcaggtcctgtgttcatccctgctgcagccactgtgcctgaggtcacactggagtcatgtgctggccctaggggtggctgcagcccacataggagagatgagatcatgggtcacattcaaagggaggttgaggactagtagtagaaagggaagggactagattcttggcagacagaaacgaggttgtctcatacgtggccatcaaaaagaaccatacagacaactttcagagggggtccctggtggtggtgggtaaagaaaattgtgtaaaattatagatcagttctggttttccttgaaattttcatttcttttatttcacagttgtcctttgttttctgaagttactgaatcagtaacttcagacacctactaagcaccgggccttatccatacacagggcatcatgctttaaccttaatttgaaacgaaggaaggcagagaaaatgtcttgttttggtttcttggtgtgctggatcatattggctggaggtcctagtgtcagcacggcaggatgtgactcttctgatgtttgtctcaggtttctctgctgagcccagaagttcctggttaataaccaccctttgccttctcagttccctctaaagctgtgtctccagatgggctcagctatcttgagttaggacataaaagagaaggtagtagggagaggaagcaaaggcattctgcactctgcctgtctgaaggcagatgctctctctcagcccccttgaccagagaacttcactgcggaagtcagcaagtcagctgttccagggtgtagtcaccagtgcctttcagccagtcccctggtgccaggtattctgctgtgtgcacaagcatgaaggaggagacagtaccttgaaagctggcctcagcccataggtggccaggtggacagcctcctgcctcctgacctcatggacttatcttcagtgattcccccaaatcttgggagtattttccttcttgtcctgagttctagcagcgtttcccataatggagcatgagtttttattatctgcaggaattgggatggggttagcttttgtcttgccaaactcacctgtggtatgtcttgatgagagggtgtccttttgtgtagccccaaatttgcctttccattgttgcgccttcttctccattgataaagaattatggctccctgtggagaaagaggcactgtgcatttctgcttgtgtccccatctataaaacacacagcaagggttatccagtatcccttcctgctgttaatctactttaaaccaggcacagaagcacctgtgtggagtggtggccaagaactgtaacctaatgtcagactatctgctttaagctcaggcctcagccccgcccgagaattcgagcgagcgcctgacctggacgctttatctgttgcatgggatggctttgacactgacttcatggcattctcagaatagttccctgaggcaacctgtgaagtcacctgatgcagggattgtcacaccctgggcagtcaacaaaagctaaccattgcagtggtactcccggaaccttggaccgccaaggaagtttgctgttattgtaacctttgaaagttttctaggcagaacaccggggagggcactgcaaagaaactgagtgacagaaagaccagccaggtctccccattctacaccgtcagatttcaccactctaccacactgccctcgattgtttatggaggaatgaaagtgtgacatattcctgtcttttgataaaatggtgctgcgtaaagggatgtggaggaagggagacacggtgaccgggaaataaatgtcatgtgtaccccgggttgggactagaactgaacaatccagctacaaaagacaccttgatggtagttttggaaattccagtgtgggttttctcccagaggatgttcaggaattatcattgattttgataggtgcctcatttgaacttgggtacaaatctactcttctcatgtgattggctgcttggccaggttgacaaaacttcagcagcacagatgcagtcaaatgtagtcttcctccaacagtgcctgcacataagtggtgaagcaagggttacacttgacgctagaccccctgaatccagcaggcttgacatgtaagtaaatgattgctgagtgttttgaaggcctgagcaggcccatgcaaacgattgcaggtttcttccttcaagggcagaactatcctcaaccaagtgaactttccatagtctttccacttaaaagggccattgcttcttcctttctgcttccttgcctcttgactagaaccatccccaatcactattgagatgtcttgtccctggctgggtagaaggtatatatcatcacccatggcaccagcacatccagcctggcccttcccactccccctttaccctcaggggtcccttactgtgaaggcagctcccactttctgccctgggctgctcggatgttacagtgtcgtttgcttacaggcaaggaactcttagccattcagtgatcttttctccaatccctttgactgcgagccaccttttccgaagctgctgcatgtaagcagcctgttcctgtcttggaaacggaaaagactcaagatcaaatgcttaggctgttcaggcatggtggagtgatggctaggtataagtatgttttctgccttggacttcccttctcttcccttaaggcggaggtggaaaccccagcaagttacataagttgctggagcagagggctggccagctgcccaggcctgctcagctctggagctctcgggaatgcctgcactggcagtcaagtgtgggctctttcttaatgaggacaatcattttgcttatccctgtaactcagaagagtggcgtgagatcagggctgggatccctacacatggctgctggcttcgttcaggctggatggggagtgtgcagaggtgggaggacgtctgtcttttcagtttgaatgttactgaccaggcaagtgtgggcagggctgcagagcaggaatgacactattgcagcccacgtggaggacgggaagggctctggagagaaaggatcagagcacgaaccagacacactgccgtcctcttctgtctgcactgtgtgtccacctgactgtctgctctgtggtccacctgactctttgctgtcctgtttgttatccagagattttggaatggtttcatttcctcagctttgaggccctgcctgtctacagttagggggtctatctccaaaccacaggcttgggttgttaaacccaccacttctacagtaggaggaagatgcacttgcattcttagggatgctctggaacctgtctgggctatcatagtgtggctcacagggtggccatgtcaggctctgatttcctctatgtgttgtccagatggcaccaaggagtacttctgctacgcattagtgacacatccatggaacactggtgaatgatttgaccagttcaccagagagctgtctataatttctgggtccgttctcccagagcagtgtcagagaggttggtggttgatggagtagaatgacctgctatggtgactcacctgaagtaaaaattatgagtatgtctcgaggttggaggccaatctccctgtgctctctaaggtgaattagcctccaagatgttctttgttcctgttttcatacctataaaacagggagggagctgggcactagtctccaactagtctctgaagctgggtactaatctccaactagtctctgaagggctctgaggctgattcctttgttaactactgggaaaaactgaaggcaacctctaacgtctcctacgcaggggatttatgcatccagtgccatatctcagaggaccacgtacctatgcaggggaatttcacagctagcaccatctctcagtgaactcccttcgtgctccttcatctagcatgagttcgtagaattaatttgcatgctgagcacatatacccattcatagagaacctcataaagaactgcctactctaagcctacatcgatatcagatactgctaatttttaaaataatttattcccaaaaaggaaaactatcaccagtgttagaattagatttctttgttgactttggatattttaatgatgaatgaatatttctctgtaagcagtttgtcatttgttcacattttctgtttgggtccattttcctttctcatatttattataagggcactttatgtaaagtggggagtgacttcatttttttttttctgtctttccttgaatgaatccctactctaaagttaatgtgtacctggtttctattttggtatcagagtataaaataaggcaggactcaccctttctcttctcccaaatgattgttgatgtcacaaccctgtttattgaataattcattattccctgcaacttgaaatgaactctgattgggattgccacactcctgggacatgtgacagcctttgaattgcagaggcccatgagtggtcataatatgaaaagccctgctctgctcatgcctgacaggaggcgggcactgttggaattctgtgctaagccctgctgccgaatgcttaacctactcggtgtgaacacagctgtaaatgagcagtttagtgtttaaaatgctggaaggcagatggcagtttgctcttcccagatttgaagtgctcctttaagtcctaagttcattttaaattacagaactgctcagggtgattggattgccacttttagacgttaatgttaagtagatcctgggctgtgcatatttagcactttctgggtccttggttccttgcgtcatccctctaatgtctgagaaaaccctactatatgcaaagcctttgggggtctgtgaggataacctactgctttggtattacttcagcgtggaagatcactgtcagtcatgcacgcagtgtactaaaatgaaaaggtggtctgagactggggagccaaaggctgcattccagaagaagcacacacaagcagggtgctgaagggggtgtgctcaggcagcagaggatgcaagggctttctccgcaagatggtgggaatgaagacatgtaggagatcatggagcaagcctgaaaaaaatagccagtgattgcacagtgctgcttatatggtgaaattgaaaagccagctgagagatagtgaggtcaacttgtcagaggcctcacagaaaaggacattacgctgtacggagggataagaccaggaaaggttttggacaactgtattgtaatcacatggggagaatgaagaccaggagggggtagaaaggaaacgattattatggtatgttaagcccctgatgttccttttccaagtgggagacgtgggatttcagattaagtgcctttgaccatcatgttaaaggcaaaatcaagttatggtcatccagtctgcggtggaaatcaagatgcaggcttttgaagttgtaggcttaggttactggggtaaaagcaatgctgtgagtttctttctgcagcatttcgaaagtaccaggcatcggagtggtaggctactccgctgccactgtctaattcctttgcttaggtgataccatctgcgtctaatgggtaggatgatgaggggctgacatacgagatggaatgtgatactcttaggagtggaggctgggttggagacttagggaaatttccagtctgctgaggtgagcacggggagtttggagtcgcaggcctagaagtgaggcaccgtctgcgtacaggcacccatggcgggagcttcgagaatctgtgaaatgtccagatctctccaggagtgagagagaagaggtctgaagaagcagctttgggaatttttaaggagtgatcagtataactcataatacttctctgtttggagcataaattggtacaaccatctagaaaatagtgaagtggattagacatgtcatcctacagcaagcagtctgttggcgcaacttggctctgctgtggtctcacgaaacagatacaaagtagtgtttgagtgtatgaaggtagctgtcttgtcaaaaccttcataagcataggcttacatgtgtatatatatgaacatatataatgccatgtgtctgtttcatacttatatccacacatgtacagttgttcctcattattcatgactgtgaagtgaattcgtttttgctatctcatgggtaggcatgagtagactgataagatgtgatttccccaatgggtgtgtccccttcttgtataagatgatacttcactttctgctcttggctctccacctggagataattgtccttttcctggtccatttagtggcatttaaaaatgtccatgttttctcttagtgttgttttgattttagttggtctcttatgcatagtgttcaagtgctcttatggtccttaagtggaagaaggctgttttgaggcttttgacatcgtacacaagtacaccttggatgagctttgcttgggaattagtatgctgctggctgtgagtttgacattaatgagcaaaaagcatgtattaagtagctgtctttaaacagaaacatatagaaaacaaggtttcatattgattggttaatgaaaatattataaccagagacttaggaacaacgatctactacatgcatgtgggtgcacatgtggaggttggaagacaactttgtgggtttgagtcactccttccaaggagttccaaggagtgaactcaggttgccagggctatgtggtaaatgctttaacatgttgagctatctggggggggggggtccctactttgtactttcaatgtgaactttgtaaaggcctcttctataaatgtctgatatttttcctattattgaatttttttcatataatatattttaactatagtttcccctctctgtactcctgtcagtttctcctattttccctaccatccagatccatccactttctctttttagaaaataaagaggcaagtaagggataatgataagataaaataagataagacaaagaaacaaagacaaatcagaatagtaaaaaacaaggaaaagggcccaaggaaaggcacaagaaacagatatagacatggaaacacacttattcacatactcaggaatcctgtaagatgcaaaaccagaatctataatatatacacaaatgtcttagtcagggtttctattcctgcacaaacatcatgaccaagaagcaagttggggaggaaaggtttattcggcttacacttccatgctgctgttcatcaccaaaggaagtcaggactggaactcaagcaggtcaggaagcaggagctgatgcagaggccatggagggatgttctttactggcttgcctcccctggcttgctcagcctgctctcttacagaaccaagactactagcccagagatggtcccacccacaaggggcctttcccccttgatcactaactgagaaaatgccttacagttggatctcctggagacatttcctcacctgaagctcctttctctgtgataactccagctgtgtcaagttgacacaaaatcagccagtacaaaaaaggacctgtagggtaaattaatactaatagtaatcatcagcattatcatctaaatataaagttaaaagaatgataagaagtcctgacatgaaattatgagacaaagaacctcccatgatgtcattgagttctttttctgttggccatctgctggtgggcatatggcctacctttaaaagtagtttgtttccccagtgagactcccttggagaaaactaaattttcatttgcaactagtgattgattggagatagtttctgggttagggatgagagaacatgtcaagttctccctttagcactaggatctcatctggtgcagaccctagcaggccctgtgcatgttgacacagtctctgtgaatttacatctgcgtcagtcctactgtccttagaaagccttgtttccttggtgtcgttcatccactctagctcttatcctctttccacctcctcttcctttgggtcagggtggttctctagcttgggggtggggatttgatggagaaatcacatttagagctgagtgttcttagtttcacaccctctacataaagtctgtctttgggtctctatccttattccaatctgctgcagaaggaagcctctttgaagatggctgagcaaggcactgatctatgagtatagcacaatgtcattgggagtcattttataaggatgttctctctctctttctctttctctctctcactctctttctttcatcagtaatatttgattttaccctagattcctgggctatctatctagtcttaggttcttggtcacctaagcagcatcaggtatgaaaaacacggagtaggatttaaatcaaatcagattttggatggttacctcccacaagctttgtgctgtaattgcagtagcctgtcttgcaggcaggacaccattgtaggttggaagagttttagctggtttgttgtttatatttctcctttggtagcatgcagaataccttccagtaccaagaacactagccatgggagtgaaggccttatttaggcgacagctcgacttctccatgttctgtgagttatatggagttgtctgcagcaacaggcatttgctgtcgtttgtagagagcaacctcaacaaatacctaggttgtttggaggttcccatgggacgcctttggccaatgactcaattcgctttaactcattcccaatactggaagctttgattggtgacatatgtctagttggagcctcctctgttagttggctatttcatttagattgccttcatatgtgtatatatttcaagaagcttctattatatcaggttttcacactaccactgaaatggctcctgattttagctgtctctccccatattccctctttcatttcctcttccctgtccatcccttcttgatcctctattccagtgcctgactctatccatccataactatctattctgtttcgccttccaaaggagatctatgcttctatgggttgtagcttgcttgtgacttagcagccaatatccctatataagtgagtatataccatagttgtctttctaggtctggattacctcagtcaggatgatagtcttgttccttccatttacctgaaaatttcataattccatttttaacgactgagttctattgtattgttggtggaaatctagattgttttcagttttttggttattatgaatagagcagcagtaacagggttgagcaagcaccgttgtggtaggatgaagtgtccctcctttggatatatgctcaagagttgtatagctggattttgatacagattgattcccatcatccagaggaactgctacactgattaaaatagtggttgtacagccttgcagtcccacccctgatctgtttgattcacatggcttggtaagttgagtggtcttcggtcaacagtctccacccagcctcccttccttcttccttgttcctctttgttcctaaccagttgctagcaaatctcaacttagctgtttgctggtggcattgaaggtttgccctcctagtgcaataaaaaactctcaacttcacggaaagctctccaagacttaaagtggtccattccagatgatgggatgttaaatatgacaggacatgattgtttagaatatcagagttcgcccattgtaaggctccttttgatacattagtaaaataagcttcagagaaagggaggcttcaccagggaacctagtcagtcagtgactcactaatcaagaccaccaaacatgtcagctttcacaactccctccagactgcaactacagctagccatgtagtcaaaagggcatcctgaaaattagcctcaagcacatgtgcaccttagtgtgtcgcatttgttctgtaagctgaggcaatagggagtaagtagctttaggaattgtttgtgctgtgggagttgctaaaagcttctatgaatgtattccagagttacataactttctggaagcgatagaagtggaggcgggagagaaaggaaaaagagaagctaaacaggctagtttttcatatccctaaagttttattatttatttgtagttttttgaggtagggtctcactatggagccctggctggcctggaactcactgtatagatttatggcatctaatttgcagagatctgcctgcctctgccctgtagctgctaggattaaaggtgtgcatcactatgctcaacccgaagttttatttttaagccagtgaatttcaaacgtgagttatttttgagctatgtttacaaacttcagtaactaagggggaattaattcaagacgaaccataagcataaaggccaaaactaaaaagtcatcagaaggaaatacagcgagattttagcaatcttagatcagcaaaagtttcttcataagacacagaaggcagggaccctgccaaaccttggctttcttaaaattaaaaacttgtgtctatcagaaggcaacattatgagattcataggctaaccttcatgttggtagacatatactacacaaatgccaagtctagagtatatagagagtttgtaaaactctgcattaatagaacaacccaattcgaagacagacagaagttttgaagacacaccatagaggaaagctaagaataccgaataaacacatgaaaaagtgcttgctacgaacaatagggaagtgcacagaaaaccatggtgggttattccctcacatacccgaaaaggctaaaattgccaccgatgctcaagtggtagatattggtacaatcacactgaagaaagtttcctatttgataataacaaacagtattataacctgtagttcatcagttctacctttgggtattcaagagaaatgaacatgtgtgctctcacaaatacttggagaaaaatatttgaagtggccttatttatgatacccaaactttagtaaataatatgcacactggagtgttttaatgccaattcctgatctcagtgcttatcaaagagtctacagctgtgtgatgatggtgggcggaagaccatgcagtagactctcagtggtggcaagggttggttatgcatgtgctcacccctctctagactttcctgtgtgtttgagaatgtccttagtaaactgttgggatctaatggtgtcccttactggccacactgactgtacattcttagcttgtattggaggaggttggtttatggagggagaacagagtgtagtcactgaaagaagtatgcatgaggctggttggccagtgaactggatctgtttccaaggctgggtggtttagacccagatgtgtggacgtcctggggtgatttggctctttccatatcacatggaggcaaagaagaactcagcgtgtgctttttctgctgcctttaaactgtccctgaaatcctttcttaacttgaacacagatttcttttttcctcctttgcaaccagtttttatttatattggcggagatactgatcttccgttgaaagctagggaagttgcttgttcaggggtttttaggatttctgaatatgaaatgcaaggaaattgcataacactgcaacacactgtttcctctgcttgttgcccaaaatacagtagttccttctagaagcttgaaggaatttggcagctcctaccccctgatggtctgctgtggtgttatcctgatttgagatcaagtttttcctgaggtcaaacaacaaagcttcctgaattataactatggcaacagtgtttatgcaacacacgaatcaaagtgggggtggggggaaggtgtacccacaacattcagagtaaataaccacagagaccttctcctcatgcctaaatcaccaggactagaaactagcagaaagaaaggcctaccttatccctaggctctggtgatcacttgctacctgtgtgccacctctcctttgggaattatgtcaccttcaatggtgatgtctcacactgagaagcccaggtgccagctgcactcaagacaggaagggaaggctttaacatatagaaaatccactcacccagctccttaagtcttgcttctggggcaaagagaaggacccaggaaggaacggcaccttctgtcttaagcccatcctgtcctctagtgatgaataatttcttggacactgattctatgcttggcactgtatttggtgccatttcctcctaccctgctctccatacacacagtagaaggatcttttcctcagaggagaatggaaataacgaagaaggaaaggctgtacttggaagtgttaagttctgcagaactgacttgtaagtgcagtgggaggtcaaaggaaggagccattcaggtggtctgtgagcctcaggggagttaggaagccttgtggaaagcgtagacaaaggcaaataatatttgagctcattgggctccaggagagctatttttacttctcacaatgctctcataaagtgttgtttcttagctctactttacaatgagaaaacagattcagaaatgtcagatatcatttgagggcacagaacttgaaagtggtagagccaggcattactgtgaagtctcttaagccaacagttcacctctaccgcctaactgccccacttacactaatttccccctgttctggagtttgtccaaggcctatattgtgattaagtcccccaaatgtgtcaaacccgggaatatcaagggttacccttaaatgaagacaagctcagtcctgtaagagtgactccacgttagccccagtgccatagtggccatgaagagctctgcagcaccagtgcagtatgggtgcttgcttgtatcgcaccttcccttcaccttcacttcatttgaggaagtgcgtattctctgtcttccacacaacagcccttgaaaatttgaacactgatactgtgacatcttaaagactcttctctttttccttcatccaaagctgaggcttagggaagcatcttataagagtgatatatgcctcagactagaacagtgacagagacaatggagtcagtaagtcccgagggaaggtcaatatccaagtccaagtgagaagtcaaagaaaatctgacttagggcaatagagaaaggaatggggtaagaaattagctccagataagtgatagcattggaactttttttttttctcctgagggttttgctgttgctttggttttattccacaactcttggctgtaagccactgggtcacaattataaaaagaactaagatgttcctggctcactgtggaaagatcaagaatgacccctggacatgtttagatgaataggcttacatgattctggaatccagtgtcccttcatagtgtggctttccttatgtccttatgtttgcctggttcctttcactcacttccatgattggtaggcttgtccataaggctttagatatgtatctcactcctttagcaatgtgtatgccttcctttccaatggtggtggtagtggtggatgttgttgttgttgttatttaaatagtaagatcaaatgctactgactgggtttcacttggcatgaatcccatgcagtagattttagagtctgggtcacatggatggacctgaagatgcaattagggtctgccccaggtgaaacatacggacttgggggctgtggtttctcttgggatgcaaagatgaagccaagcaaaagaggagtgtggatactgagcagtggtgggagctgcaggtgctcttagtttttctctaatgtagctgaggaataattatttcctagctgtaaatgcttgaattaacaagcattaactagctggtaatgcttgaattcggaggaaaccaagcttattttctacccatcatccgtgtcctaatcaggatgaacagcaagcagcaagctttacgcatcacatggtgttgtgttggtgtataaaaaggcttcagggattattgacagactttccatggctgtaggagtccagtcatctggttcaccttttgctgcgctcctttcatgagactgcctgagtcccgagttgcttatgattgcattggaaagggaacttaaccctgtcctgcagacagcccctttctcagccctcatcctagagcttcctagtgacacactggactccacaaccctctgctgcctttgtcacctgcaggatgcagagcaagtgtgaagcaaagagccatagagagagagtaaatagctttggaagggagtttgataactttgagttaagccaaacaagaaaagcctgccttttattttcttgttataagtacggagttctatatatatttacattcccctgtcaagtaaagattcctagagaattttccagaagaacgagacacagtccccaggaaatagtagacctggcttactttttaggtctagataaaactctgtccttatcaactctaacacagggattaggggacacatcattttttttttttttttttgacttcttgcacttaaaacctaccttcctaatcagtgctctttaagcagcctgctacatgctagctactgaaccctatttatgtgtacttctgctggacaagagctgggatttgatgtttgttcagggtcagattcttgcaaagtactgtcaaatatgtttttattggctctcctttgagagagcctccctgagacagcaagctgtagctctgcagtggggatgtcaagggtaggttgcccactgaggaatggaagagaagcaagagccagttctttctgcttcttgagcaggcctgtcattcagcctgaagcaatgagaggcatatttgtgatgggagtgaggcacgagtacttcccatttctgagctctgtcttttctagtagcgagtcatccttctttattctaagttgctcaaacaggtttttatatacctctgcttcagacatggctattccttacacatttctccacgtggccacccctgtatagagaggtctccctagctcaaacaattcctgtctctatgggatttcatgggtggcggcccacaaatggatggagtctgactggtcacttctcaagggtgacattacaagtctctaaaatggtctgtgtccagtcgctcgctctgctgagaatccttccgtgtcttcctcttgcattgctggccagctttctttgtgtgctcatcatttttaggaaggatttcccttggtctcctagatggcctcaggttggttgtggttttcattatttactgccatactttgtactaattggaagtttgtaaaattactgttatgtttaaataggtggaaagtgtgtgcttacataatggttactctgctgtcattctaactactgactagcccccacccctttattaatctccaggctatttgccaagctggaccgagcatagatattgtggctggctgaattggaattgaacataggccctcttcaagattatcatgtgcttttaatggctgaaccattatctggttgtctggttgttttaaaagactgaggcctaggaatatatagtgatgtgtgtgcaaatggtaaatctacagtttgaactatggcagattactgtgaccttgttaacactgaggggcaaataccccaaagtgcaagttcaagcaagggcagatgtatgtgggagtgcatacctgtagccatagtattcaggacgtgaagcagaagggtctacagttccagcatagcacagggggagcctgtctcagccacacacgatgtccagtaatacagaaccctcctgagcactgttcaaagatgttaactcataccgtgtttatgttatgtccccacaatggataccaggggacagacagtcaggtgggttgagcgcacatatcttcggttacttggaagaggcctcaaggaatcagagtttggggctgagtttaggtaaaacagtttagttcatgtagaaacaacagggtttttccataataaaatacacattttaactgctttttcattatttatttattcatttaacatcctgattgctgtcccccccccatccagttccccctcacagactgcatccccttctcctggatatccccctaccctagtacatcgactctctgcagtattaggtgcatcctctcccactgaggccagacaaggtagcccatttggggaatggcttttacagacaggaaacagctttagaaacatcctctgctcctgttgttgatgtacccacatggagactaagctgcacatctgccatatatgtgctagaatccttggtccagcccatgcgtgctcttcagttgctggctcagtctctgatagcccccagggggccagactagttgacctccttggttaaaacaatagttttaaataagtttgcctatgagcctacttctctaatgacttcatttgtatagagtttgttctgaagtgtatggccaagtgctaatgcagctatgcagccaaagtcagattggttcatcaaattactattttacacatgccttcatttatatatttttaaagaagtacctgtctgtgctttctcaatatggcttagataagataatggtaccaaagggttacccacagaaaaattctgagaatccaaatgactgtgtgcattttataaaaattctctggggacatgtagattgaattggcccagcagttcagaaaatctattgccaaatcacattggtcgcagagaaagcagatgaaggttttctgcatcctgtgatttattacattgttcccccattgtagtttctgggtaaggactcgggcacctgcagggccctgtgtctgtgaaagtcctgccttgccagcatggtgattatcacagatgggagttctctggttctgagggttcatgcaatgtcacttccacgttagccaccagtgggatgcatggacgggcggtggttttgtcaggctggatctcaagagcattcccagttccatcttctctctgactcaacagtaaattattgctgactcaacagtaagttattgttcttatgactcacttgttctggctgcccttgatatcactttaactttattattgtcgccgttgtcgtcttcaccgccgtcaggttccgcatatgcacagtgatagtgacactaaaactaatccatttggcctttcaagcattggatggggactttgtaaaagtccattctctagtgctgttccgaagccattctctattgtgaagttgctgcctgccctggtctaccttgctgggtcatgtgatcacatagtcctggcaggattggtcgttagccttatttcagaacccattgtctttggctcatttacccagaagagacagagatgaatggcacagccttggaggataggggtagcacatacttttggtgtctttggctcgctgatcagacctctccaactcagcatgcctgggtgttctaggcaggggtctcccgagactcaggaaacctggaaggaaagtaacttggcatggttttgcctcttaattaaggagagccgaaagctctttttggattttgcctttacaatgtgaacacatttctcttggatagactgttcggattgaattggagaaatgcagtgatcaaggagggctggaaggaaaaacaaataaattggccaaaggctgtctcctcccgtgttgcccttactcggctttccgaggttattgagtgtagtcgtgatgggtcgctgccaatcaatccctgagcaaggccctggtgggacctggctgtacctcccagccttgtccttagtcctcgtggttgtatggcattcggtggttgtcaactacactgaccttctccccagtaagatggcacttactgggcacaagtacctagcccttcctcttttattatttaaactcatggggatagtttctctccaggggagctttaccccataccagacccacattgcctccttttcggacctccattgtacttgtcaatatttgaaggaatcatatttgtaaatttgttttcttcactggtagcaaagttccacgtgagcacctagagtctgcccgtctttatccgtggcactcaaatcactgcccggctgttgcatttgttaacacaagcaaaagaattgcagaggactggaaaattttcaaaccagtatcccttatttgataaccacttgaataaaactcttctcatcgaagccaaaggaagccatggcatttggctacctagagtccctgctgttctccaagtctctctgtcacctttgtgtaatgccgtggacgtccattatcaaagaccaatcaagtccagacacttcatttatcccagtgatggatgctgctcagagagccacctgcaactttgtttcagttgggaatcagcacaacctccgtggaggccttcacctagactttgtggggttttgtcttttgcaaagtctatgaagtttgagccattctttttggcagaaacacaggccagagctccctcatttgtcttgagctgttgcaggctattcctcttgacataatctcactgaatgttcacggcaggcaggggaggcatatgccaagcaactattatcacccccatctcagagatgaactaataggatccggccaaatgagctgactggtggggaagtccaggccaaagccattcttgtgatgccttgtttctcagactcttatgtttgtcctctgatctttaagtggctgtatagcttcagtcttctatagagaataagtataatacacctgatatataataaagcaggatgatctcttggatttggggtttgacatggggcaattcctagacagagccatgaagacccagagaaagtaaggccagctatggcctacttgagcccgttgccccacccttgactagccattcctctgcattcttagtagaaaactcaccttcgggggttcagtgcatagatttcagaaatccttggcttagttcttttagggattaaatatttctcagctgtgagtgaccgtcagcatcccgagggatggttgaatagataagtagatatttaagttatgatgccagcttcctcccaggcctttccatacctacacgggcagatctggccctgggattgttttcctaagtagaggcttcaccatacttcttttcatagcaacagcacctcaggaatagacgtggccagcagcccagcccagcccaccctttgcttttgtgtggaccctaggccacatgtgatatttacagaataatttttgcaattgacaagtgatagagccctgacactgcatcccaaagaggcagaatgccagcctccctttgcagcataggcaaagaatattggttctgctaattagacatttttttttgcaataagttacattttttaaattttgtaataacttgttttctttcctgatatttaagtacctcttggcactttttactgtttattgttttctatcttgaccttcatagagcagctagctgccttttgcagtagccactgtctcctctatagtaagaaatttcccttcttaccatcggaccagtgtctcttaagatgatttctagcaaccatttaagaaggtgtgttgaaaatgtgatagcttctctctacaaaattctaatctacatacagaataaaagggactggtctcacccccagggtcaggactcaacagtttataatgtccctttgccattaaccagctgtgaaacctcaagtcctctcacattttccagctgtacaacagtggagcaagtgctcttgccaagcatgcagtggtgtagatggagatcatttctgtgaaatgctgaggacattgtcttgtgtgcagttaatgcttaatgatctataactcactttgaattctcttcttctgatgtatatacacaaatcagtttatttgccatttaaaaaaagatggagataacccactaccaccacaccacccccccccccacacactagtgtttcacaggtggttctgatccatgcttatttgagaacagctaagtgcatgctgggaagtaagtcatttcttgagggggtttttactggggccagggtgcagaaatctccttccatctttgggttttctgcagtgagtctgtagaccagtataaaatgcacatagagtaaatttttatttctatttttcaggtgtacaactccaacagagacagccagagcgaagggagtaagtatggcccgtgggtaatagtctgcagtcagagttgggggtgggaggggaggcctggagaagtcgccacaccaaggctgagccaccaggaggtgccatgggcattttgggtcagccacatttcagagggttattccagagcaagattaagagtgtagtgacctcttggatttaaacaacccttcgtgctttctgtgatgctcttataagcattatctcacgtggtggtcccaggccttattaagatggtagctgcagtcaccacttataaacggcttaataaccagcaacggagagccaaggccgctggcacagtctgccatcccagcaagggcagtagccaaggtggactgcttactaattctgtttcctatatggctctttgagaggaaagagcagagagcagtgaggggaggagatactgttctttgatagaggtgagcagcagcctcttagaacacagcactttcctgcagcaggccagttccccgcttcagcaccctggagggcacctgtgactgcaaaggcaaaagtattagaggagatgcctgctgggcaagcccagcaacctgattatttccttggttcataagacaagaagcaaattccttctggggtaccctaggggcacagaggaaactgactcccgcctcagctttgctctacaaaagccctgccctgaactgtggtagtgccgggagattgggagcagagcagcccatctctctcagtagacagaagtgtgagcctttcactgatgttgttgctgctgctgatgatctttttcttcctcctcttcctcttcttttgtgaaggccattagccattgtgaaacagatgtttctttctgaaatactttgccaaaagtttaaaataacaacaaaaattaaacaaagactctttagccaaggctggcctcaaatacccatccagggatgaacttctgacccttctgcctccctactgagtgctgagatagtgtaactgggaaacccagtttatgcagtgctggggcttgaacccagtacctcatggataaaaaataagcattgtaccaacctggctatatcagccattgccagaacatccagataaaatattaagtgatttgtaatgactacaactgacaagattgtactcttcgttatgcgaggaaaagccaggtttggttttgttttctcttcaaaaaatggagtaaggaaaacattttaagcaaatgttcaaggaaacaaagaagtagctctcccccgaccccaatttaagtagattgtttaaagtgtctggggttaactttggctaaggggtagggagcaggactcagagatttaacagcaaagaagcaatagaaggctgtagtgggccttggtggtggagcaaatgaagacacaggctggcagacagaccagctctggggatgcaggagccaacaataaggggccttctggatgctgtcggcaggatacaaagtgaagagtgagattcccaggaaagataccagccagtgagtatagtgtgtgcctctccaaggaaaaacaatatactatgatggatggtgtctagcatattgtatgaaatgggagctggaaggcttctcaggggaaattagggaggccactgggataggaggcctgcatggataccccacaggctgaaagcatgtcttcccactcctggcctcaggcaggtcattgtgcttcttagtaaagactcctagagaccccaggagctgtggatgagtgcatacagagttctctgctgcatgctaacctgcacctgttgactttatgaacctgcttctttgtgtaagtgtcaagaggtggaaaacattctagttgaaatgattttattgatgggtatgctaataggtccggctggtccacaactgtttcaggagtatgattggaagttttccggaagtggctagcctttgactcagtgatcatttctaaaatacaaactgtttatttaaaatgcaagagagcagttagggaatctattaaatggagtaaattttagagtagtacgcagcctttaacaagatgaaggatgcaagtggtgtctttccatagtcagagtctgtagaatcagctagggagggagcctctgtaaagaaatatgtaggtttggttagcctgtgggtatgcctatgagagagtttaattggatgaattaattaatgaattaattgggttagttaattgaagctggggagatcccctctgaagtggcagcactgttttgtgcgctaggccctggaatggatgaaaagagaagggtcagagtaccatgaattttttcattcccagctctctgcccttgactgtgaatgtgatgtgactagctacttcaagttatggtaccttgactttcccacagtgttaaactataacccaaaattatgtgccaaataaactttgttttttaaagatttgtttattatgttttattatgtatacatggttccgcctgcatgcatgcctgagagccagaaaagggtgtcagatttcattatggatggttataaaccacgatgtggttgctgggaattgaactcaggacctctggaagagcagccagcactcctaacctctgagatattcagccctaaatttagtttcttaagttatttttatttcagagtattttatcagagcaacagagggagaaactgaggcaggaggactgtggcaatggctcagcagtcaaggcacttgtacaaagcaagaggaccagggtttagatctgtggagcccacagacatgtcaatgtgggcatggcagccgtgtgttatcccagcccttgaaggcagaagcaaaggatctctgagcaatctggctagtgaaactaggttagttggaaagctctggatttgattaatagatccttcctcaaaggataaggtagaagaacgaaccaggaacattgccagccacaaccttgggcttcttatgcacacccccccccccacacacacacacatgcaaatgagcacacacgcaaacataccacacacacaccaatatgtgaaaaggagaaagaaaatattgaacaaggaagaccttaatgtttgatgcctgcagcacatttattgaattttcaaaataagggcagtggaacaaatatagggcgaagtcatgggattgatctgggggtttgataggaaagtgtcttaagctacattgatcatcagatactatcaggatggcaagtggcttgctgggaatgttcagattctagtgtgtttccgtgtaagctacattgtctactgttagagtcgtttacagccatggctgtgaagtaaccacttgatatgtgtgcgtcaggtactaaaggtttcttagactaagtttgtcggggacctttggcttgatttgtagatgaggaaattgaggctaataagctcccaggatacaagttagtcaaatttgtacccaaccccagtggttgtatttttgaccacaagacaaatttacttgactttgcctgaacaaagggtagtgcagagtcctccatgagggatgcagactctgccggagcatctgtttctgcctccggttactcacagcctggggggattcgcctgtgtccgtcgtggagctcaccttatgtaggaagaaggagaggttgtgatggaatgaaaagtagcagccaccttttcaaggctgcttcattttgtttggctcttcactgacttccaggccagtgagggattagtggtctgggttggtgttgccttcctttcttggtattaatatcctctgctgtatcattctttccctgtcttctatttaggaattgcacccagggccttgggcatgcagggtagattctctcccacttggctccagcgcacaccttgacactgttgtctctctccatctttactgggctcatcggccacacatagcactcactattgcttgggatcttggtctttctaccattttttaatgccccagtttaagctcttttaaaggtaagaagtcagtctgatagggatttgaggattgattattgcttttctgaccaaattccaaatgtcagtatgcaaataaaaactatgtaagtattttgtttcctcaaatgttttggtgggagtttgaatgcaaacctcttgttatagagccagcggtgttcggaggggaattcttttgtggacttgtcagaatttgttgcaatgatgtgaagtttctctcagggcatacagtgcctgagggcattataccgattcataatgacatctgttggccgctatattttcgcattgctcacttgctaaagagaagacggctacagacaatactggcacatctcttcccggctctttttgttttctcttctgcatgttctgtttacgtcacaggtagaaagcctgcatcttccttccctgtacattatcatagtgaatcttccattttctgtattaatttgtactcttctctttcccctccatttgtactttagtttacactttagaccactaatctagtttgtacttttaaagcacatttcttgtaaaaatgcatcttctatctagccctgcccttaaatgataaaaaacagccctgtgtcttgctctgatctgtctttgtccccctcagcatgcgttggaagccatctacatcattctttgtggtctgccacccctggaaggtggatcatctggttttgaagagacgtgctcccacctcctcagctgtattccgctctgaagttctcatcaccacagcacatctctatgatgtgaccttgtgtgatgctgtcctggggttaaactctctggtccatgataggcttagtttgctctccatagtggtctgtctacctttccagtagccttacgtgcccattttcccattcctgccaactctgttcctcagccctgtgattccttactagccgaatatctttacgtgctagcacgttcctttctctagtaagtagagttttgagcttctgctcacattgcctgccagtcctctgggcatcctagtctcttaatgtcttgctcatgtcctttgtccattttcccgtgacagcttgccatcttttccccatgtacttgcaaagttatttctatttagatattaatctttattaattgtagacattttatcttatttttgtggtgatagggattgaaccagagccttgcacatgctaggcaagccactgaagtgagtatccagcctgcaattagatatttgaagtacactttcccgtcttcttacctattgatgttatttgtgctgtcgttctttggtgctgggattgaacctagggccttgtgcacattacagagctgtattctttatacagtcattgcatcttttaaattttgtctctgatttcttttctggttcctagttttcaaatcttatttgaagaaggcccttttaacccaagggctgacgatgcacccgagtctttactttctactctcttccctcttctgtcccttcttccatccttctgtccttccatccatccttccctccctcctattaatgccattttagggttgacattgctacttgtagacatttattctttgagaatagatttagtaagttcctcaaacatgagaccttcatctgcatttaggattatgttaattaaatagatcgattttgaggaaaaccaacacttttatctgtaatcccatcctctgctctaagaactttgaatgtctttctgtttattcagacgaacatccttttattttgttttgagttttctgtctagaggtcttgtatgttcttggttgaagtcttcctaaaatattaaagacagaagacaaccttctcttttagctgctcatcgagtaatcagtagtcccgggaacagagaattttcctttggttgttcgcacaatgtcagaagctcggagctctccagaaggtcaattctgactgcacagaaaaggaaaaggggagagtggaattacagctggtgaagaagaacttgatttcctgctctttcctgctccctgagcttctcagtgacagggcaaccacccccagtgccaccgtccagtctccagatccccgctccactcttacaagaggcagggagggctctgcactaggccaggtctgttctcctcgccactctgccggcttctctgccactttgatgcttggttagtcttgttctacaccagaactttggctacagttatgagatttgttcttcaaaaattcagagaattgaaatcaggtcagaagtgagagactctaggacttttaggatgtaagttttaagtaataaatgtcactaactgttcacctcctcaaaggttagcttaaaaaataaaactagcaacaaaaacaaaacaaaacaaaacaaaaaaaaccaaaaaacagaactgcaggtcccctctgcttctccagcagtttaaaggctgaaagctgatggattggagtagagagggtccagtttcttaatctggttactcatagttctgcctccctctatgtgagactcaacccaaatcaatagcctaactaggtttatttaatatcacgagtccttattgcggcaggcttgcctcctcatagacatcatcagagcatagccaaatgccgagcacttggcttttcagaatatcatggcagcagttcactctgcctcccactcttggttagcacgtccctttcactcctatttggactaattactggatggaaccttaggagttcaggcttcctgaaggtcctcatctagcaaatccccatctgagtccacaagggcagatgctactgacagccgtgagcacaaggggagaacaccttcagctggaatagatagctctacattgaagcagttatgatgtgcagatgtgcagcagggctgggagcaccatgagcaatagacagatggcccagttctgttgggggttaggaggcgtgtataatatgcatgtcatcaacaagtataccttttgtggaaaatgccccaaactgatggatttgaaaaatgagcctcagatgggatttcatctagaccgaacagatttagaaaatgctaacctccaggcagggccatggctcattagtagagggctcgttcatatagcatgcgcaaggctgtccctgcaatcagcagaacagcacatgctgagggacccactgtgctctctaaggtggttattcacagtcggaggagggggggagagcaatgattagcaggggaatgctctgtctgggagctagaggtgtggtctcttgtttgtaggatgtggacacggaatctccaaactgaactctgaagcagtttaaaaatatatattctttctggctattaaatagtatgaagttacagtagaatattaaggaactacagcaaaccgatttttcaaaaacagtaaaactaatttgtaagcccacagctatttcattcttgaatttttaaaatgatgtcttataagtattttccactattgctatggatcttggcttaattggcattatggcgaataaacttattcccattttgtttttaagaatgtccaagaattatctgtgccatataagttacatcttgataaaatttgtggtgtttatttaatattccataataggattctatcctaattgctctaatggtcctttccagttgatggatattttgaggcctatacctctctcttctctctcttctctctcttctctccctcctctctctctctctctctctctcttttatgtgtacgggtgttttggctgcacatctctctgtatatcacatgtgtgcctattacccatgttggttagaagagggcatcagataccctgagactagagttacagacagttgtgaaccactgtgtagttgctgggaattgaacccaagtcctctggaagagcagccagtgctgttaactgctgaatcacctcttcaggaccctgaagtgctttgtttagggtaaatttggcggtgttgattagtgctttcatatagggtgctgtggagctgatatagattagcatgttggcccttgactcttggagagagatgaccgggccctctatactttcattatctttcctataggaattttcattatctttcctataggaatggagatatcaacattcctgtcttacaaactcaatgtgagaattaaagttgagcacagtatctgaaatgttaatacctaatcactcccgggtttagttcttcccatcacctggccaaatgaggatagagagttccaggctagcctgggtaacatagtgagaccttgctacaaaaccaaaagaacaacaactcgcacagaacaaggaaaacccagcgttgagaaaagccattggactgacagatctgctcttgcagggaacaatgaggagaaagagggaggtagccattttctctatcttgaagccccctgagggcagttcattcaattctggtggctgcatgtctcaacgctagtacctctggagcgttctaagtagctgtttctgatatgtacttagtgtggtatgagtgggaggcacaaacaccataaatttgttgattttgtaaatgccatcatttaccacagagatcttgcttttcagtaaaggggcagaggggaaatacttttagtttgcggaattgttgatttcctctatggccctagtgtgagagcagccactgatgctatgggggtgaatggaggagtactggccagtaaagctttatctgtagatcaggcagtggtgacttttagccatggaggatagttggttagctcgtcacttaacacacagggaactttttaaaaaccagtctgtttagaatggcatgagatttggcagagggggctgatggtaagtgaatgcgaatggccatcacttacagaaacggagttcagtgtatctagattttaactgagccaatggaattcaagagatatagccgagaagtaggaaaaccaatggccagggtcctttgcttctgctcttgacatgcatggaatctttgctttgtttctttatgcagtcatatgcagccagacttgggagactagaagcaacctagagcaattctatcagcagtcttttagcatctgacccagtggttctcaacctgtgggtcatgacacacaactctttcacaggggttgccagagaccattggaaaacacagataattacattgtgattcataacagtagcaaaattatagttatgaagcagcaatgttcaccacaatgtgaggaactgtaccaaagtgtcacagcatcgggaaggttgagaaccaccactgactgtaacccgtcagattattttttttgccgctgtgtggacacaccacatgaatctccgtattagaaccattagaatcagtctttcctcaaatacctgtgctcagttctgggtgagccagggccacaggctttggtggctttaaagactcagggttgggtctttacagtggtaccgtggcatcccacagagattctggaacaaatggagccactccctgtggtctctgttgtttatattctcattcttaaggttgtcactcaaatccaagctcacggcggtgctttatcaaggcttgtctggatttatgagccaagactgaagatcaggagaggagatgggcagggatgcatttccatctctctgtgtttacctagttctgtccctctgatcctcaattctcttcatctctgtgcattggcttcccttcatctgccagacagaaaagagattcagccttgaagatcaccgtggaaacctcagtgggttagcatggctactatttttaagaaggttctaaagctgtcagccttcatgatcaaaggtccacattctcatgaaagcagtaaagggcaggaaaaagggcttccctgtcccccttgcttccagtcacctttggccctttgctgttagaacacccacagtagagaggcaggaagaggcagccattggtaacaaggatccctttgggatcagagccatccaaaagctgccaggtctcccctgttgggtagctttataaatagaacatttccccttttaaacctgggcagagtggaagcattaatgggcgcaacgcctggcctcctgtgcactggtccacgaggccatcagctgagtgtaccttcccctccagctttccatcctgcctgccagggatggcccacggcagattcttctccacactgcctgctcccctgtgccctcttggcctttcttctccctgctggtccatgcaggtttctgtggcaatcccttttgtcttctgaggctcagttagagtcagaggagaggctgtgcaggcgccggctttctgcactttgccttttgctaggaatcctgcctgcgacatggttgctgcttgcggctgcactgagctacaattacgtttagtgaagcagtgatgtctcaactacatgccttagctacaggcagagtctgggggggggggggggaatggtttctcagatactttcagttcccagctgttgtgtgtgatgagaccatcttccaaggacagcattggcaatggggctccttgaacttgcccaggcagtcagaagcctttttgcttatcctgggagacatttcagaaatccattcttagcttcagacttacagaggcagccagcatgtaattttgccgtggcctaatgtttgcctttccctcgtgctgtggaatctgtactaacagactggtaaagctacctcctgacagcccaggctgggcttcaaggcagtgatgcaggactctggatacctctctaacccctatcaagtggcagctaagacagaggttgaaagattgtccatactgtcaccaagtccaggcttctaatgattatacttaatacctattgagttcacactacacatggtacattgtgctaagtgtttgacacacactatgtcacttgataattattataagggaagtggtatcattgacctcgtttacagatgcctgaggcttctatctaggttcaaactcaagtaatttcttcaagtatggtcactcagtaaactgaacaaagattgcagattgtacttcttactctgtgtgtgtgtgtgtgtgtgtgtgtgtgtgtgtgtatgtgtgtgtgtgtgtgtgtgtgtgttgtggtatgtgtgtgtgggtgtgtgtgtttatggtgtgtgtgtgtgtaagggttggcagaggctataaggtttcatttggggtagggtagagtcacatataggagttttaactctgacagtctacatagattgcaatcccattgccattgctgtaataatatctgaccttgggaaactccaggcctcagttatttatatgcgagactggcttcactacatacatcttgactttccaggtaaatagaataaaattgtgacagataccttttgctcagtggtggctggtgctggatgctgttattaatcatcactgcttgctctattatcagtagcatccttagtatcctaagattattgcctgcctctcaagttccctagagtgtctgaaggtaggtagatgaagtctgtccatcaaagtgtgttttgggtctgaatatcatctccttcttcacctttgctttctcacaatatattttgacaaaaagggggggggcattgtacctggggcatctggagctagcaggtaggtttgaaaaataaatggcaggagaaagggtcttggtaggcagaggcatttggatctgaaagtttgaaatactctgtcttcatgattttttgttgttgttgttggttcagaagtcatcgcaaagcacctgaggcctaaataaaaggattcgagaccagtggactaagatacgctcaggatgcccagtctgctagcaggagataatgatgcaggtgatgctggggcattggctgagacctgttttttcagtgtctctgtcctgagaaacactcttttccatggcagatgtgcagcccttagttagctgtgctctgcagcagctgacatggtgccatgtgggcctcttgactcctgttgagatgagcctcttttgacagctgtccttgggcctccttgatttaggcagagagctgagaggtttattacaggcaagcagtgatgtctcttctatttatgttccttccatgactgtatctctcttccatctcagtttttctgtttgtccccagaaactttgggaagcggggtagtggctgtgtgtctgtcaggcagggagggggcgtttggattgtcaggtgttgcctagaggccaggccatgatggagacgccctgtgggtgctccctgacttcctcatatgcacagattccagtgtgttaagtcagctacgctctcctaaagagtctttggagtgctgagaacattttttctattggttcttggtcttttggctggaaaactataagtttatttgtttcctcattcaggaaacatttatgaagataaaggcacaagtgggctgattgatcctccacccttgtaaagctggcgccattttaaaaactttaattgaaaaatttaactgatgtgtaaaaaactacaaagtgtgcacatcaaatagactaccacaaagtgtcgatatttgtatacattgggtaatatggaggctatatactctagagagattgacaacaaactataaacaagtagactagggtatactttgtggtagaggcaaatcccatgaagaaatatgaaggaggaggaaaatcaggggaaggcacttggtcagatgatcagagcctcctaagaagtgagagagggcaggatgcatatgagaagttgacaggatgcatgtgagaagttgacaagtgagtactgtcaaccaaagggccagccacacacaaccccccctaagaaggggaatgaatggagctctagagatgctcaaaaggaccattgggatagatgggagtaggcccagaggagagcagccaggtaggctagagttagactcatgcactcacaaggtaagattgtggtcttagcattggagaaactcctagagtattgtgataagataaggtgggttgtctgtgctgctgtcatttgaaaggatggccctggaggtcggtaaagaatagacctaggggataaaaggagaagcatgtcagagatgattgcagcagtccaggaaaaagtctcaacagacttgggtcctggtattagctgtaagtctacaaagaaggagctgggttggatataggtggctcgtccttttagctagcttgaatgcagcataagcttggggcactgtgagacatgagctcagatgtgttccttatgtctcacctttactgcttatgtttatgtacacacgtatcatcttcattattattgcttttctttaaataaatttcttttttaatgtttacttaaggtataaatatatcatgcagtacattttatgtcaaacagattcctaatactcaatacgtaggtacatagatctaagaaatatatgtgaacttcttggaatcattccatataccacatcagcagaagctcattttacatattaaggcccagagtcgttagatccttcataccctgcagggaaggtagtagtgcagatgctggcaattggttgagttagcgatcaagtttttgtctctggccatgatagtttaaggtgctggctgcttttcaacgggttctcccacttaccaaagcacaatgtataggagagggctcagaatttgtgttacaagtgtacgtaccctgcttctcttgactcctggaattgacactgctaggaggagaagagaaagagataatagcagagtgaatgaaatgagtaaggagagatatttatgaagcattgtcttcatgattgcttattttaatttggtacttgtcattatttttcacagagtcatacaaataaatataaacttgacagctcatactgcctattctggaagaggttgataagactcatggggtattaagctaggagagaagactaaagagactttttgagaaatttatacctaaggagagttctgtattaaacaggccaagtggataaggtacaactcattgcttatgcaaaggttggagaatgtggttaattagatgttcaaagaaagccagtgtggtgaggtgctgagagctaggagagtggcatcttaggaggctgggtctgagcaagctagggctgggccccaaggttcccttggttcatgttcaggatatgtgttacctcctggacaatgttgacactgcaggttgaataaataagctgatagtttcaatatcttggaaacataagaataagagtgaatgcagttccttaaagtaagaaataggccagacactcttttgttgttgttgttgttgttgttgttgttgaaaagcttaaaccaaatgggtctgtctcacagggccatacctatatagggagttgagttgtcagggtaaagtttgtggcatcaaacccagtgggtgggttggctcaatacctataaatatagtaagagatcatgtgcttccttttagagaaggaatgaatatcatttttgtttaatcaattggacaagccaaggtaggaaagagaaagctaggttgatggagtgtgccattgatggatggtaagtagggaagcaacttggattttgttgttgttgttctagtttttttttttttttaattcactctacatccctattactgttgccccttccagtccctaccctcccacaatccctcttcccattacttcccccccccttctgagagggcggagcccccccctgaggatccctgtactcaagtctctgcagagctaggctcatcctttcccaatgaggccagatgaagcagcctagctaggggaatggattctacagacaggcaacagctttagggacagcccctgttccagttgttggagaacccatgtaacaatggagctgcacatctgctacatatatatggatgggggtagggagtgggtgtagggccaggaataggtcttccaaagagtccccgagctctggccagtgttcagctgtgggtctctgcatctatttcagtttgctgagtggagcctctcagtggacagttacactaggctccatctacaaaaataacagagtatcattaatagtgtcagggattggtgctttgccatggaaataggtctctagctgggctggttattgcttggccattccatcattctcagatccatctttgcccctacatttcttatagacaggataaattttgggttgaaagttttatgggtgggttagtgtccctatctctccactggggtttcagcctggctataggaaatggcctcctcaggttccatatccccaggtccctttgagctgcagatttccatgcattctcctggccctctggccctctctcttgtctctcctcacacctgattctcaacaccttcccattttcctccccatcccctctcctacccagttccctccctccatctgtctcctgtgactattttattccctcttctaagttgcattcaagcatccatgcttgggccttccttcttccttagcttctttgggtctgtggattatagcatggatagcctgtactttatggctaatatctgcttattagtgagtgcatacaatgcatgtccttttggatctggcttacttcactcaggacgatattttcaaggtccatccatttgcctgcaaaattcatgtttttgtttttttttttaagttgaatagtagtattccattgtgtagatgtaccacattttctttaccttttattcagttgaggaatatctaggttgttttcagtttcaaataaagctgctataaataatttgagcaagtattcctttggtatagtgggtcatcttttgggtatatgcccagcagtggtatagctgggtctcgaggtagaactatttccagttttctgagaaactgccaacttgatttccaaagtggttgtaccagtttgcactcccgctagcaatggttgagagttcccttggtccacttcttcaccagtgtgtgttgttccttgaatttaatcttagccagactattctgatgggtgtaagatggaacctcagggtcattttgatttgcatttcccagttgagtaaggactttgatcattgctttaaagtgcttcttggccatttgagagtcctctgttgagaattctctgtttagctctgtatcttttttttttttttttaaattgggttgtttggattgttggtgtctaatttcttgagtttttttgtttttaagatttatttatttattttatttctataagtatactggagctgccttcagacataccagaagagggcttcaaatcccatttactgatggttgtaagccaccatgtggttgctgagaattaaactcaggaccactggaaaaagttggtgctcttaaccactgagccatctctccagccctgagtttatttacacacacacacacacacacacacacacacacacacacacacacacacttattgaatataaactctctctctgttggatgtaaggttggtaaagatccttttccaatctgtaggctgccattttgtcctattgacagtgtcctttgccctacagaagcttttcagtttcatgaggtcccatttattagttgttgaacttagagcctgagccgttggtgttctgtttaggaaattgtttcctatacccactttctgttttatttgatttagtatatccagctttatgttgatgcctttgatccacttggttaagttttaatgcagggtgatagatatgggtctatttgcattcttctacctgcagtcatctagttagaccaacaccatttgttgaagatgctttcttttttccattatatcatattttccttcttcaaaaaccacctgtccataggtgtgtgggtttatttcagggtcttcacttctattccattggtcaacctgtctgactctgtaccagtgccatacagttttcattactattgctgtgtagtacagctgaggtcagggatggtgatacctctggaagttcttgtattgtacaggattgtttttgctatcctgggttttttgtttttccatatgaaattgagaattgttctttcaaggtctgtaaagagttgtgttagaattttggtggtattgcattgactctgtagattgatttatgttaatcctactggtccataagcatgggagatctttccatctctgatgtcttcctcaatttctttcttcagagactcgaagttcttgacatacaggtctttcacttgcttggttagagttaagccaagatattttatattattcgtggctattgtaaagggtcttgtttccctaatttctttctcatcctgtttatcatttgtataaaagagaactactgatttccttgagttaattttgtatccagccactttgcttaacatgcttaacagctgtaggagttctctggtagaacttattttgggtcacttgagtatactagcatgtcatctgcaaatagtgatactttgacttcttcctttccattttctattcccatgatctcctttagatgtcttattgctctggctagaacttcaagtactatattgaatagattgggagagagtgggcagtcttgtcttgtccctgattttagtggaattgtttttgtttttacatatagggacaacaaggtagtagtggaaatataggaggaagtgagaagaaatatgaagagactagcttggaagtcactggaagcacgctggcacacagataacagaattaagattgctatggaagagaagaggtgctacttcctcttggatgctctctctgcatcaaacacatcagtagtttccattctttggcttccaaagtagaattcacatcatgacacaggcacagtaaatcagcagtcaagttttatttctgcccctaagaaggcagaattgggaaacttcctccagagtggagaacactctgtcaatctatatagcagcctcaaagggctgcctcttgtgtctgaactaagaaattttggtctctcatttcctcttgtctcagccacccctggtatggtatgtgctggtatggtcttctaataggcaaaggttttctttgaatttgttctttcccacagttcattctgttagttgtattagatgttagagtatatgcaaagatgcaactactcaaagttgagaactttaccaggaggaagggcaacagtgccttgcacatgctcctcagggttcctttaggggagataggagccgaaggagactttgttctccctctaatcaggtcagcttgggtatcttatactccttggcaagctctcttatttatgaagtggtggttttggtttttttgttgttgtgtgttttttttttttttttttttttttccccgagatcaggtttctctgtgtagccctggctgtcctggaactcactttgtagaccaggctggcctcgaactcaaaaatccgcctgcctctgcctcccaagtgctgggattagtcggtgatagtttggatgcatataaaaggtgcaaagggggagagaggctcatgatttttttcgagttgtcacatacagtcagatacattcacacactaccaccacctcctccaccaccaccagcacctacacaggtttttatttatttatttttttcttaaatttttttaaagatttattttatgtatgtgagtgctctgtttgtttttgccactgcttgccagaagagggcatcagattccatcatcgatggttgtgaaccaccgtgtggttgccggaaattggacctctggaaaagcagtcagtgctcgtaacagctgagccatctctccagccccacagctttttaaaagatgagtggaagttatctcagggggtaccagaagcttccatcagtgggttttgttttgttttgtttgttttttattcacagtataacagtgttagttatggtagaaccctacctttctgtctggaccttttaggcaagaaagagaattgattgtgccttatctggtgttgtttttataattgcatggaggtagaacaattctgagtcacctagcttctcttcctggagttcatcttggcataggaacccaaacccacaccactgttaggtactgatcagggtttgccctaagatgcaccaagttggcccagcatgtacccaacccttctgttttcccatattctttcagtgcatctgcagaatggagttctgtgattctggccctttcttttctctgaaaaggagagatagatacaaggctccagaggtggagatggaaggttggatggtagcacctttctaacttgggaggtcagcttgtgtcgtctgtgtgtactctgccagcactaattataaggaatcagcgtgggctgctgatgtaaacctgggcgcagggaactggaggttgtgggaggatgagaagccaagctttaaccgcatcacagaatgcagagcctgcgagccacagctccctacatcagctcattgcaagtcaaattaagggaataatacaaacctagtagatatttaatgagagattatttctggagattataaggatacagaaattgcaaataaatccctgaccttttctgagccttggctcagtgaatgggctgaatcacctgctcaaggggattaaggacagccgcatccatctggcaggctactttctcagtcatttgcaaactctgctccatggtgatagtgttccagaccttttagtgggaattcactttgcagactagatcttaattactaagattatgaaccctgtcgggccaaagtcggaactaatgttctgcttatatatacagcagcggagtccctgtcagatcaatgacacttaggccaagttaaataatatgcagttgttaattattagtaactcagtcatgatgtcagccggaaattcaagttgatgagagtagaagtcaaactgcatgtgcatgtgttgatgtgtgtgtgagtgtgtgtgtgtgtgcacgtgcgcacacgcacatgtgtataagggaaagagactgaggacaaaaggcagatggaaaagttcaggatgtggcagtgtctcaattctggtttacagattccgaacatcagtgttaaactgtattttacgagttcttgggactcttgtttgatgtgggttccatttcttaacataattttatctgtttataaaactaggtagtcaactcaatgtacaagtctaataaactaggcttagcagagttatccccgaactcctgtttggctctgcagcatataaatgctgtgtagatttgacagttaagatacactgataaatagaacgtgtgtgtgtgtgtgtgtgtgtgtgtgtgtgtgtgtgaactgtaaggctttttagtttaatatcagtatgaagggtgtttgcttgcttttaacaaattagagaaattgcaccagcatagagaaaaccaatctgaatattcagtggggtctttgccattaaaaaaaattacagttaatataaaaatcggtagaatttgtttacctctcagctatctggaaagttcctttgcagttttcccttccatgtcccacttgcctaggaactgcccttatttcctagctgacctggtaggtcatccaagcaccgggactttctctctcagttgccaagttctttccaattttcccaaacttttgttggtgtttctggggtaaggaagtggtctctgtcccagacaaagttcgtctgtgctgggaaggaatccgtgttcacaagcctgctgcttaaaccatccaagttcagagtctgtctcaacagctcccagaattcagtgcacaatggcgggtctttcccccagacttctgaccaccatgcctttaaaagatactctgaaacacttctctaaaaacgaagtgaagggttccatggactccagagtgacagtcataaatgttttggaaagtttctcaagcacaagaagatagtttcctgtctgatacatactttcccagtagcttctgagcccttcatcgaagagggagaatcatccatgcgtgcgaaaggatgcccagtgtccttagtcacctgatacaaagcaaaagcactgcaggaaagctctgaccccacccagatggctgtaaggaaaagagacaataactgctatctgcaggatggctcaggtgctcaactgactcacctctgcaagctacatgtctagtatccgtggataactaaagcttggggtggagtttttatggatgtctggcctctttattgctacttagaaacttgtttacccctggaaaaaaattgttcctgtgggttatctcatttcccgagtggcagtggaaggtactggaacagatggcgaacccattgaccccactgatgtgctatggagagaggctctcctgcttctgggtctggtttaggtagctttgttctcagctgtttcaatgttcaaagctgggtcacttttctttccttcatttccccctcattttctgctttttctaatcagcagaacagaattatttttttaatttcaaagttatagttaaaagcagtttggtgaactggcccctggagcaagtctctacatgttaacttggcaactttgctcatatgtagcttattcaaggcacagttttttcatctgtgatgtggggctaataatactatcattcaagagaatttgctggcattacaagacataatctaggtaaagcacttatccattgttttcaaagcactttacatttgctttatgtaactgactacaagcagttactcctgtgactccaactggaaggagtctgatactctgtactgccaattcttgttagaaacttaatgcaaaagttactgtaagaacgaagataacacatgcagaacacttagcatgtatctgtcctacagtaggctctttgtcagtatcactatctctaaatcatctgtattttgcacacatgtatgctgtgaccacaccatgtagcttgctttcagcatgctggtttgcacacgcgtggcctgaccacacttctcttgttctttcagccgcacaattggacagtatcggcttcagcataataaggaaatgcatccatgcggtggagaccagaggtaaagtagcctaccagacagacagatggcattgttctcatggaaggtcatgggtctgtgaggcagagaacctgctacctgctgcttctgattttaagtaactcattaagtcccctggtgccactgtccatgtttctacaggtcatgttggtctgaagcaggggttctccacccgtttcatgtcacccaggtctctggctgatcacaaggatgtcttacatatatactgatagaattcctaggtttatggaaaccagttcttgaaacctggttattattagaataattgaaaatatagccgcagcagagtggtagatatgcttctatgttaacaacttcattcacagctgatagtggtagctctcatagcaggtataatctgggaagcacaacattgtaatcatcctgtaacagtgtaaggagttatgaaaatatctctggggctggtgagatggctcagtgggtaagagcacccgactgctcttccgaaggtccggagttcaaatcccagcaaccacatggtggctcacaaccatctgtaacaagatctgactccctcttctggcgtgtctgcagacaactacagtgtacttacatataataaataaataaatctttaaaaaaaaaaaaaaaaaaaagaaagaaaatatctctgatttttgaccatgctgcaggtattgctaataccactgtggtttaaggagggagagaaacacaacaatgttagtaacagtgaaaataaaggctcttttcccatctagttcatagaccccggagatctctccagggatcatcttagagtctgtcaaccccagtaaagacctctgctctgcagacctggacctgagaaccatcaaggacagagaaggaaggggttagctgcctcctccacactgaggtttcccgcatctattggagcaggccatgagataggggaggctgggttactgtcacaaaccagagtctttattgctggctttgtagggttctaagtaccctggatctgttgtggctttgagaaaagctactctctctccacggagattgatcaaaaccaagggactgagtctatttattctccagtgatctaactacttgtactttttatttgtttgagagaaattctgacttttaaagcagataacctactagtggtaaaacagaaagggaaaggggcatacacacacacacacacacacacacacacacacagaggctggctgggggtaatagaacatcttgaggtcctgtgcctatggatcctataaggcttcttccaaaggagatactttactgtatagaagcaggtttgtatatgtttctgtttgtttagttttccttccttgatttcctccatcaaaaaatgaagacaggttctcaacaactgtacataaaatatacccagaaagggcctgtcttgaaaaaccaaaaaaaaaaaagtccacaggggatttggagaggaagcttagcagttcctgagaggtatgagatgtgatggacgtggaccaacatgaagaaaaccatttctaatcactcggtcttaattgttccctgttggagttgagcatgaggtcttggtccaaatgctgggcatggtggcacacacttgtgatctcagtactggagaagcagaaacacgatccgtgggctcactggccacccagtgaaaccatattgatgaaccctagaccaaggagagaccctgtgtcagaggaggtagatggcattctgacgaatagagattgtgctctagccaccacatgcatgtacacacatgtgggcccacacgtgtgaacaggcatagatcacatacattcacatatcacatacatgcatccggattgcctccttttgtaagaggcacagtgacgctctaatccgcgcttttcagtaaatggaagttctgtagtttgacttctttgtgtaagtagttcacagtaaacacctttgctctcactgtgatggattttctgatttctcagtcttgacaaacatttcctaagatggaaaaggtccttccccttcaggattttttatgctgtgtgtaaaaatagatggaaagtgatttatcttctcctgtgattgatttttttaagagtcatgccactttggatttttgaatgtaagagttggttaaatactacatctttaaaataatgtattttgcatctttaaaaatcttcatctgctgcctttggcaagagaggagggaaagtttctttcctgccagcgacccggctaaggcgagggctggagtgtggggcacatccgtgaatccctgggcagcagtgccaaatcccactcgtttgctaagagctgagttgagtggcagggaactttaattacagcagcttttaggaggagagagaaaatgaagggaaaacagaagagcatttggcctggttggcctgattgtgttctgatgctcatctaattaaaccatcctctttcctcttctcagggatcaatgagcaggggctctaccgaatcgtgggggtcaactccagggtgcagaagttgctgagcgtcctgatgggtgagttccgcagtggctttgtcaggcatgtcccttgggtagcttcctctgtgccttcctggtttctaggtggtctctgggttagaaattaaggtatggggatgcccatgcccagcaacctgccctgctagctagttgtggctataggcaggaacaggagaggctaggagtgggcctttgtaacattgaaatgaaatggcgggaccaagcatctcacagtcttcaaactcagcactccagtccaagtgctgcttgcccactcaaatcacagccacgccctgctctgttgttagtagctcatgacactgtcttcttctgaggcaggtattcagtaggacatacctcatgccccaaaaagggcgtctttctagcctgtgaggacctcagggtctcacattcctgatccctagagtatcatgtaacgttcagataaaatgtatatatgcagatcaaactcaagatccctcttgcttctggatttcaagccgtcacttgatcaggagagcctcctctgtctcccggctgatgtataaatagaaagccactgcctccaaatgtgcagtgtttgaatcaaaatccatgagccaaagttgcctaggctgcagatatcctgtatttttagccatgcagccagcttcagtgagtcacatggatctaaatggcaaacagatcaagtttcatagatcagtggctgttgtccatgtccacaaaagccgtagcctggtacttgggaagattaactctcagtccggctctaacgtggcgtttcaggcgagggcctctctcctgtgtttgtcacttctttgtcactccagtttctgaaaatagcttttgcatgtgcagaagtctattcctttatatgggccagaatgtgctactcactctgcagttcggactcctcggtgtcgtgagttacactcagagccgctgttgggaggcatggtgcacgggaggctcagtctacactcacttcccgctcttcagttccaatgcgggatgcagttttattatttttaaatttttgaaataattgtgagagacaaatgcattgtaccctttactccgattcctccaattaatccttcttaacaggatgtgtttcaataccacaagaagatactggtattaatacagcccaaatgagagagtttcaactctcataatggccttgggttcctttttatgtctactccctgccttacctcctcacacacaatccctaaccctggtgaccaggagtttattctttttttttcttttaattttgtcactttgaaatcatttgttatataaatggaataatacattgtgtaagatttgagtgttgagtatctttttttagtgcacttaattatttctagatttgattaacttgtatgtatcattgctcattaatttctttttacctgctaagaagtattctattatatgggcataccacagtttagccattcacctgctacaggattttgggttatttccattttcaggctatagatatttagagagaatttttatatgagcatatttttattctcatagaataagtacccaagggttctattgttgggccatatgttaatgtgacttaattttgagaaattttaacataagaaagaagtaagaacttagcagatgtcagccttcagtctttcatttctgcttaggatctggaatggattgctagatgatagtgatattaaattttagaaagagctctctcgccattctgcagaatcctggtaggggtgagatatgcatgcaccttaaagctgttatcttaatgtgttgttagcacttaatatgacctgaatctggggctggaatagcaaaggagaaagaagaagtcagattgagcaagtatgagcagtagcatgggcagaggcaggtgcaggttaaaggcagaggctgttgatgctgtgggccttttctttaatatctaagagagcggcttgaggctggaagaggacagttagtactgagaggctaaggtggccttttctgctgacaaacccaagcactgtgctaaaaagcttaggagcccttttttcttcacaaaggaaataatgcactcttaaaagttctaagtggtagagatagtcaggaataggatttagactagttcacacagtaaaaggcacttgcttatgtggctggttcatcctaagaaacagctgcatgcagggtctagagactctctgccatccttactctgagccctttcccttcccttcttccttctagtttcccatcatccgtgtcctttgctgtcctcagctttggctttgttctctctgggagtgtcccagatagatcagtctctgcagtctttggagcttgcatcactcagaagagtgtcttttgggtgacagttttggcagtaggccacagggaggactttgattggccagtgtgggccagtcacatgatgaacttttcaatttggagccaatcacattatcctcaacagatggatgcgtgtggcctggagctcatgcctgtgactgggcctgagagtaggaataagtttatggatggagcaggattattgataagaaaagggaggaatactttcccgaagtaatgaatgttgtgctaatgaagtgtgcccagcacagcagtagcaagattagattcaagcattaggggagcagagtaacagaatgtggcacacgtatgtggtcaagggtgggtcctggaagaaggcaaaaggtgagtcagagaatacctcatgtagggctagaccaaagggctgtggcttagtagccagtattttgtgtagagagagcaccaagatgaagcttccaatagaattcaaagatgacaatgtgaagctattgaaaagaaatgcagaaaagactaagtgtctgaggcgctccacttcggacaaacgagatgttctgaaaggcagcggttctaataactgttctccgtagcctcccaagaaggaactgcacttgctctcttccttagtcaccctagatagagaggaaagtagtcacgactgtctgaagaatgtcatgaaagagtaacagctagcggctgacagtcacaaggccagctcctctgccaggagggcattccagatagactggaatataaatgatcctctggggtagagctgactacagtgtaaggtcgaacctaatgccaagaattcgacctgtgagtctctcaatcagtcaagggactctagtactctcgaagttgtcaggccagtgcactaggtctgcctcccttccctcttctgagtatgttgttatagcatccttgtcaatccttggtaccactgctgttctggcctagccaatggtgtagaatataatctgctgtagaccacaaaccctccagggtgcagagtgaagcccatactcactcccatctgtcctcacccttttcgtaccgagctacgtgcagattcaacattgctttcacttgttccagtgcgctcctaactggatttgtgtgctctgctattgtgtgcaaacatggcctgggattaaaatcagatgctaacttcaatcactcgttcatttcttgtattcttgcttcactgcggactgtaggagggatgggggatgagagccaatgtgttgagaatatctttgttttactgatcagagttccttaagaaaacttattagaattcctcatagcctctgcagggtcccttgcacttcatactggtgtcctgccaagaaccaccctgtttacttcctagcaacagaggttaatagtctttgagtagtaaaaaagactcagaaagactttcagactttctgaaacagaatatatgtactatcccggccccccatactattaagtgaagataaatgtttacaaatttttttccaaacaccacatatacaaacattctcacattctccccttatacataccccagctacattcttacttgttacatgtctgtttctcttctttccatatctgtatattttttaaatgaagctacattgtgtgtatgtgcatgcgcgtgtgcacacatgcatgtatatgtgtatagggaggaaaggggacaacatgtgggtttgcgttttcttctgttctgtttgtccaggtaggaactcaggttgtcaggctgagaggcaagtacaatatactgagtcatcttgctgacctctatccccttctaattattttaagtaatttcccttctttgtttaaaaattatgagtaatcattggtgaaatttcacaaaaacacaaaaatcataaagaagaaaataagagtcccttagagcaaagacaacctttattgactgctttattgtatatgaaaccttcgaattgtagccccctttaaaccatatatactagcatgtagtaagtgaataagcatagcgttctgtgtaatatggctacaacacagggcacgcacactctaggctttccaacaggctgtattcacataacactgcagcgtcttttcccatggtaagtcctcctgtggcattgttcttgcaggtatattccttgtagatgcattagtgcccctgaatcagcttcctgcccttgtgtagttcagatgggagtcctgagaggcaaaggagcagaggactgcgtgcgctttggaagtagacacactgctgattcttttcactgtagacaaatggtttcaatggttcattctcccgtctcctgctccatctaatagcctggcccacatagaggcgggagcatgagatgagaagattcatgaagttgctgagtcagagcctgcacatgctaagaaatgctcgtaggtcccatgtccttgcagtttgacttacaatattgagttgctgggttaggctctgtgtctgccttcagcctctccacccactgttgccacactcactgtcagcaagccgaaacagccgtgctctgtggtacttgttttatgtgaatggtacatgtgaaagatgtattttcctcttagttagccttgcattctttggttttggattaagttggatattttggatattttgaacatgtccattgttgctgatagaagtagggtcttttcttctttttttctttctttttttctgcctgattttattcttagcattatttttctgttttaattgtttgatggaagttttacactcggaagctgtattagcaccgtttgcatctaagctttcacgtcctaagcttttggtttccctttttctttttgtcccattgtaaatttatatgaagccaatctctcattccttattcttgatgagaattatatgttaagagaccctctcctcattccaagatgataaaaacgttttgcctttcttaaagcccatctgtggcctggcattacagctcagcaaataaaggtattcgcggccaagtctgaagacctgaaattgatcccctgagcatgcatggtgggaagaaaggatcagctcccacaaggtgtcttctgaactctatacatgttcaacaacacgtgcgtgcacacacacacacacacacacacttcccaaaagaaatgactgaatttatgagtgaatgtaaaccaggtttaaagtcctttggattatattcacacaaagtgtaaactctcctttccctcagaaatgtatactgttgactgatacctgcagcaagagaagccttcccactctcaactactttaaaaatcacctctgaacactttcagcagtgactgggtccttgagggagcttttagaggtggattttctaaagaacaaatcccgtttcactttgttgttctgtaaacctgacatgagtcctttccttgggttttttctgttcctcttattcttggtgtcctcagaaagttatcaggcttgcccctggagtccaggtcactcacctaggctttggttaactcctgttgtagccttgtcatgagcagcgtagtttgaatcttcaggatctctaatggcgcactgggcttcggtttgccctgccagccgtcgccttttctctcacattcatcctctcgctccggcagctcgtttcgtggtgcccaccctttctttaatgaattccttttacattgcggagtaaatgctttcagggcttggctctctgtattctgtaccaacagactcgcatgggcttccacaggaagcttaagtctctttgctgctgacttcactctgaatagattctccttggtctgcatcacttccccgaatcccgtttcagagttgctctcttctatggcgttgcagggctgttgtacgcgatgccagccaaatcctagtcagtcataaatcttgtatcttgtatggctctgtaggcctgaataattcctcctggccccactctgcctaagatcttggaagaactggagtatgtaactgtgaacccaaagcctgcggttcgtttcttgtttctttgctgattctttgaagattacctcctgcctctttttttgtgtttgttctgttttgtttttgggtctctcatgtagctaggttgatatcagacacatgcacttgtacacacacacacacagagagagagagagagagagagagagagggagggagggagggagggagggagggagggagggagnnnnnnnnnnnnnnnnnnnngtatatagtttgccaagctaaagatgaccttgaagccctgatcccttggccacctctggaatgttgggattagaggtatcactaccacatctgctgattttccccttcggaattcactcctcatgctataaaattgttcttgcatcactgctgcccagccctacctcagtgtctaggttctcttctcagggctgtgataggcctatggaaagcagcctcccttccagctgtgcagggaaggaatagggcctgacttttctcctaggatggcatgctatgctggaggccggcacctaccacatggtgctctcaaaggcgttctctgggccttctctgacccccagctctggcaacattaactaaaaggcttctttgctgtgctgttgaagcctcatgtccctttcttctgtgtgtttttattaatgtttaactatgatagcaaagaaatgcaagttcagcattgccggtggttttctcctcccatgctgtccaggtccctctaagttagaattacagtgagcacaaaggaggtggtaaagggcgttgctttaagtcaccagatcacagacactattcttcccctcctgtctccagccatgagttagcctaccctgtccctctggaaccttgaaggtctgcattcctttcctctgcaccctcatttcccacacactttcacgcagtgtcctacataaaagcaatcaaggacttctttatgaagagtaccacaaggaccaggcgattcttcacgatgccttctgggacctgaagcttacaccataacgagtggaaacaacccagaccgaagactgtgagccaggcagagggtggtgtgccatgatcctgagttcccagagaagggagatcacagatggagggttccctccccctccccctgctctggcacctgtcaccaccctgcctataaggacactgcaagaaccagtaagaaccccagacagtcagagctttccagtcccaaaacacaagtggttgtgggtgttttggattcttagacgtgacatataggaaattgctaggttttttaagttttgtgacttttatagtcagaaaagagagtaagcaactttgcttctcaagttgccagatattaaatctagcctcaggggaatgacctgtggggtaaatgacgtcggatacacaaggagggagttgtacaggtagcaactgttttcctttaagttgttatggagatggagaccatgacacgctcaggaagagttgatacttcacagtttatagccgacaaagcaggaggcacgtctagcgtaaggcggggtggtattttggaagggcagatgtctatcagtgcaacaggcacaaggtcccagaaacagaaccagtacacgcttggatcttggatgaaggagtctggataactgaatggagaatggagtcttttaagcaagtactgtggtacaatttagcatccatatgaggaaggatgaaatgggctctcttctgactccctatgtgaaaagtatcttgaaatgtatcctaagagcagacactgtagaccctctgaatggcaagcacagaagaagtatctctgggaccttgtttttaaagagctttcttaactagagcacaagaaagaactattaggagagtatgttaagttgagctgcctttaaataaaattttctgtctaaaaaaggtattactcatggtggacctactggtacagcctcttaaccccagctatttggaaggctgaaggaggaaaatgacaaattcaaggctagcttgggctacttggtatgactgtgttttaagattacaaaaatacaagaaagacaggagatgtaactcagtggtatacatttgcctgacatgcatgagggctgaaagtcaatccatggtactgtagaggaaaaaaaaatcttttttcaaaaagcaaaggtaagttatagatctgaagaaactatttatacaaatgtatttatcatcagtgatttgtagctatacttactttaaaactcttgattcttaagacaataccccagtttttaaaatagacaaaaaatattgagaagaatggttgattaaagcaaataaacaaagaaaaaaaaaccacatgtgaagatggctcataccattgtgtgtgtgaaaggacagtgacttgtaggacagctaaagttgaagtgactgactgatatgtcctgtgatgagaggcccgaggtggcccttactctcatattctgttggtgggaatgcaaatggccctgagatttttggaaggcaattgaccatttcatctcaaggaaaacattctcattattggtctgttcttgtagcttttgacctagcctgcttgtggatgcagcatttaccaaagagataaaaatgtagcctgtggaaagcctctgcgcaaatgtttgcagtagatttagtcatagcagctacaactggaaagctcccagatgtccatcatccaaagaatggataaacaaattatggcacacccagaactctgaatacggctccacaataaaaggattaaactactgtacttgtaacaattggctagatttcagaagtgcgatgctatgggcagctgttgccagaggtgcctgtggtggaagagggccgagtgacagagtatccagagttctggggtgtgggagcacctggctcgtggtgggagctccttgaatgtttacaccattcagaaagtgtgggactgtacaggtgctgaggagtaaagggtacctcagggataatcactcaacacttacattcggaagaaggctctgcatttgttctccctgtcaaaaatgaaaattaaaacattggcataacctacacaacaagcaaaccaacaaacctctttgactggagaggctcatagtctgagtgcatgctgtttcaagggtgtgagaattactcactcagccttaaacctctgagagcagctttagtagtattttcagaaacttaaaactcacagatttttgatacagaaagtccactttcaggaattatttctgcaaggaagctctgcaaagaaacatcgagtttatgtccgtgtctatcagtagtaacaagggtacagctaaaattttctttacaagaggacatgaagtcaagaatgatgcagtgtatatgtaaagtgaagtactcagaagtccatatattcgtgtgtagatgtgggatagtttttatagggaattgtcaaatgaaggctctatgaaaatggcttgtgttgtgtgcttccacttctgttttgtgatactgaggatccaacccaggaccatttgttttctaaaatgtgtgtgtgtgtgtgtactagaatatatgtatacacacatacacatatacatattttagtgatattagaagttgtctatatggtaaaaaagatttactgttcactgtatacatgttttcagtttcttctcttttgttggtgtgtgtgcatgtgtgtgtctgtcttcaagctgtgagtgtctgtgtgtgtgtgtatgagtgtgtgtatgccttgtatgggtgtgggtagaccagaagctggtgcttggtgtctacctctatcacttcacaccttatttttgaggcagggtctctctactgagcttgcagctcataatagtccgccttttcagcaaactctaaggatcctctcgtccctgcttccccagtagactatagataggctcacaccttcatgcctagctttatatgcaggtgctggagatacgaactcaagtctttatgctcacatttcaagcaccctaaccattaatccacctcctagtccttcattgattttttttttaaattaagtgtataaatgaacctagcccaaccagaaaatgtttaactgacacaatggtacagtgggtcatttttggaaaaatataagcttgggtagtgactttgagcttcttttacttttggagtaccaggtggtgctcagaaactagatgacctaagtcagcttcctgttaggatcacagcttcctttggctcggtgtgccctgattctctggattcctgtggtggctggtgggagagagtccctattcagtgcttgtcactcacatgccctcttcaacactgcgctactctctcagtgcatgtttatctcactaagttctgcagtggtcgggggcagggtggggaggaaggtccgggtcctatggacatgcccagatgccaccaggacatctccttaagcaagggacaggagggaggnnnnnnnnnnnnnnnnnnnngaaggaaggaaggaaggaaggaaggaaggaaggaaggaaggaaggatagaaacaggccagtctttatggaactggggtaacttgggtggttgtattcaatttagttcggacattaaacgaattaaaatggacacgttcaagttatgagccttgcctcatcagcgctataaaaagccttccagccggactgtaatttgactctcctccctgtaatgttatgcaatattcctatggttacagagcccaaaaaaagtggaagctaatgattagtttgctaaatgcggttcatggaacagttcacaactcccagacctgccaacggccgctgatgtccttgcatgttcccctttctgggatggaagttggatcgttcctcagaaaaatgtacagtaatgcttgtcttgaatccagaaaccaaggagggcagcagtgctcatgagccttgggaacagagtgggggaaggtcacagcgcctggatgcctcgggcttcagcagtttgtgtccgtgtctatctgcaggacgaaaacaggaagcctcagatgacagagaaggaaaagaattaatgtctcagaggctggggcactaagaaaacaacatttttaaacctttaaggacatttgccataagagaactgggtgggatttactattctatgaatatgcttcttccttgtttgtttttttgcgtcaagaaagtcatatcgcccttggtcacctgtgaacaatgcacaagcatcctgcctttatgagctacaaagtttgtgagctaaagcccatctctgcttcatctgtaaatatatgtcaatggaagagcctgagcaggaggggccagctgcaattgtgtgttctttcttaagaattataggttaaatccttaagccattcacaagtgtttgacctcatctcactagcatgaacgtgggttctttctcatcagacagaacagtatgcctggtgactcatctcctttcccagtggagatgcacttagccctgtaggcagaaacccttgcttggctttcagtcttcggaactattgagaaagagctagtccggtttcagtctctatttacctgacatgtcatttaaatatcaaactggaaaaccagatctaagtcaccatgtatcttttcttactctttcaaaaggtggggaatatgaactagggacaaccaaataaaggcacatcacttctctgtagtccttgccactggttcagatccgagccagtccagccactatgaacttaaggatttttccaagagatgagaggtatggggctggctcgtttgactaaaaaggcatgcctaggttcacgtgcagagcctgtcataaagaaccactctctctttcttttctggctttgttttggaggctttctgtgaggttcttaatggtagcacttggcacttacataaccttctcgaatcaagcacaccaaatgacaccttgtctccaaaaaagtcatgagcttggtgacaacttgagtaaggccagtcctgaaccatccctgagttggttcatggtaccctgagttgtgcctttgagttgtgtgtcctgacttcacttcccaactgtagatggaataataagagagggagtcccagtgaagaatgaggtgctgtgcagagcaggaagggaatgtgagctgggctggctgggcacagctccgtctcaaggctgcttgtgcaagggtggactttgcctccacacacctaaaggctctactatctccatgtcctgtttgtatgtggcctggcctatcttgcccatgacagtggtccctgatggcccatgaggctgttcatcttgcggttctctgccttttattctcaggggtctgcgagctgctctgaacagctatgtgaattttctctgtcagtaatgagtttacttaaaattcatttgcctaaagttacatgcaagaagaggccgaagaagaagttatccggagccagtgggattatggtggtactcattgtacttaagtcaactgagaaaaaaatactataaaaatgatggaatcaaaccatacacaattcagaaaatacaaaaaccatagttcttaccactttaatacaatcattattataatttgaaactgtttgctatcagctattttttatgtctcaaaaatgtttgaattttgttttttttttacttaccattataaaatacaagcaatttccacgtcataagtcatcagtatgaatgtaatgttaagtttataaaatggccatgtaatattccatcagggaggtataccgtaattcacttagccactctcctctgattaaacatgtaggctgcctcttgctttccttttccccactgaagagtgtgtgttgtacatgcctggtctgcaccttgatgcatgctttgttttattctctcaggcaaaatggtgagaagtggaattgctagttagcaggatccaagtgtttccggactcttgatggtccatattgtcaaattccctttcaatctgtcgcgttgatatcagctgcctctcggaatttataagccgagtgccttttccctattcttctaacaacagatatttgcatgtttaaatgtttctcttatgcaataggcaaaataaatatcttattttttaacttgaatatttcacttttctagttagtgatgaggttgagtgcttactatcatatttttcaggcttggttttgttcattgccttttctccattttagaccccaaagcagcttctgagacagaaactgatatctgtgccgaatgggagataaagaccgtcaccagtgctctgaagacctacctgaggtagggatttccacttgtaagcagcaagccatctagctagcacgtggtcaggaagaaagcagtcttatttgcagcctccagagatctgctgggcgggtggttgagatgtggaaactgcctctgtgtgggagcattaagttcagtgggtcaggccgatcgtaaatcggccagggttgatgggctgtcactatgctatggtgccatgagtgatttagaaagccctgctcttcatgagatgtattaagatgactagccttagtcataccctaaacggtggccttccctgaatgatctcttataaaaacaagaactgatacatcactggattgagcagacttgatcatttacccagtttattacaacggtttggagctttacacacacacacacacacacacacacacacacacacacacacacaaatattgcttatattggttcttaaaaatgagagggtagatgtggaaaaattgctatttgaaaactgctatttgggggaggagaaaggaaataattaccttgtactattatatacagtatcattggtcccctctgtccctcacttggactgttggctttctgcttaccactacccccaccacacccacacagacacacagacacacacgagaccctgaaacctacacttagtaggaacactgtaattctgtgttgtggttacagggaggagaagtctcacacagaggagaagtggaatcacatggactgagcctctatacagccttaatgaggcctgggtagcacaggagctcacagaaaggagttggtagtgcaaactttatttgggacattgtaacaagtgaggtgcagtgcaaggggtggctaagagttgagctagggaagctagggtagctgatagaatgaaattgaagcacaaatgatgaagagtctgcttgattcttacctggagtatcagaaaaagctcatttgtagtttgtcaggttcacactccactggtacaatgtcctatagcccactgatacttggaagtaataaccttcttggaagcaaattgccaataaacatcttttatggagtttctagaagctctgatttcaacaacaagcttctagagagatgagggctaaaggcagctaatgcagatatgcatacttgtttctcaacatgtcccaaagcgctcttgttcatggatgactaacagagtgaaaggaggtctgtgggtttggcccgcacttctgcattagctctcgatgcccattagctcttggtgccctgtgactgatgtgtatgtagctagagctatccacttcaaaaagagaggagggcagagccttgcacacgccagtaaccccagcccctgtgaggcggaagacagtgagttccagtttagccttgggcacataacaagatgtggtggtgaggaatctctgaaactgagggtctcaggtgcagtgccgtgtgcctccagtcctgctgctacacccagctgctgttgtgtctctgcgtcctgagtatttgaaaggtgccatgctgttttgcagtattcagggtactgcttagcaagagagatcatcgcactgtggaactgacgtgtctatacatttttattctagaatgctcccaggacccctcatgatgtaccagtttcaaagaagtttcatcaaagcagcaagtaagcatcttttagctgaagtttcaaggagaaaagaatagattcttctatttcgaggaatactcagaatcccaatataaacactgctagcctcatgcgaagtgtctgcctaccaagcttatgagaccctgtcacagactaaacgatgaaatggactcaagactgccaagggccttactaacactaccgtgttagaaagagaagagaaaaacttaagagccagttttcttggctagaagggaggggaggagaaggaaaaagagatgagacagaaaagcaattttgcctttctagttttgacaattggtttttcttcccatccttaaagtaacattctgcaaaatgaattggacattggacatctcctaaattgagcagtggaagtgtttccttgagcttggcaccctttatgtgacttcacaatcctttttccaccatgtcttccatcgaaaggcttctgatcatcccttggctatatcatctaggttcttagttcatattactgttattgaagtacatagggattaggttcaagctaccctaagtatattggaatctgtctacgtggggcagaccagcagtaatgtggcagttagattctctatcagatttaaacctggcaggaccgctcttggtattgcgatgcccatagcttgtgcctctccttggatacttttagcctttagggtttgtttaccctggtaactcctactggcctagttttatagtacctaatgttccgctagccttatgcttgatcttgtcctcaccagcaaggaatagaaaggcatgggagaaagctaggaatgaagatggtgtgtatgtgagttctttctcaagagaaattccaagcccatgtcaaccattctctaattaaacttcacatcagttctataaatagatatggtgagtattagcaatttatttcccagagaaaacaaagccacttccccaatttgaatcaaaaggtagcaggctatagagtgacagaaagatttaaatgttctgtctgccactgcattcttcatactccgaaggtgtgttacacatattgtggtgtgtgtgtttgtgtgtgtttgtgtgcgtgcgcgcatctggatgcatcattttgaaacacgagaccttggtgatgttcacataagatctgtttaccacttcacaagtgcataaagttccttctttccttgaaatgaagttggccctcgagggagccagctgctcccgtgtttgttccttccctgggtgtgcagttgaccagctccgtttcatcacagtcattagttggatgaactctgatacagagagcacactgaaaggcctttagagcctgccacactggtcctgggcacgcacgcaagacagggtggtaaatcctcaagaacatctcccctgtgttagtgccaggcctttagttcccctggtcttgtccagtaacttagctgtgactccaatacaacattaccccttttcttcccagagctggaaaaccaagagactcgagtgtctgagatccacagtcttgtccatcggctcccggagaagaatcggcagatgttgcagctgctcatgaaccacctggccaagtaggttcctcccccactattgctctttccttacccaggagagttctggcctccgcaggaagtcactgcatgtctctcccactgttacagcaggtaggctggaggcccaggaaagaagtatgtgcagtggtagctgtagagaacacatttagtgccaggtctcccttgccaaggagcccgcagagggccacagcgcagctcaccagagcttgcagggggactctccaatccagagtatgtcagccattattcctggttaccgtgaagttttcagggttcatatgttctttggatgtctgaggaaaagcaatatgttgtgtggttacagaacttggatttggagcaagagtgccctgattacagaggtgtctgttttaaaccacagtcaaaacacgggtttacccacttcttcagttccacattcatcaagtgtggataatagactgtcttcatctataaggccattgattctcaaacttaccttattagagaacaggggacttatttctggcaaatgtcctcctgccctgcaacatcaccaaagtgttgagtagcccagtttttgtgctagaagttttaacagcgttgcgacacttttgaattttagtgtttattgttgcctcacctgcttctgaataatcttgttgagttggtttgtgttagtcattatttgtatgctatattctgacctttcttttttcttcttttggtttttcgaaacagggtttctctgtatagccctgactatcctggaattcactctgtagaccaggctggcctcgaactcagaaatccgcctgcctctgcctcccaagtgctgggactaaaggcatgcgccatcacgcccggcttgttctgacctttcttaaatggaatattctttattatagaaagatggtggtggcatggtgtcaatatgtcgagtttactcaactcattaagtcccatactttctgaaccgacgtgctgcaaatccgctcttagccagtggtttgcttgtgccattaagccagaccttttgggtaagccgatgcacatttatagatgattgttatggttagttttccttcatctgttaagcacttggtattaccttccattgtgggcacacatatatataccataaaggtttacaaggctgttaaaaagaaccaagaatgttttgtgcattggtgaggaacaagtgaacagaatcaaggacttgtccattattgatcacttttgtgtgtgtgtgtgtgtgtgtgtgtgtgtgtgtgtgtgtgtgtgtgtgtgtgatgccatatctggactgcatattcagaagtatttaggaagcatggtccaggacatgcaagtttgcggggagaatgcctccagaatgtcaaaagaacactgtgatgtttgcttacagtaatgggagcacaggctcagaaagcagctcctgatgttctcagacgaacttggtgcttgctccatacaacccagagttgagcatttgctaacctagaaagttggtttctgtcattacaaacagaactctgcatacttgaggtagacatggaaatacgaggttccaggcgcactctctgctaagggtgtgaggggtgcttgtgactctgcatcttcaagtggccgtgaagcctgctgagagcaggtaggggagagaagggctggacactagctgaaggctgctgcttttcattgcaatcagttcacaatgagcttagttggaaagaaaaaagttagtggtgatccatcagaaccaaaattgaaaattttccatttataaattgccccaagaattaatattccttaaagaagaaaacaactaaagcaataaaacagaacagtctatattcttaatacaactagagactatgcaagttgtgcctgtggtgttgacttcgtgccttgttttccctgacccctgcctgggggttatttattccatgtctggaaccttttgtgtcacgtggtgatgatttccttggccttctgacattattaccttgttcctttaagcatcaagatgtctaccagtcacccagctcctgcaccttactgtgggttagaactgctgaggtaaagcagtgccctcggtccacagagcttgcttccagatgtaaactggccctgagttttcgttagtgctcaggggagttctcagaccatatttgagctgtgctctgcttacactaccggccttattttagagcccagctgtaagggaaactgaacttggggcaggagctttgtttaattccactgttctcaggttcagacttagcctagggctggcctgggccattgttccctctccactctcttaacgatcagcttccttcctaagttttggtttcagggtctgactgctggaaagcccagtgtttacttctcttcttacctattccctgcctggagatctcagcctgtggttcaaactcggacaatatgtgttatagctgtttattttatattttataaagttttatattcatataaaatttctaggaattttatatttaatatcaagaaaaaatacatttggggaattggcagaggtttttaaggaaaagctaaaactcctgacctctaaagcaaaattattactaagatgtatccaagtcagggaagaggttgggtctattccagacctcagggggaacatcaaaattacagacagcatgtttgtgttgatccatcttaaatctactatgataattagatgttttctacctgtgccttgggatccagtgtgcagtctggagtcacttgcctgcatgtgtacttggaagcactgcagatgcttgttcatgctggcactgctgggccatactgagacccttctagtagcctctacatttctgggttgttttccagatagctaaggcacaaacagacctttgagacccactggcctgcaagggaggccatacagaaagagttctgaggaaagggagatggtattgaaaggaatatgagttggaattttggagtacattaatgatgaagaatcaaattgactcttcaaatataaaaggtgccattgttgtcaataaatcggtcttttaaaaaatcttaacttgattatccagatatggtattaaattgatctctaagcacatggacttattttaaaatagtactcaaaacattttcactatgaaggaagtcatgtcccgctagctttggatctctgcagttctccttccttaagtgtctcagttttctgatttgtgtgtgtgtgtgtgtgtgtgtgagagagagagagagagagagagagagagagagagagagagagagagagagagattttctgtgttttcaccaggtaggcgtgggagcaggtatggctctaaacagaaacaagaaagaaaattcctgatcttataatgttataattgtggaataaaaaaaaaaaacagtggatgagtaataagcacagacttcatggtagtttcctaatgtttacatatttgatgactccaagtatgttggcgatccccacacttatcattcaccgtggctcatccttaactttattacagtgtctgtgctctgtaggaggatttcaaagcattctctatatatcaggggccactatttaaaaaaccctttcagggctggttttcccaaaacacttcctaagaaataaatcttactctttcatttttgatacagttccactagtgtggttgtgcctacagatcttgttacaagaagctcttgtgtttaggatgttttaagattcaattaagagaacacctaattcaaaatggcttaataaaaaggggtctattatgtccttacaaagactcgatcctgagagctggttaatttgtggtttctgaaagatccaggtcatttccggctcagccagcctcctcttgaggtcatgagaggttatattgtatccgtgcacatcagtgctccgcagaggcagaagaaagtgtttcttcttgagcctctttaggagttataatgatgatccccaagatctccacagacttgaccacacattcctcggcccccttggtccaaagcaacatgagtaggttacaacagacaggatttagcagttgctaagggaagcacagtctctagaatgaaaacagaacaggagttttctgtaggcagccgcatgtaggcagctcgtcatgtctgctccaaggagccttagtgaaataacagtgagcagatgttaggttcactagagatcttcctgtggtgtgatgactcatcgggacacgtgggaccaaatggccaatttctgtggttttggctcatgtataccaaattatgagatttgggggtaaaagactaagaaagaagggaaatacagctctgtgcttatgtccctcccccaatccctggttattttcagtcccattattatctgatgtttattttttgatcatctgtcatgttgtaactttctaaaagggcaacagtctaacaattacagggataatgaaagaaaaatgtggggcattttctttttggcagacatttctaaggatcctatgactgaagcctgagaacttgcatcctccaaaccaagaagggaatatccaagtttcttttaggatctagaagcagtgggttgagttcacatagaaatatcattgttacaagccaaggtaggccttggctccaaaaagggtagcacttaatggttaaatagcattcaatgatattctttaagggtcagaaataaaggagaggagtactattacacaacactggtacctatctcccatagaactctcctgtgctctctccatctctcccaggcttcaaagataaaattcagaatgagctgttaactacatgggaattgctaatgttttctttgccaccgatggtactctgaaacaaacagctgtgagaatttgcactcatattcactgcacttaatgtttctgatgcagtgctgctggagacggatgctcctgtggtttctcaggctgctgtccatcagccatgtcccccacctcccaaacctatgttctctctagtagctgttagacactctactgctgccatttgtaggattgcatggctgctgggctactgctggttgtggcttgatatcccgaagagccatattatggcatctagtcccaagctgacctcacacttgccatcctcctgcctcagcctcaaaagggctagcatataagcatgtgtcacctggcccagctagttctgattgaaccactttatatttaaatccacataattctttctattttcatcactaactccccaaactgcctgtcttttccaggcttcttacaaagccccttccctgatttgtactggctggttcccttctagtctacagagtacatagcccctgtaggtagagaacttaaaacactttctgttccagcatatgattcatctgcataaaatacaaaatgataaaaacaccaaaagcagtttctccattgtcattataataaaacccactatatcatcttcatcccctttggactttgccaccctgtctgtgtttcttctaatcaccgttgcctctatattatggactgcactgtagacagcactgtggggtaacagttgcactgaagcatgtgtagcctgttggtcatttctcaaacatcttccctattccatctttcccctttggcagtcatttcctcgcttctggaatagctgcttcatagcctctgcctgctcgaagctacctcattcagctttggcagagatcacattctccaatctacaagattccatcctgcctcaggctcctctcactttcctgagctcccgttatcttctctgtttcccctgttaggtgtgtcactctctgcccgtggcacagtttgctgaacgtctctttcatttctgtgagatcagaagcttccaggggatgtgcagtccagctctcttgacattctttcttacccagatattgcaaaccagcctctagctggagcatcccacatgtgttctgtcctgtggtacattgctggtttaaaagttcgaacagtttagacacttttaaagggggtaattttacttggaaaaaaaaaatccaacatcgctggctagagctgaggagaagccacactatccaccagggtgtgtgtctccagtttcccatggtcctccacggccctgttgtctctcgtgcctggcccagttcttatgcctagcactgcctggtcataatgcaggtgttagggttttctgccagtctgcttatctgtaaagatagagtttggggatgggcgaggagaattgctgccctgattgcgtcctttattcttttcctgctatttatgataggtcagaggtccctgcaagaacctaatgatactgtttccaataggtttcttttttttccagtttacaaggcagggagacattgttctattctgttttgtttgttttaagactaatggatctcaaaagagcctctcagctatttttggtagagtcaaaggaaaacctgtttaaagggacacagcagagagaacagccacataatttaaagcaaacagacccctgtcactttaaatcaatggaaatgcaggagtaatcataggtcaatccttatttagcctacttgccaaaccggcagcctaagagtttcatggtctgtggccttcaggagtagggtaaaagagagacataagttaagtctatgtatgtatgtatgtatgtatgtatgtatgtatgtatgtatgtatgtatctatctatctatctatctatctagtctgaaaaagaaaaatcagcaaacttttcagaattcaccttcctcattggtcttccgctcacatttggactgatttttcagtgactttcttgtcttatagtttatcttttctaaattcaaggagtcagccttggaattccctctcacattttagaaaggatcccctctctttttccttcttggttttctgctagtggtcttgtaaaagcaagaataacaacaacctgctgccttagttccttctttgccaagcatagcagagcctggacttctgcactgaccctgggaacagtgatgaactgtccttagaggaactgaaggcctctcttacccagcaccagcacactacattgcattttttgtgagctttgtttgcttgtttgcttagctaggtttgtctgcccagcctggccttaagttccctgagtacctaagagtgaccttgaactctttgtgggggtcagtaagggtacattgagacagtgtcttatggaacccaggctagcctcaaactttctatacaaccagagatgaccttgaactcccaatcctcctgggtttccacctcctgggtactgagattattggtgtgtgtcattatatttggtttactgatgatcaaacccagggttttatgagtggtaagtaagcatgctatcaactgagctatatccctaccacataaaatgcttttttttttcttttacactgagtggtttctcaccaattcttcaagtagttgtggttcatatgtggtaaggcagacttgtaggaatttgaagttcatctgtgggcattgagagcacagggattaagagagaacatactggagccagactgcctgattgggctctgttctctcctataaccttgcaggaatcagtggctacccccaacctctctctatgtatgaatgaatatatggccgtgctagggatggaacccctaagctatttctctggctccatatggcctttcattgtatgttcaacacttaagttagaacatcttctaactcaagttgtgcagctgtagcctgataacatagtttcctgatcatagtcctagaccttcataaactctaacagccaacacagagaagcataagccaaaatgttgtcaacatacacacagcactgaaatcaggttaaagcacttcactgggaaagcctgcaggcaatgggaggtggtacatgggtcgggggagcgagcccaaggttcagtcagtatgcagccacatattaaaaggtccaagagcttgggcagacgttgactacagaacctgtatgctcaactcctactgtctctattctgcctgataactactagtaaatccattttttcttaatgggaaatccaaagtaaggcgataatagtacctgctgtcctgaagttgtgagagttaaattaagtgtacagaaagctgtgttgagcatatggaacatctgctgcagatatcagctcctttggtctgagaagtgcggagacggcaggaagacgggacagttactgaagccgttaaacccaagccagttgggttactgttatcgactggacggagctttcttcacagtcacattgtaagggaaggctttggggcttgatgctgacaatatcacacatggcctcttctgcccgagagagcatctgtctttctgtctctctctgtctctgtctctctctgtctctccccccccctctctctctctctctgtgtgtgtgtgtgtgtgtgtgtgtgtgtgtgtgtgtgtatgtactgttttgcttctttttatttggatcctggtgtgtatttaggccagagggctaagcgtctcactcttcctatcgaaagatgagctagcccagtgccagctgggagaaagagctgttatatctggtttcaggtcccaccttgccccagacctcacacttctctgtgaagattcagggcctccaggcttcagtgccagggagccaagcacctgttcatcagagctagcagagctgattttccatggtggctctcgctctctcacccctcccgcctcgtgcttgttggtgtcacaaggctgatttcatctcagaagcagctgtgtttactgaagtttaataattcttaatttacctgaagggggacacattatatcacgaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaacggccccgtgaaccctctctgctttgcacagggacatttttttttttttttttttgagcagtgccgcatcctgatcttgtgtatccaaacctggaatataaatataagcctgtttttcttcatcctactcaatgggtgggaaaggaacccaaaaataattggtcttgccagtatactgcaaggtcttcctgtatccttgaagatacacacaattgggtccaacattgttaaagtcaggctcagtgagaaaatagaacatccttagggtccccaatgaaggagctagagaaaggacctaaggagctgaaggggtttgcagccccctgggaggaacaacaatatgaaccaaccagtacctccagagctccctgggactaaaccaccaaccaaagagtaaacatggtggtgcatgtggctctagctgtatatgtagcagaggatggcctagttggtcatcaatgggaggagaggcccttggtcctgtgaaggttctatgccccagtgtgggggaatgccagggccaggaagcgggagtggatataggggggaggggatagaaggagggtgtttttcagaggggaaaccaggaacggaggataacatttgaaatgtaaataaagaaaatatccaataaaaaaaaaatagaacatcctaggcctcaacctagaggtggcatgttagttagttagttagttagtttgttttttgttgtaagcaagaaagtttagctttaggtaatttaaactgtgttaaagaaggaaggctattgggaggtttctagggcagcagcagaattgaagcagagttgaacctccaggtattacaaagcgctctcgtagttcctgtgcgagctggcatcactctgtgttttcctcagccactgcctcttcttttccagaggattatcttagactttaattcttatttgtcagaagaagtagattcactcagaacctctccagggttctgccaccagattagcacctatgcctgcatttgtgccagccaccctttcgtccccacctaaaggtggtctgtcactctccctctgtgactgtagagccagccacttgggactgcgttcattcagactcctctctaacactctctccctcctgtccttgaagctttcacattgacacacttgcatgagattccctcaggtcttcaaaaactaagaaaaccagaacttaaaattgcctccccagccccgtgccccctgtagacagcgtcccacttctccgtgcccttagagctcccaggtagttgtctgtgctcactgctcacaagtcccaccttgctgttcgttcttcttgtgcgtgctttcctacccaggcctccagggaagcaccgtgtacaatgttgccatgactctgtgcagcggaatcagcctcatcagactttccttctttcttactctttctgctctgaattcaaggctctgcccctccacctccccaaggaagcttcaagaacatccgtctcatgcttttctcagctgctgtttctcaggcttggttgcagtgtccaggacatagcccttcagctccccctccccttgcttctgtccctgtctccaaaggacttcctcagttggttagagaattgcatccttctgtcccagcaaccctcacccacctgccttacttaattttttcccccacagcctgtgtcaccattaaatacgctttgtatgggtcttacttggttatttattattgccatcttctcctgaaccatgagcttcctgagttggcagtgtctgtctgctctgtgtccttggcatctagacaatgctttgcccatatacttggtgatcatttgttgggggggggggagagagagagagagagagagagagagagagagagagagagagagagagagggagagagagagggagagagaggagagagagagaggtatccaggggaagtatcaggggtcacctgttggaaagctgactttgcaatgtcttatctccaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgcattgctgtgatagctaccagggcttaggtgtgaggtacatggtgtaagagctcaggtagggaacccaactctacttgagaaggcaagaagcaaagaccacatagtggcagctaaggctatagttttcctcttggttacttttaattataacattagcattgctctaattatcacctagaacaagagttgtcataatcttagcaagaattcctttaacatttcaaatgtgtataacaattacttttctgttaagagggccagcattttacagagctacgtaaataagcattgtatgtactgattagaattcgtgatcatcaaaatatgaagtttttttttttttttaagagtccttactggttatctacttaagagatgagacaatagactgttagcttgaaatttaccgcttgaatttgttttgatggtttttaaaaatgtatcttggttagtttaccatttgccataccactagagatagtcatatgtgcataacaatcactgttctgttagagggtcaacagtttacatcactgtataaataagcatagtgttgactagggctataaaatataatttggctcatttaactttgaccatactactagggtgtgtgtgtgtgtgtgtgtgtgtgtgtgtgtgtaaaaaggagttcactaggcccattagagatccccagtcacaatgtggcaagctgagctttctaattttaaagagctcccatttgattccatttacactgatgtctgagtgctgctgctaaggacaatagtgaccaaacacacactttgaacctttactggatttaccttttaaccgttttctcttttctgtagttgtctatctgtccttgaaatactcagaacggtctaatgtttctcaacatcatgggtaggaattcttccggattctcagctttccccctgttctgtccagccaccactgcaatcaatgactgattcactgtggggagtaaattgtcagtattgagaaaggcataaactctgcatactttttcaattctttattgggcatcttcccaaaccacacaggtgtgagagggtgtgtacagtgttggtcactgcagggctgtttagagcatacaaggaggaaacaactccaggtgcctgttaatgtggaaggggataaataatgttggcctctttacaaggcatttgaaggaatgaatagcacttatcttagaagataaaatgaaatgaaaaacataggctaaaaaggcatatcacttagataacatttttggaagttctctctgtctctgtctctgtctttctctctagtctctttgtcatatcagatgtctctaattggacacacacatagaaatcagttttaaaatatcaaaagataattcaaaatcataaacattgattgtactgttgcctttataaaacatatggacaaggtaactttacagaggaaaggatctatggtctcaggttcctgaaggagtggcataagagcctatcgtggcgggaaattgtggtagcaagcatggtggcagggacagcagagagctcatgtcttgagccacaagcaggaggcagagagagttcactgggaatgacacatgtctctggaactccatagcctgtatgcagtgacacatactgtctccaataaaaccataccatctgaggcagcaccaccaactagagaccagagacattcaaatacccaagtctatgttggggaggggggcatcttattcaaagtactacactaatattcatgttaatgttttcccctggaagtcagagggaatcatttatatatgaaatgtacttgagaagttttagcaaacgtgtgtgtttcaaattatctttctctccatcttgctttagtgtctttgtaaagagtgttaagtttaagagagtgggtgattatcagccaacctgtaagatgattaaccaggctataggggctagggtggaggttggtggaatgtattccaggatgagaattggaacagcctagcttaaagcctacggaaatgaagaaccaagaaaccaaggcatcaaaggggtgagtctcttcacaggattcatagggctgatgttaagccacctagagagagatgacacagaagcaccatgcccctttgctacatgattccaggtagggctctggcagatcctttttatcgcagagtatagactgggaagcctctcacagatattagctcccctggggctgagcaatagcaaacacaacagttagaaagggctcagtgctcctagatgcacaggtcaccccctctatagtgtcactatttctggccagcatttttttagaggacaggtctgatctttctgagtggtatgaggaatttggtgaagtaaactgtatagtcagagagaaatctcaacccagccccaagtaggcagaagaagagaatcctaaattccaggccaacttggattatataacaagacctagtctaatactagcaaggaaggaaacaaaatagagaagtctcttccagattctgggagtgtgtaactgtctagatcacctagcagactggggccaagcctgggattgagtggaagcgcctgctctcattgattaggctcttgttttcttggctcctctattcacttttccccatccagcacttgtttctgcctttaagccctgattgcttttttcctctcttacccactctcattgtggggaataaattgtcaatattgagaactgcataagctctgcacacttttgcaggtcattattgggcatcttcccaaaccacacaggtgtgaaagggtgtgtacagtgttggtcactgcagggctgtttagagcgtacaaggaggaagcaactccaggtgcctgttaatgtggaagaggataaataatgttggcttctttacaaggcatttgaaggaatgaaaggccagttagcttttcaatacccttaaactagctgcttggatgttagtcttgtcctagctgtcttcagaataagagatggaactcttagctcttccagtcccacatctgcctggaacctgccatgctcctgctttgataatagtgaactgaatctctgaacctgtaaaccagccccaattaaatattgtccttataagagttgccttggccctggtgtctgttcacagcagtaaaaccctaactaagacagaagttgttacaaggagtggggcattaatgtgataggcttgaccatgcttttgtttggaagaatgtggattttgggactttggacatggaaaacagtggaatcctttaggtggggctcaatgggctatcttagtaggaatatggaagactttgttggtaagagtggtttgaactgggtggacctagtccaaagaggtttcaatggaaaatttcagtatgtggtgtagagactggtttttgtggtattttgatgaagaatgtgactgctttttgccattgtctgaagactctgcttgaggctaagatgaagagattcatattaattgctttgaaaaagaaagcctcaaaacagtctggtataaattttgtgtgtttattcaagttcactcttatgaggaatgttttaataaaaaggagtaagctgagaaaggaaaaatacaaaatatatggctcaagtattaaaggggcatcaagaagtagaatggagctgaatcctatgttccaggagttaacaaaataagggagtggtaatcttgaggcaagatcccacccaactaaacttatgcatttgcagttgaagaagggataatattatctgagcattattatgacctggatagtgttttcatttctacttttagtctggaatgaactacaatccagaaatatggggtacacttgtgatccagatcttgaggcaagaaaacacaggttttttatctggttctttaggaacagtggccatgaaaagcttaggtccaggcatgggggtatacacctttaatcccagcattacagaagacagagccatgcagatctctgagttcaaggtcaatctataggacaagttccagaacagccaagtttaggcagtaagggagttggaaacccaaagctggtaatagaacaagagggccctagctagcagcagaactcatcagtttcaccatgtggctctggctttagagtcaataatagaagggactactgggacaattgatgttagttagctagagctgagaagttagtggtgattaagaagagaccagcatcactgaggtgaaattttctgggaagtgtcttctgagataacaaagaaactgtgttccagagataaccaagtttgtatccatgttgcagctatatttgataatgtttaagagttatccaggtagtactggttttgaaggtatgaaggggtcatgagagaaactgaagcttagcattgtaaaaggccagggaaggcccttgataaaggtatagcctcagttgcagttgatggcccagtgggtatcatgcaaagaagttgaggcttgggaccataaagagagcctataagaggctattggggaatcctagttgcagcagaagactccagagtattggagatgccactaccatgggatggtcactaagaacagcagcagcagtggaataaagtcaaccagagcctagagttcaacagagggcagagctggagatgagacccaagccctttagaggatcccaggagatcatgtgtggatcccagacattggaacaaaaagctgtagtgttgaagttgccttggagacctcaagatgttgtagatgccaaagcagtgggctagctacttagaaaagctgctaatggggagtggaaccagcctagtaggaagaagttcattgtagttaaccaagatgaaaaaggaattggagatttgaagactgctttgatgtcagacatggacatgcagagtttggagtttgcccagctggtttcctgtcttgctttggagattccagttaagtgattagacaaatctcagaagagactttgaaccttggacttttaacattgttgagactgctatagactatgaggactttggaagttggacaaaatatgttactatgctctggctaggtatggctcccatagactcatgtgtttaaataagactatggtggccagggagtgtaatgtgatggtttgtatatgcttagcttagggagtggcactattagggatatgaccttgttggagtaggcgtgtcactgtgggcatggactttaacaccctcaacctagctgcttggaagtcagtcttgtccaagctgccttctgaacaaaagatggaattctcagttcttctagacccacatttgcccgagtgctgccctgttcccactttgatgataatgaactgagcttatgaacttgtaagccagtcccaactaaatgttattcttataagagttgccttggttacagtgtctattcatagtagtaaaaccctaactaagacaaatatcaagtcttgaagacaaggtcgaagtgaaagaaaatgtcaaatctgtaaaacacaaaacaaagcaaaacaaaataggggaagaaaagaccatgtaggaactctggcttgaagctctgtttcctgttaatccagtttgtcatgtgactgacagctctacggggcatagggttcagtctctagacaatttagtgttgatgttcaaatggagtatgagaagtagtcctggctcaactccagctaagtaaagtttctagattgttacaactgatcttcaggtgatggattactaggggatgtgagtctaggaaccctacttgaagatttgggcagaaggtggaagacaggtgcacatcatgtggtcctcaggcaagtgcatggcgctggttgctaatgttagtctagtgatccttcttggtcatgcaggtaggtggagttggcatctgactagagaaaggagcaagcatacacagggggaatggatagagatggttgggttggtcagagttgtagtaggagttaggtttcatgcctactgctagggggttggctaagaagcaagggccttcagggagttggagagttagctgtagaagttgggcctcttgaggaaggcatgcttattaggggtgctggaaggcaggtgcaggcaggagttcgtcaggcaggatacaggatacttcgcaagttcttaagcataaagatgtaggtgaaaggttacttatcacatttggacattaacaactaagtattttaccatattcttttcaaaaaagttcttcattgtggaatgtgcattgtattggtcagatgcagttcctaggagtcttagcagagtatattcagtagttaatggcaggcttgatgttcttggggaagcaagagctaaagttttctttctttttttttaaccccccttagaagatatattgttttctaaatatgataggttcatattcttagtgatctgagccatagtcaatattcctttgggagctacataaccatttaggaatagtactaaaaccctgacataggtgactagatcttgcttttctgtctatccctggcaggaactctgttggccaaatacatggggtgtgggaaatacattctctttcttcttagctcaaatgtagcataaccctttcctgtcttgtattttggcaccccttgcccccgtctctctctgataagaagatcctgtgatactttatatgcaaaagtccagttttaagtcatctcgtgtaagagatgtactgaactgttgctatgcagtgtccagtggcctgtctcatggatgtctctatctgtgatgttatcagtctagcccactgggagatattcagagtacagtgagaactttagttaggtgggaattccatagccagagaagatgctgttaatgacctagctgacagggatgggctgcttttcacgaagacttaagatcatacgtcaccacattcattattctttatcattgaagctctaaaacttttaaaagatttttttccccttttattatgccattaaagtcaaaagagaaaagaagcgagcgggaaccagattccactctgcctggtggattcccatcaccctgtactgattgattcgtgatggctctcatggaaatgcatttggaatgcatgaaaaagctgctcactctttccagagtgcgtggagtgtttacaggaaacttggcaagagcagagcaaggcgcacggcgtatgttttcacaggtttggaaggaggcatgattttaggggagccttgctctctgcgttgccttcaccagagctgaaggccattctctccagcataagataaaagacctgtctgcccattgcttcctccccagcctcagtttgtctgtcccaccccttgggcatgcagttctgggagtcaccagccgaatgcagtccccctaacccgtgccctcctgactttgcttgtgccattgtcttatgccagtgtctccatcataaaggctccatccctgtgaactctgcacgttgtggccgtggccctggagatattggtttatttgttttctttctgttactgaacaggcttcttaatgataagtcagggtcgattacgtcatgtgtcctacaccaacaatcttgctctctgtagatacttcaaagaagattctgtgatgggtgagacttgtaaaggaccaaaatgttgactgtgttcttggtggaaaagtgttttctctctccagagtttcaggaaaaggaattgtaaagattgatgtaaccatccatgggaatagaaaagtaccagtcccttctggttttccttaagtgacaaaaacgcagtgttgatcatatatccagagtcttgactatgggagaaaactcttggccctccattttgattttcactgcattatataaaaaccagctaacgtatgcagatccctgaagctatgagggaaaaaaaaaatcaaagtaccataaatcaaagtaccatagtcctgcattcccttcatgttttcatattaatttcaagagtgaatgcttgcctgttctggggtctattgcctagagactgagccagtctccctggatgtttttgccctttctaacactctccactgctgctgtggtactttaaatttaaattcccttattaagcctgaacctatattgtgattctttcttctcagtgggggaggggagtcctcttaccataaagctcatcttagtctctatgtaaggggttgcccagggtggatggcttttcctatgctcagacaaccatgaatgcctagagccacactagagtttagattccatatcctctctcaacaatatttattgacattgtctacttagtacagcttcttgagtgctgtctgctgaattttacaagctgtgtcatattccagtaagtttctcaagcactaaagaaggtattcaaaagggtcactggcatcaggacctgtgtttgctatcaagggtcttgggtatcatgtactttaaggtctggcagagttcaggggactggaggctgtagagagcatctcttatcagcataacctgtcaataaaaaagcctatggccaatgaattgaggcaggaagttggaagtggacactggcaggaagagagatggttttgggaaatagtaagagtataaaaaaagagagactcagggagagccaagggaaacaagatggaagatggacgaaaccagcaggtagatgaactcagggaaacaccgagacactgcgatgtgaaaaaagaagtgggcagggcctgaggtagctgaggtaggacgaacgaaccctgttttgtaatgtccagcccgttggcatttaacatactggcagtgctgcacaaaccacccttatttaattccaggccatttccttgcctcccagtggaagccttgcctgtggcactgtaaccttagccaggattcctaagcagtttcatctcagtacctaaggtcatcaacatcttggtttacttaagtggcatttattaatatttacagggttagaaatgaaagctgaacagctgtttgaagagttatctatgaatccatcaacattatttttattaaaaaaaattcgtagtctctgacttagcaggagagaactgaataattgatgtttttttttaacccattcagtctatatcatagcccagccaccagactccattttcagtggtcagttaactgtggtctgaaagtgtgaggtggggagtcttaggactgaactagttatgagttttcactatcatgctaagtagcatgctaaaatcaaggcttaataaagtttagtaacttgccagatttttaaggaactctcaaactaggtatctgtaattttagttttaaagctaggagcgcatgactatctcaattaatgccaaggcaccatcagctttagctgtgttttcttgtattgtccctgggaccagcagcaccttgagagctgctatcccggcgagtaaggaagaaaagaaggatagcacaaatagctccacagggtgctcacctcataaaagatatcactcaacccaaaagacaagttctctgttgactgctaacaatatatttacttgattctgcagaaatatttataaccattcctgagaatttgagagatttgatcatagtagaaataacttgaaagttcctcccatgtcatctacaaaaaaaaccaaaccaaacctaagcaaaacccctaacattgtgattccaatctttttaatatgcttgatttgattgaacattcactagaatgaattaaaaaattttttatatagaattccaagtcttaaaaaactatcattcagccaggtgtggcaatatgattcttttattccagtacttgggtagcagaggaaggtgaatcagaaattcaaggttatcctcaattatatatgagtttgagaccatctatgctatatgagaccctgtctcccaaacaaaagattttcaacagaagggtccagttcagaaccctagtgtttccttttacttttgagactagccctgcttgggaatctacataaagtggagctcaaagcttagaatcctcattccaggggcccctttcaattctccttttaaagagctaagcttgatgctctccgttataatttatagtgtcaggaataaggacatgcactttctccttacattaggtagaataacttgtgtatttgtctaatgttgattgctttcaaacatatagtttctaatctgtcgttttaagaatatcaataaatagttttagaattgttactatttcacaattattttgctttacaaaaagcattttatttacttcttgaagattccaggcatgcatacagtgtatcttgatcatatctgcccattgctccccactctctcttctcaaggatcccctcccaactcctgccctatatttatttattctatttagtggactgagttcagttacagtatccatgtgtgcctgagtgtgggggtcacccactggggcatggcgagcctatcaggggccacattcctaaagaaaagtaactttcccctgctacccccagtaagatcagccttccacagctcctcggctaggggtggggctttagaaacccttcctcaatccatactattttgctctcgatgagttcaaacttggcttaaaaccaagccataccaataattaataggggagatttattgcctgcaagttgcctactttcaaaagatagagtggttttaacctgttttcttggattattttatttaaaaagagaaacgacaaccccttgatcttagcaccaaccatgtactgatagcaaaacaagagtgagccactgtacttggagagaacggggcatgagtactggttttccatctcatacacagaagtgaacaaaaggcttcattgtcttcggcttgataggcacacagtggggttggtaataaagtataactttctaacgctttctctcaactgtctgttaccttttgtgcacatgcccatgtgttgcacacatgagtcatgcatagggagggtaactttagagagttgcttttcttctactatgtgagttctgggatcaaaatcgggttttcattcatggcagcaagcacgctgatccatctcactggtccccaaatgctttttagacatggcttaggaaaagtgtagaaagggcatgtgccagtattttatgagacttcaagaagaaatgcaaaagaagatgagactcatttggattctataaaatagatatcttatatccaaacctggcacattctacagggcaattaacccttaactttgaagattacatttttgctagtataaataacttacgaacttaccaaaattaactcacctttaaatctgtctttgagggcatatacctcattgttattaagaatgtgagtgaagaaggagccgcacggccctagaagatcatattgctagatactcatgctaaggacatgagttgataatgtagctggcggtgactggaggaacaagagtctccagggttgttacagtgggctcccaggccagcaggagtgggagagaggccaggagagcactggaggatggaaggagtttgaactgagattctgtccgcctactcaaggaatcttccctaacatttaagcatagactaagaaaaagcttagctaagtacataagatattttcttatcttagcctgagatcaataatgaaattgataattacattcaaatttatcctggcagtattactctgcaatatctcctaagttgaagactagacaatcaacctaggattttcaaaatgaaagtgactctgaagataaatttaatattataaacaaaataatctactataggctactcagtagaaccaacatgtggggatattaagaccgtagaacttcatataataagacaataagagaaaaaagttaatagagaccaaatataattgtttaaaatataaagatgggattgaaaccaaaaaaacaggcagattggaaagaagtttgtactgatcacagaaatagaaatgatcattgaagtttaaaattcccttaaagaaatacagtattacactaaacaaatctggggaaagacaggacgattggtgttagaaaatcaccgcagtacagtacaaggaaataatggaaatatttgaagagtggggtggggacttagtttagtatggcactcgtacagcatgcacgaacccctgggttccaatcaccgcacagaaaacaaacagaaagtcagaatgagatgatccaaatgtgctctcctatacagctaagatgacagagtatgaacggaattagttgtattcaatagtgtttcacaccaggagcaggatgcttttaaagaaaagggtgtgcatttagctttcagtcttggagattcaaaggtcacagttggtgaggcagtagaagacgatgcatcatggcaggaatacacttggtagcaaatggttgtagctcggaaagcagaagagcctagatgagccctgtgggcacatcaccagcaacctgaggaccttcattctgtctcactcatggaaggcttcacagtactttctaatagtatatcatgggggccaggcctctagctacagtggactcctggtaggcacagagcatactcaaacagcagcagtaattttttttaagagaatgggtgagggttttctggagttgagaggtatagatctctaaagacagtagtcataggcacttctaaaaagaggaacaaggccacgtccacacagacatgtaccctaaagaagttatagaacatgacagacaaagggacatttcacaaagaataatgtagctcatgacagctaaacagtgtggcctgcagtgtattggtaagaagtgagtgggtgttctatcacttgcctgggtggtgccagcttgttgtgattttttccccttcaacttctttgctgagaaagcagttttagattgctgaccccttgggtgtagcattatagctggacattattccctgcactcattaccgtctctgatcttcagggttaatcacatnnnnnnnnnnnnnnnnnnnntcctctattctttctttctttctttctttctttctttctttctttctttctttctttctttctttctttctttctttctttctttcttttttaggtcttggtcataaaacccagaatagtcactgcttggctatacccttgggatttttctgtctttgtagacaggaaatgaagagccaggacttggttttcccaagctcattccctgtctgtgactggacactcatctctctgtctctaggatgtaaacatagatcagaagcagcccctcggttggaaaccatcccttggagtgagatgtgtatgccaggctctctcactgtggactgtgagcacggagagctgggcacagagagtgagcataggagggaagagtgcaggcttgcagaggaggacgctgaagacagttgctccgctcctctttttctctgttttccccttcggtctcttgatgtagctatgtgactttgtgtgtgcctttcctgtccctcctctggggagctgtgcaccaagtcttgtctgggtcttcagacagcccttcatttccatatagaagcagatttctcagccccatgatgtgctatcagatagtgccctgaaacctttcaagtgagactggaggagatgtgccctcatgggaggccctggtctgtctctcttcagtgtcactggttgctcgctctttcccttggcacctgggcacacattgctctgtcatctgtcagagctcacgttcttcagagaataggctttgtttcttccatcccttccgttttctctttatacttccccagctcataatacacagtgttgctttgaaaggccgtttcctacactcttttgtctgaaaactagagtataaagttctttgtcattgcttagacaatggaaaatccagcatttcagttttttgttacgtcttcttcgcagaatttaatttaaaagaaaaaaaaatggagggagaagcaggagaggagaggatctggcacacaacatgaaagcattttattttcatagtagtatggtgtgttcccttcccaaaggggaacacatctgccatgtcaagaggttcatgtgtgtgtttgtgtatgtgtgttcttgtgtatggaggcaagggtctggaaatcatggaacaagctgagagcagcagtaacttcatgctcacactctcacagtggtccctgcttgaagcagtaggttctaaatcgatcagtgggtcctgctggttctggcctcgagacagtgggtaaagggagcagatggccctaaagcctactccatccctccgcacatcagggagcctgccctgccctaccctgtggatgaacctccatcccacctgtcttctctatcccttgcctctcagggtggggctccctcctaatactccagtcggcttccttagcaattgcaggcaccaggaggacttcctagaaatgtcatttgagttgcttatagacgtttgccttcacccaaaaacttcagggttggccccaagcatgcacggaatgggtgttctataggagttctcaccacagatctttctcttgccccagttcagaatggtggttttagcaaggcttctgtgacagtcctgccttctgctaactactgattctctggtacccagctgggccccacagctaacagtgccctggttatataccccgtgcttgtttcattgcccatcaggctccagggaggcactcacattgcacagcttatgggtaccaacacagggagcctcctatctccagtagcctcttgtctctgagggcctctcctactgaactcaagaacactgcatcatcttcctcctcatcactgtcccatcttgcagaacacttgatacttccctgaattcccttcaccttgacctttcagtgagcccacataccatggaggtagcccaggcctccagagcggagcagcaacaaacttgctccagtgtgcagcacttcccaagttctgtgatacacactggagcaagctggaatgctctgggactgtttgagctaaaatcttgaagctcatgcctcttcaagcccactgtgctagatcctaggttcccagcagcaaacaaaactagcgtggtgcttgatagcatggagcttctaaggcggttaagaaattggcatcatctttatttctgtctgagccttgtgtatggttgtgagtagatctcagactattgcagtactgtacaccaaagcagggagagcaatcccttcccagcatcagatgcagggattggcacaaccagtttgtaatgtgtgtattaattgataaaaaggataggtagattgtaagacagaaacactgtaatagttttaaagtggtttgttttttataatatagagttaagatgcagctgtacccagtaaatcttataacaataattacctgctgctgttggtaacctttgcagattgttatgtgcatggcctttaagaagtcactatactttgggaaaaggtcttgtatcgtgggacatttggaaaggattcagtgttgtgactaatcaaataaatgcaccttaaaatgagacaggtgcaaaattatacactgcttataacaaatttgaaactaataatgccttattttatgcaagaaaaaaaaataaaggacttatgagaaacaggtaccctaaaatattctatgaaggagtataactagatacaggtctaccgggtgacatgctggcagtgtgcagtaactttttaatccttataataaattctgatcccatgaatttattctggagaaaaatatgtattggtatttatgtacctggagtttgctgcagtgattcagtactgggaacaatctgagtaggtgataaatgaggtttgacagctactccatcagaactttctccccagatgctagcctctcactgagccttgatcttctctcccctcaagttagggattaactctaagaatctgtgtacagttttcctctttgtgttggctttgtcttctacccgtgtttaatgataacttagcttttaacatagcccaagtgaatgtggtttcatataatagatttccagtgttgctttctcctggtacagaagtatctgaagctgtgggatccatcagtgacatgttttaggaagagccgcttcctaaatgtgttgagaccacagatgtgggaaacggggacccgctggaagcctcagggcgttcccatcatcatgtgggaaaccacaagagtgacaagggttcccgggcttcctgctctccccagcagctgctgagactgccttctgaatccctatggcacttgtttggaatataggtttgagttcattgtagagaaatcgaaggaaggcctggctgatgcttgtggttgggaatctaaattactgatcccttgttcctttccaagttgtgggtttcagctctgtgccttttgtactctcatccccgcctccagaaacctgtccacctgccctacccacgttggtcctcctcggcaatctcggtgctgtgttatttcttggcggcatggcctaaggttagattgctggacagggtcaggctctggggcctatagcgaagagctggggttactgaggacctgcattcacaatatattagctctgtggattgacacagacccagacaggtctgttgaagcaggcaactggagatttttctcctagaaaatgtgcagagcatagttcttaccatgctgtggcccacattctaccactcttccccatctctgctgccatctgagcgcagcacatcattaggcaaccttgcctactgagcattcagggcaggatgacagcagctagggcgtctggctttgatgcttgtacattgtaacactttagcattttgtcactaaacactgagttcctttagaaagcaaccttttgattggggctttgcaaacacgaaccacgacacttgctgagagcctgactattggaacacagtcccagatctcagcttccctctgtgactcacctggtgtctgttaccagacactgcctgctcttctttgcctaaagaaaggtgcattttctcagcttcgatcttcacttcctgcttgttgatggtgaactttaaaagttgtttccagctatttactgcatatttaaataaacaagaggagctgttgctgcccttgaatgtgaacttgacagctgagggaacctggggctgggggttgctgatgcagaaattgggcagtgtagggcttatgaggtataatacaccaccttttacaatgggctgcaaagattgggttgtcttctttagtgaattctattcacccaggctgagtgcctatgtaaatgtgtttttccttctcaatagcaatctgctagcctctgtctcagacacataatcccacttatagatttggagtcttggtcatccctcaaaagggtggttttcatttccttaagtgggaatgtgtgtaggaaataagaagctccaagggctgaacttcaggctgccttctttgatttagtatttgattagcatttagtatcttatctgtaaaatagaactagtgataaggggctgtcttcaggaggctgttccccccccccaagtatataaagataggtgtactgattaagttcaattgatcctacaaatgttccttggaaacatttaatatgtcctgctcctggtgaccaacatctagacacaccttccttgtccccatacctccctccccatcctgtttggctagaccagcattttaggccagttaaagaactcagtgggcttcctgcagcggagctcctccacacagtgactagggcaaatggctgcaggcgcagagacctgccagaggagcagggtctggcacattaaactgctcagatgcaatacgaacagtgctgtactgtgctttgtatgtcatgattctctactggacttgatggcagtttgtgtagcttcctccctgctcccttctctgtgcatctctctgtctcggaagatgggagacccatggagttttgagcattttggtgttagtagctgaggcctttctgagactgagagaggccctgctggtagatttggagaggcgctgctgatattgggtttcccctcgggtgggaattttctaattgcttttcatctcactcagtaaagaacacctcgctcacagtgccctgccaagccctccaggctttgctgccccaggtccgtgcctgtctgactttttgttcctttcccctcagctctctgtgctctcctcacctactgctcctctgcatgagacttcccaggcgtccccaggccaacatctttacttcctcaagatggttactgcatgtctccttctaccatacttcccagatcaccgtttaaaagtgcgccatatccccagtattccccacctctcttcctagtgtgctctttgaccacaagaccttacactttattcattccctttcttaccatacaaagtgaaagtttatctaaggcaaagaaccaggggttgcgggggaggtcgttttatttagtgcagcatctccagggcttaaagcagtccccagcacacggcagacactgggaatcatttgataagagaagaataggtaagaccttgagacttctcaggtgggtcagagtccacctcggtccgtagcctgcaagtttagacagtggtggtttacaggcaatgggcccatcactgaggaaagcgtcatactgacaggaatcagtgcatagcaggccttgatgctgtcatttacatatatgcatatgcagacagtgtcctgaccatgttttccatttagcacatctctctaagtctgagaaataactttttaatggtgttttaatgagtatgaaagcattttataaattataaagtgctttgcaagcgttagttacattggacattagaaatcaactgatagatgacttgaatagttaagtagttttccagaaaggcagtgtcctgggtcagttcctctccattttccttttgctggtccctatctgggcctacagacagcgcctacgagcatagctactttggctgaagcctacttaggaaaggtgactatcttaacctctgagatccagctctctagttctaaacaatgcactttctttgtacaagaaagaaataagagaaataaaccgaggctgatgaatttgggtgcactaaaggctgtgtctggctgactagtgacaatgagagttacagttcttttcctgactgagccacacccattccataggaaacagtaattcccatggcctagtttagtgtattcccattagagaaactcagggatgttcaagactgttattggccatagatgaactaatacccttgattgctttaaacaacctccagacaggactacacgacccagtttccctttgccacatgagctccctaaacataggccatgtggaaaggaagaatagccagggagggctgcaccatgcccagaccacaccatcctcgaagaaccctgaggatcagtagctctgctgtcagactggcctcacattccacgtctgccacttactagatatgtaatttgtcagagttgtaactttgtagtgctgaacaatattagagcctaattcatgggacaattttcaaacgaagtaattgatgaagtaattaatgcccacgttgcagaaaacacgtgactaatactgctgttagttattgatggtaatcattgtaataattaaaggcaggcagaagagagagggatttgagaatgaaaaaaattaatatagggtactctatcctagaagctatgacaaatgtttggaaggagaccaatataataatttgtgcattatactatattatacaatacacattaggtaattcatataataatgattattataccctgtaaatatctgatggccttataccttgcaggctagtgtaatcaacagtgatacctggtttgtcatgtactacagctgtcagggcagctgccctggtagcctctccactacccctggcacaactgaagatctgagaccctgataggttacatgcaagtttgaagcaggaactgagtactgctgatcttctgtgcattttcaagatgtcagcctccacagcatccgcatgttattcctttcttcacactccacaagttatatgtcgccctgtacctgatactggggtagtcatagggaggctcccaccaccgtgtactcttgaaacttttgctaagtggaaggaacagccatagacccctcagtgaatggtgacgccgttattgtgcagcaagtgctgacacaggataacggaggagctacaagtttagtgcaagacctgacctactgtgggtagccagaaaaacccctctgaggaagtgagaatggcctagaagagagccaggtaaagagggctgttggattcccaaggcattgaggatcaggaagaaagaaggcccagaggtgaaagagcacagggcagtggcagagaatcaccttggtgtcaccggtgcataggacttagtaaaggtgtctcacacattctctcctcttcccattggatcgccaacttttagtattatacaatatatgtaacatttttatcacatcaaacattttaaagactatagcggagtggtataaatacatatatggcatacacctgtcaacctggccatctgcaagtgtttccttttgcagaacctaaagtctgcaccatggaacaatctctcccttgtcctcccccatcctgcgctgctcacagttctgtccctgagtctgaattggagtatctctgtaagtgaatcagacagtactcacccctctggctggtttgtttcacctaatataatgtcctcagattctgtccccgttgtgtttgccagaaacccatctcttttgaaggctgtgcagcactccactgcaggtgtagatcatgtcttgctgaaccgtccatctccccacaggctcctgaatgtgttgtaacagtggttgaagagagtggtcatgaaggtggatgtgcagataccttgagtccctgcttgtagttcttttatggatgtgcctggaattagaattactggaccagatgacagttttgtgtgcaatttttgaaaacccatcatacttcctgccaacagctttcagcttgaagattaaaatatcgagaggacctttggtggattttgaagagagtagtattgacttctaggggagctgagtagaaatggaactggctgtgtacctggtcctcagaacacccctgcttagagtgcagactgtgtgcacagagcctctcgtctctgtttcccccacagctctctatttctctaaagaatgtctaggatcaagtgggtctctgcaagtgggcccaaagttgacataagttgttctggtcaatagggacatcttagcaggcatctttgtccatccagaaacatggacatttatgccaccagaagcaggggcaagttattcatacccagggagccttgagacatcttggaggaaagagcatagcctgggttggcaccccttagctatcattttatcagtctggggctataaaaagcattttgccagcccccttccttttaatttatctacctaatggctttattcttacaccactagaaagcagctctctggctgtgccagccagccataaatactattctgtcacattcaaggatcaattcatcattttaccaagtagacagccatatgtgtggtaggaaggggaagaagcggtgtagtctgatacattgctttcagagggagtcacagggtccttcctgtttcagctcaacagtctatgtcatggatgaaggaccaacctttcttctttcatgcctctatcatagccctgggtgactctgtgatatgtctatattcatttgtatggggtttctgaggaataaggatacctcttgtcattggttatgtggaaacaactgagagccatggctaagaggacaggctctactgacttagttccatcttggctgtatgagcacaagtggcgtcttcacttctcagtgtctcagggtctgcagctgtataattgtggccaatagagggcctgtctgagagtgctctcatggagggcaagtggggctataaaaagtactcttcagaaatagtactttattaattattcaaagctcagagtatggccattcactaaataaccattcccaggaattaatgtgaccgtgtgggccatatagagctacttctgttactctttcctttggggacagcatagaaaagctgtatttatgacactgatggactttcttggcagaatcccccaacaccctcatactagtcccacctcagaaagtccaagtggtatctaggcaacacacacttagggattcgaaattggtgaaagcaaccaaattaaaaaccctggaaacttaacacttagctggttaaccacaaaatagcagcttcgtttctagcgaatcctcagccatcctcaagcccagccttggggcttcccccaagaaggtgttagcaactaaggtgatatttactgttgcttgatctcccacccactctctcactttcaggagtgttagccctaagcctgcctgcatcctctgcaggaggcacttcaaggccgtcatccagctttagtcttataacgcttgagaaaagggagtcgtccgtccgtgtagaggcgccctgaaagatggaatgggaaacttggtttgaaggagcaagcttgctgcagctgcagtagactcgcactaccccgagttggttttccagggtggtgagcttaggttgcttgttaggtagattagggcatgaagctgttggtgtcatgaagtagctctgagcctctcagcctgttgtgccaaagatgctgatgagtaagtgaaggaaaatgagtgtgtggtttcctgaacatttctatagatttcaaatgtgtcatggttttgtttgtttgtttgtttttgcttgtttgttttataaaacacaatgggataagtacttatccttgcccccaaacaaagcagctattaaacattactgcagtatggctttaaactggtacctgctgtgaatcatgccctagcaccatgatagaagcagctgtcctctgttaggctgataaaccatcccaagagagtgactagttacctgtgctttaacagccttcccgtttatatggtaggtgtcttcattcctgtttcctgcctgagaaggccatgtgacctgagttttatccagccactctttctctgactaaccaatgggtgaccatctccctctgccttattttcttttttctatgtaagaattggtatttgcacactatgctccttgcaaattgtagttcttggtgcaaaagtgggttgcaaaatcaatttagtaaaatttaaaagagtatataaaatatcagatgcatcccactaactgttgggtatatgtatgctgtgcatgtatatgtgtgttgtatgaaacatctcttatggtcagaaagatccaaactactaatctagagttattataaaagccaaatgtgcataaaacattctaggtctttttgtaaagcctccaacatccttagggtctgaggttctgtatagttggtactggaggctggagcggggaaggcaacaatggttctgtgctgttattagaggcttattatagccacaggatctgtgtagaccctgcctgccactaccacatcaagtccaggatacacaggcatccaggactcagagacagccagattgcaaaccttgctctaggcttacaggtatttgaggcctttgtggcagtctgtggttgtaaagaacacagcacttacatggccctaactcccatttcaactcaaggaaaacagacgtgatctctatgtagtatgagggcctttcttaatgtgcctctaaaagggtgggctactgccttacccgtcatgatgctctctgtattacaacccccttcatctggaagtgatttccccctttctctctcccccagagggagatccagactgtccagctaattcccttgaaacaaagatgacaggagtccctcgaacatgcgcattttcactgaaacatgttcatcacttgctaactgtagtccagttgcatggagcatagggtgaagattcccagcaacttccctgagggtcacagaaggagcaagggcttccttccctcccctgacaggtgaactcctcccctgcaccctcaaaggtgagcttgcaatgtttgtggaaggcaccttagcagagtagcccatgtggacacagtggactgaaaggcacgtgtcaatggagaatttaacacataagaagcatgtgtgtgtagatgctaagacaggattcaacatgacattctgaactgtgtgaggaggagcccaggcagtacaattaagagaacagaaggcaggcctagtgttttatggatctcactaatgactgagtcccgaggcttctgctggaccggcttcccagcaccctgccagcctgctacccacacatctgtaaatccgtcaagctataattcatgactggtgccagcagaggctgaggtctaggccttcctctctggaacacacagagatctcaagtcgttaataattcactccggagtaatgaacaaagctgtaccaagttgtgagccgaagttatcaagtgacagaccaatttatttctgcagtgcccagatataatagcagcaatgggaaggtacaagcttgtccctaaaaagtttctcaagacttagatcaatgtgttttaaattccagaagaaaatggatcattaaatgggaaattaatttgttgggtagcctcaagcctatttatattcagagttgccaacccagaatttctatactgtttttccaaatgcctttggacctcagggccagcaaatcagagtaattattactcattaattaaatctaagaagtggaacacagcctgagactttgaaaagggaggttgggatagtttaggtacaattatccccacattattgatactcattagacatttctcagttgggctgagaatattagtcttacatctaccaagaagttcccaccatgctttaagtttcatcacgtgtcatcctgcttgtcactggctctgtcaggttcaatacgttagtctgtgttcattctcatggtggagacgctgtcactgagtgagagcatctgtctgagtccgggatggagaccaggacagtgcacaaagcaagggaccatgtgagctgagccttacagagaagatttgtcaagcacagagctagcaagggcgttctaggccacagagtgacacgggcaagggcagaaaggtgggagaagaggaggagggcggtagaaaattattctcatcagtgcacttcccacccatgatcacattaacccaccgaaaccacaggcaatgaagtggacatgccatccaccctcactactccttttaaagagaggaggaacccaataccttcatgtttgccaaagtacatacatgctatttgtcaatggaaagtagcagaaacgtagagaggagttggggcaaggtatgctttttctatgtgtatccacaagtgtacaccaaatctaaaaaactgcacatatccaagagtgtacatcaaatgataaaattggttgaagtaaaatttcagtaacgacggggtttagaagcagacatttaaagtgggtgaatcctttctcccacacaatggaagtcttcaggagaaacagcataggcagtgctaggcctgcatgcaagatactgagtgtcaacagccctcaaccctggcgacctcagtctatgggaagtgtctcttcccagacttctctctaggtttgagttagtaataaatagcttccctcttccagcaggcgattaaggaatcttctagtattctctaacagtgctgaatggcactaacttgtgtattgccagtgacccatccctacgtttttattcaaggggcttatgaaccactgaattttatagcttgggcatggagttcagatatatgtattttgaatagctttttttatctaaaaatatgcatgtatatttagcagattactctgacatagccactactgacctcatcccttctttaaacgttgagtgtacatgcagtataaacacacagataaacagtagtgcattttttatttctgttgatgccacatgtttcacttaatgcaagccttgtgtttaatcaaacgagcgtttaatacttagggtttagagtaccgaatttcctgacatggtttaaataccagctatttcctttagaaagaaagctatgtctatctttgcaaatgaataaaactaggagcttcttgatctgcattggagacaatgcagagggaaaaccccttgacaggtacagaagttgtaatcaagacggatggggagttacctggacttagagagtatgacttgggtgagcaaaacttcatcacctggcagatggccttggctcgttggctggctgttttaggccaagtggaaatcacaccctgaagtgaatgctgaatgagatctgtgaacactgtagttgaagatacaaaagaaaacttgctctttgattcatggcatccagagatgtcccgagtcttgcctgctctagatgcaggcagggaggccagaggcacccaagaaggtgagctgtctgtgtgtgcacgacatctctcacttgttctttcccctttccagtgttgctaacaaccacaagcagaatctgatgactgtggcaaacctgggcgtggtgtttggacccaccttgcttcggcctcaggaagaaactgtggcggccatcatggacatcaagtttcagaacattgtcatcgagatcttaatcgagaaccatgagaaggtgaggcagaagtgtccctggcggcagagggtcaagttcagcctgcgggtggggccacacactgggacttaccttcaggctaggtttgcattgctaatggcacttgaatagtgatgatggtgaagtcatggtcctggtgttgataaatgtgagaggactggtggaggggaccaccatagctcttagtggctctagagatgtggggatgggtacaatctcattgagtccttattctgtatcagggactgcgctgggcactctttgttgctgtttttcttcgacgtccagtgaaggggtaccgttttactttttacttgattatctgtatgggcttgctactactaggtatgctgaagttttcccatttgtgctgcaagtattttttctgtagtctagtttctgattatgtagatagtacaagtttcatacacatgttcatgcatgtattcatgcgtgtgcatttgaaggtgtttatatatgcttgtgacctttgcttttaagtcactggaatatctcgtctattgtttgttaagctttttttttcttagagagctgtataaaggtatgaagtgctcttcccttccagctctccctggactcctcaagtatacccactaccaccttcatggccttctcccttaaaatccagtttagtccagtcagtcattacctgcatgcatagccgtgtgactacatccactagagcacatgaagcctccagaggccatcaatgccagcagctcctcagtagcctgggaggccccgcccctcatccttgctggaattctgactaacttgaccttgtcaagtgaacacagttactaagagctccggaatacaacagtgtgtctcaagaccacccttcacccccattcattgtgaaattctttagcaccgtttaagtcctgctcagtcctctttactcttagtagcaaatccctgagaagctgctcagagcctgtgtcgattaccccaggtggctttttcacatacataactctggaacttgatttaaaaagataataatgatacatgttccccttcctaaataaaacctttgcctagaatgagaatattcatgcaaacaaatttagattctgaccagtccttgcacacgacaatattatggataagaacaatgcaaaccattgtcacccctggtctgaattttggcaagaacctcctgatttgcctccttgtttccacttggcctgtttattctgataccatctaccacaatgactctcctgacgtgccaagtgagctcacatcagttgtgtgctgcctaagctgttcagtgactcccgcatggctgggtttgaaggccattcttgctaggagcctgtgagtcccacacagtcgtcatcttctctctcatgtttcttgctgcctccttggctctgactactctatggttccttgcacatggcaggtacacttctgttttgactccttagctactgctgttcccatcacttggatgggacactcttccaccttgaagattacacggcatgttttcttcagcactctcaagtgtcttcagagggggactgtccagacttctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccccctcaatccctctctccctccctctattctcttacacacacacacacacatacacacacacacacacacacacacacacacacacacacacacacactgtctcttcgattacaatgccctgcacctaaatgtgcaagaaggctgccatcagatatggttccttggccttaaacttacagaactatgaacccgactaagtttcttttcttccaaaagttacccagcctcaggtattttactctagttatataaattgagctaatacagtctacacacattctagacggtgcctgtgagggcagaaacttccttttttctgagctctttttactgagaaccttcctttgcccttcttaggagtctgtgatacaccttcatactggctagggaaagcattggagcccacacaagtactgggtctcaaaggtctggagactttgttccagctgatctgagagggagacagtattctacaaagttattaggaagcaaatgtccctgaatacgaaaagacagagcaaaagaatccataagatccttgaccttccctagtccatgctggtaatgcatactcatttctttttttattcagttgaactgatggatagtgttaataaatacggtccagaaacataacttgataaaaataatttttactcacaacttattcacaagatactgtctaagcagccacgtagctaccacctcacttaattttcctagcagtgttcaagaaaaaaattctgcatctttttccattaggaaaatgcaaattaagactagtttgagattgcatctcaataagccagaatggctgtcatcaagaaaacaaatgacaagaaatgctggcggatgtggggaagagacaccattatacactgcctatagacttacacactggttgcaccagtgtggaaatcagtaggtagtctcctcaaatgcctaataattttcctccagggactatatatacacctagaactccactggcattctgtggccattagagaagaacagaattgaaagcccagaaagcaaagatcttggctctcaacacatttgctttatagtaatgggttatttctttaaaatttccaattctatatgactagacccctccccaactcacagtttaacctgaaggcctaaactatcaagtagacaaatgcttggtattatagtggagataatattcatgtatctagttagaaataaagaaataaaatattatagctatcatctgaaatgccccagttacagaaatttaacagttccttacaaagttttcctcccgatcgctttctaagggttaatgtgtcaatggtttttaaagttttagatgctaaggaagaacaggtacatgtcaaggaaacgcattgcctgctagctatgcttcaggcaggttgcgcttggtacagtgcactgctcagtcccaccacaataggagactgattccttgcgttctggacagtttatggcatttcttttggatgtggctctggagaaggtttctagagaaataggaggatgcctctatgcacgcatgcctatgagtagtgtgtggtgctgccattagcatccgtaaaatgtgagcgttcccttgaaatctatcagcgggctttgggagagatgagagagtagatctttaactactaacaacggtcagaagtgtattctttttaatatatgttaactcttggcctcctgtgccagagatgagctagcaaccgtccaggtagtcagtgcaatctgggcccactcagctgccttcatttgcccttgggaaaaaaaatgttgatggcaccgaatttattgcactacttactctctgactttacacacaaattgcatattaattaatatgcacttggtcaatctgcaactggcaggtgtttggcatttgcttttcattttcttaatatttgacatttgttggtatgcaaaattaacactagtaatgataaaatgtgcctagactcactgcaaccatcctgctgttcgtttggattctgtctgtgtaaacctgaggaagcaagaaagaagggcctgtacaccagaacacagtgcttcttctatgtcctctaacattttccttcttaacagcagctgctgtgtgcagtactctattaatgtagggagctagtcagattgagtgcatagttacccctatttaactctaggtaaactagcaattacttatattgcaaagctctttaatatccctcaagatattataatggggctacagtttgatgttgtattttatataattcttctctattagcagaggtagtaggaaattaggctctttctggagatagggaaaatcacagctcgtgcacacacccacacatccacacctacacccactcacacgcgggcacacacacaccaccaccaccaccacccctgtatgtgtgtgtgtttagttactaaatataatggttccttttgagggatttttaagtaaaattcttcaaactactttccaaattattgatctctaaccccacccccaagtgctgataccagcagggtttaagattttcaactgtcctttaaaaacaacaacaaccaaaaacaaaacaaaacaaaacaaaacaaacaaaactctctgtagctatagcctctggatttggctttttcgtggtaaatgacaagccctgcagtggcttgcctgagtcacaggcttgaagtggctgggcatcaggttccacctgccctgtgagtgaaacaccttcagtgagcagaggagctgtggccctgccttccccaggccagggttcctcatcttctactcaggtgttacctgagaccctgaggaatttgtgtctcaagaacagtccccagagtcagttgtcagctagcctgctgctgttctgtgttgcgatcccaagactggagagtgatttcttgtcatcccagccatagactcagaagctcttcattgtgacctcattttcctcccataaaaaccacagcacataataaagtatacagggcccacttgacagagagactcctaatccttttaaattgcaggggcatgtgacagccaggattagccaaggtgtaaaactgggggagcaaggtagctaagaacaaattccacaagtgtcaggctccgcagtatcaaatgggcccgaaaagagccccaaacccctatactctgtaggtcacacacggggaaaaagaccatcaatactaacatggctgcaggtaggtaaagctgatagtctgtaaggaatgtagttaaatttacacttaaagattgaattctcatgttttgagctcaaataattcatttttgagatctgtttttttttctttatttttatactttatgtttctgtctctctgactttcagccgctctgtctctgtctctctgtctctctcttaaataaaaataaaatgtcttttgcacagcaaaggccaaactgctaaggtgccttagccctcactgtggtcctgggcctttttgtggatgagacatttggaggtcagacacttacataatttgctcaagggcacagacctatcaaaagcctaaaatctaatctgccagcccacaaggcttgtgatctttatgttctatcatctgtctctcagaacactccagaagacccagctagctaggcctcagtcaatcaggacatctaggtctttgtctagctgtgtgaccttggacgagtgagttgatttttgggagactcagtttccttctttacaggatgtcagaaactgcatctccctggtagagttactgtgtagggaatcattcatgcctttaaggtgcgtaaatgtaacatcatggaaacactcagtgaattttatgtgctttaccagtgtaatattattcattttatattctttgtcttttcaaaagatgtacacagcaggtgttatgtgttcatctttacaagggacataggctcagaggggttaaagaccttgtctgagataatacagctaggaggtggcaaagccagaattcgaccacaggtccctctggctttgaagcttgcttgcttttacacatcacagtactttaaattcccttcttatatttgatatggtgataggacagtacggcaggtctcacggatagtgaggtctggtggtggtgtgtgagtgtgcctcaagacctggtgttcacccgaggctggctgactgcaaccctgatcctgcctggcttaaggggaaaaagtagcctggtgtttatggatgtgttaattccactcacagggaacttgaaatcggggctacttggaaaagttcctctcagttgtatttttattttacaattttattctcttgtggctcctggcaggtccacagtcttcctggcttttatgtgtaaggcattcctgattaagttggaattagttcgtaagtccaggagcctgagcaggacacttggggcacagactaaagctgtcctctctgtgctaatttggaaagtctctgtgaaatgagtgcattgtccccaacacgtggtagactttgtagattgtatgagttcatgctcgcagattacagagtcctttgtacagcggctttcttcatgacccaaagaaaacttcatttgtgcaatagagctggagtgacccacagagctgtgtaattcaggctcatgagaattccagctttaacttgtatcacagacaaaacctttggcgtggccagaagatagctggaaaatcatctggggtgttctgaagtgttcaaaatgagcagcagccatgtggacagtaatttctacattcttgctatatattccaggctttgaactcagtatgtagtccagcctcgacttgaacttgcaaagcaaacctcccgctctaacctcctgagtattcagattagtcctatgccaccgtgccaaccccagcttcttactggatgtttgtgtcaaggtggcttcatttacaaaggtgcccttgcatttaggaaaacttacttgtatgaagaacatgttggccctgtgcctagcactttatattttgcaatgtgctcttgtgcatattgtatttgtatttgattccaaggacagcttaacagagttctctagacgcctgtacctggctcataaacagacccatagaactggattttggtgttgaagtgcccacccatggtaaaaattctcttgtagacaggattgtggtctgcttacataacttttcgagaaaatagcaaatgagcagagagacattctcctttttgtgttcccatgtcacttcctactgtttttgtggggcagtctttcatacatctgtgtaaatatgtgccttacttaaaacctagtctgtgtctaaatgaacatctgccacagttcttagaaagaatagatattctctgtgttatcgacaattgaatttaaaatgcaacctgccatcttctcccactgcactatagtggataatggatatatctttcttcattaggaagaaagataatatctggatgccagaggcagagttatgggaggctactccaacctggcctgcccctaactctggattcatcactagatgctctcagcaagggattgcggaaggtactgggccagaggcaaaagagtgctaagagatgcattacttgttaacaatccattctcgtgggacttggggcagttgcttcccttgaagtttggctggagaggatgaattgactgaatggctgctgcaaccccagggcttcactcctggttgttagatccacagggcaggatcagagatggctcttgtgaaatggtcatgctgtgccctaggctgagttgaccttcagcttagggaggagtcatgtgagatgcccagctcagagcttagctggcacaggcacacatatctagaagccatcttaactgttaatgagagtgctcattgagatgtcaactgcagagtggctgaggctcagcatgggtaggggaagaggaaagaagagctgcttggaggttacaactcttgggctcaaccataaccacagcccctccattttgcgttacattacaaaggctccaagagattgcaggagtgaatgctagtcagtcggtttattactaggggctctggctgctctggagatgaaagtttcttattctctgcctaacccttgccccagttgatctcaactctatacagtgctcagtttatcctgtttcaagtttgagtctaatagggaaaatgtaacagtgtggccttccttcccgacagctgtgtttgggagtgagactgccttaaatgactggctggcatcatccgagccaaggatctgccaaccctgagagaacagctgttccagctgaaactctcataattcttgtgacttagcttcctgcatctcagctttggacattgctttaagatatatacacagagaagagggccacaagaataattgtgggatacttagagccagccataaatgaaagggatggagagggccaccaccatcctcctataactcttactgctagaaagaggacatccaggaggctaatgtcacagtgttaagaggttataacaaaaggatcagtcagttttagtatcttagtaaatttgaggtgcttatgtaacccgttggaatcatctttgaatgctgcaatataatgttacacaagataagtcgggtataaaactatgtaaaggatataatctcagctgtggaaaagtgtgtttagcattaatgagaactcatacaatgcactcagctccatgcctggtgtggcaaatacttagtaaatcacagctactggactgtaaatcctctaaccacagggaacacaattgcttcattcaccacgacacttacggtacctctgcaaagtgggtgttcaaaagaattctggtgattgtttgaagagtgttattatcatatgcatttacagaggcatctaagagaaggggagcctgtgttgtcttgtgtaattatatctataacttcaacagcctcattttgctaaaaatgctgggacattagaagcgatgcagaattgctgagaactggatgagttgcctataaagcacagattgctgtgcctggcatcccaggagccacagtaagtggctgctacttacagatggtaagcacatgtaagtaccggccacagggtaaagaactattatagtaaggcaagtaagagttggtaaggttttagtttctcttacatgggtgtgaattcagtatgtgatattccccaaaggcttgcgtttgaaactcttacttagggagttcatgagactttcgaggtgtggagcatatctggatggatcactgagagcagattttggggattatcgacacgcccatttcccctagtctgcctcagatttctgatccattgagatgtgaacaagcagccctgtgctcttgctgccagagctgtgggtgctcccaccaacatgacttccaaactgtgatagacggcacctcacctctcatccacactgtgatagactacacccttacctcacatctgtattacaataaaccgtacccttatatcataaatcaaactcctttaagtcggttcttgcctggtatttgccacaataattaaaaaggtagctactacatgtggtcttaagtaataacaacacaatgaagttttaaaaaacttataagggtacaaaaccttaaaaattataatctgtaaataatagaactgaaaaggattttctttttcctttgttttagacttttgtacattttccaagttggtacatgtatgtacatgcacgtgtgtgtgtgtgtgtgtgtgtgtgtgtgtgtgtgtgtatgtgtgtgtgtgtgtttatcagtcacccacttccatcctttgaaataagataaagctcaccttcccacttagcacagagctgatgaaggactaaggctgtcctcactgaggatagttggggaagaagaacaatgtttcctgttctgtgtcagtttgggatcataatttaaatatgttttatggtctgaaataaaattgtgaagcagttgtaaataactggggatgagacccagtgaataaaggaaaggcgtttggataaattggttctaggcaacagcagtaaaatgccttcactgtcagcagacagtggtttagattatctctgtttcttttcagtcctttgcgtatatcagaagggattaaaaggagacatgaactctaggatcagttactggagaaagtgctcagagctggttcctagaagtgtctctgtggaggcctttcccagcttttcttccctgttctatgttaccactatgctcctggtcataatgatgcaggccttagctttcttcctagctcatagaactgtgtaacttcttgtcaccctgatgtgcagatattcaacacggtgcctgatgtgcccctcaccaacgcccagctacacctgtcccggaagaaaagcagtgactccaagcccccatcctgcagcgagaggcccctgacgctcttccatgctgtgccatccacagaaaaacgtgagtctctgctgcccagggacagggtggtgtgtggagacatccttgttatccttgttgcctccatggcttgctgtggacatcattagacttactgtgtgctgttggcctttggtgtcttaaaggctctgtcttcttgtactctgcctgattccattgctaagagaggtgtctgggcaacaacctgagcctcttctccctgttgcatagcaggatgttggctatggtgctgcctgtggtcccaccgttgtcggcaggtcatagaaacagtccttctcccttaatttggtatggagttactatcagaggagtcacatgtctgctagtatgtgcctgtccatgggaatcagggccttctgattactcttactcttctctgtgttgacaccttaaaatatttagaatcaattactgaattaaagaattaattcttctctcttccaagtagaagagaaatgacaccacaaatgtgccaaacttttttatctcaagacttctgagttctctgcaataattgagtacaaggccctaaagtatacagtcatatttcagtttttgtgacaagaaacaagtgtcctagcagttggaaggcagaggcaacgggggaggatttctgcaagtctcaagctagcctgatccacatagaatgtaccaggctagcgaaagcttcacagcacatatctacctcaaaataaagaggaatcagttaatctatcatgagagtgaagacctcacgatctattggaggtcagccagtattgacttttattccagctttaccatagtagagagctctgcccccttcatcctcagtttgcttatctgtaggagggataatagtgctcgccctagagggtaaacctgagaattaacaaaattattcattacagcatctgacataaggctgttacacatagacaccaaaaccagtcctaacatgcagctgacatttccatggtgccttcacggtctagggatatgagaataaggccttgtctgtaacctgttcttgcttgagtgagagaattagtgccctgcttccaacagcaatgttcatagagaagtgtgaaccaagggaggccataccgtgtcctggcagaaagctccagattgccccagagggaagtctgcctccatagaagacttctggtgagcctctggtcctgtattcttgcaggttagggacagtggtttcccacaatctcagactgttgcagagatcagggaatgggcctggtcttttaccagaaatgtgtgcagggcaggaactgaggccttaaactctgctggacggcctaaggctattaacacgtgtcaggcgccagcggcaggatcggtcctcagtgagcacttggatggtgatggtgactcctgtgaccgtgaagactgatctgtgtgagaggtacagagaggacctcgggaaggaaagggctcatatctacattgtgtcctgttgttttctctctcaaggtttcactctttttatactgaaaagtaagggtctcttccttgtcataactcataaaatcaaaatatttctgctctcagaacctcatttatttaaagatgttttgatttcctatagtaaggccacgccttgggagttagcatggtttggattgcgtcaaatactttgctttcataagtaaagctagtgttaccattcttatatttaaatctgtttatgtctactcagatcatttccttcatatcatttcctaaaagagttcctaggccgttgacattttggattctgctctgacgttggcttccctgctaaccgtagcccgtgttcttgaacatctggtgtagggggtgggggagagcatgggggccattatctccgtagtctgctcagaacttgggctcctctgcatgtaccagggaacacttggaacaggactgacctcatcccatctgctgagggaataaggcatcaggctacagggtaatgtgcgcggctcaggtttccaggagcgcccggtcacctaaggtttcctgctaagcagtatgcggtgcagatggggacaaggcaggctgtgtcggtcatttctccaggcttcagataatgctcggctatggtctgcctagagcggctgcagcctgggacctggtcctgaagcacactttgcagcattgaggggaggagagggagatgaggcgaaatcaattagatctttgcctgagattagtgtttatcacaggaggcagaagcctaaagttaaggatgtgtgaaagtaggcctatctaagctgtagaacaggctgccgtgtcctggctgcagactatgaagcaatacagcttcctcccagtgacaggaaataggattgcagcctccagctgattggattttagcaaagggtctagcttcataggcatttcaatagaaaaatctgcatgtgcatgtatgtatgggtacctatgtctatgtgtgcattgcttggatggtgtatgttactataaactatgtgtattttatagtaagaagacagcatgtgggcacttactctcttctgagaagtgggggatggttcccaggctgctatggggagctaagcaggggcttcggagtggaaggtgtgaggaggtgtgagggaggtgtgggccaggaggtggggagctttgatgtagtcgtgatttgtcgtcgctgtcaccagtaggtgacagtgcactataaagttttcactttgtcaaagcaacaaatgtggagcagaagcacaggtaaggattataccggcaatccatgaaagcaatttgtatatttccacagaatgacatccttcaaattaggtctcttcacaaaccgagctcagcgcctcccaaatctcaaccatttataccaacctcctcttacactttggggccaccacctcattatttgcatgtactgcttgtttaacacattttaaattgatcttaaagcggctcacttgtttgcacagcctcaactctggtatttgaagtgtctgaatacatgaattttgatgtacacattatattaccctgtactatacaataagaggctccactcagtaacaatgataaaaagcaagtatagctcaaataatgttctaagcccattgttatttcttctcatccccctaactggtaatcctataaggtagacactgagctgcaattcttaggcagataaaccgaggctggaggctttaagtagagagctagagtttgtcacccagatgtcctcccttttctaagccattttgtccgtgcaaggggaccttcatcagtttgtgagccatagaagtgaaaaccttgcttagctgagttacagaagtagtaatagccatctgtgccagcttccagggatacttcaggggcagttgagccatattgaatgagtttttttttaatatgcaaactgacaatctatagccaggtggcagccttccctcctgacccagcaccaaccagcactgctaaaagcagtgagcattcagtgatggttttaacatactgggccaaggcactctcatttgtgatcgcctctgaacagatggaaggaagtttgtcaactgtgctaccagacggaggatagcaaaggggattacagtttaagccccaggtctccacactggtcactgcacagccaaagaagaggactggtatatctgagtgaagggcactaacaccaagctgtaccttttcagggacagctattagaaggcagagccagaaggaccagagtgagcctggagaacctccgtgattcctttccaggaggctgcagattgacagccaagagtgatcttctccccagtttttagtatgtaaacaaagatgttgaaatgagcgtcttggaacaatggctctgagatattggtgtgcattacattgtacggagcctagggacaatacagatgctccatcttctccagcactcttagggacaggagatccagactctggttgctacagtaactcaaggtagaccaactacagtgctgatgctttgtcattaccaggaagggagtgaaggggctggggtgagaggccctgtagtcagagagagtagttctgacacctggagggcagcactctggcgtcctgttcctctgttttctcatctgtaaaactgatctttaataacagctgtcctggaggctaattaccataattaaatgagcccagtgcctgtaaagttcttgacatgaggcctagaacacagtaagcacctaataactgttgtctgtgattatgataattgtcaccaggctatagtgtcaccataccgttgaataggagcatagttcccctctggtcctgcagattccaaaggagagggctccagcatgggaaatgtggctgccctgctttcagaaacagctcccttaatgctcaagtacaaacacattagaaaccttggcagatgttgttggggttggtaggggtggattagggacaggaatggattcttgggcattgtttcatatggatcatgttaactagttgctgggattatagctctgattaattcttttagttcagctaatacatgctggaccctctcccagacaggctcagtgagagactaagaatttagcttatatacttctcatacgtgtcttccttgttgaaaaatggctgggaattcacacagttgagaggcttatgtaatgccttcctctgagcagtcagggctgcagcctgtgccgtttctcaggttgcctttggagatcctgagtgctctggacacacgtgtttgctttggcagatgacgtgtttgtccacatggattcctgttgttgcagaggctccagaacgtgtaatgtggctctttgtttaattatgtgtggtttctgtgtgtggctgaaaaccaaagagttgatgttgccattaaaactgatgtgtagaggacaaatgacgataaagaaagttttagatacgtcgttaaacagagcaaaggatattatagggttacatctgtgtgctagcattacgagagcaaagcagataatgaagcattaggtgtggggtgatctttctgttaaaagacaactattctctctctttccctctgtgtgtgtgtctgtgtatgtgtgtctgtatatgtacatgtgtgtgtgtgtatatatttatatacacatatatatgcttttatatattttctttattaaagaggaatgcatatttactatgtattgatgttttcttactataaagttctccaattatatcatctatttactgtctcaagccaatttataatgattcgtgatataaaaatgaggaatgcatagtttcttaccagtactccacagcaggataggcagcaaagttgcctctggggagagtccacttacctctaatccttcagttcccagcatagccattatgtggaagctctgcagttccacaggagtgagcttctctattgtgcctccctgcctcatttctatgagtcagttcacccctaggccagccactgtgccttctccactctccacaaaatctacctctgctgacatctccttcctttgcaaggacagaagtcattatgagcaccacagaaggtgtggaagccatacatacgctggccacacttctttctcactcattaaacccttgctcgctccatcagtcattgtgcaagatactatttatttaaacatattgcacagactgttcacaacaatattcttatcatagagcctctgaccgaatgagcaggaaatcagaccaccttgtctttccttctggcgtggtctgctctgctatcaggaatgaaagctacagtgtatgaaaggatctgcctgcactgcacagtcaggatgtctaggtctgagcttcccatgtacttgggtgtttcccagagatggcaaattcagaaactgctgtgcattcatcatttttattgcaaaattcattaggctgccatgctattatcctcctatcttgtcaagatgatgtattacagacttcattgcaaaactctaacaagcagaggagagtgttcctctctcccagctatgacacgagagtgcctctggggcttttgcttgtgcctccctgttctctgtgtaaaactctgagtctttgcaaagctgctgtctggtaactcccttttctcctccatgtttgagtgtggagaagggtggggttgcgagagttgtctctgtgcagagtcatgggtcctctggggttttttttttcttttttttttctttttttttgatgttgtggaaaaataacatgttagcccaaattttgacaggctgctgcagagtggggacatcctgtgaagcgacagggatctgtgtctcatgtttacttttcaagtctctgtgttcagaagaccagacaaactcaagcctgccaagacctgtgcatttggcgtggctctgtgataaacagaccccacctcctttgttggttggagttgccattagagtgaattggagtcacttagtaaatatgaggagtgtgggagcttagcttcctcgtttccatggcaaccccagaacaagtacaacatcaccaaaattactctgcggctttccatttttagttgcagtgatttggtctcatacttgtgttttctgcttctgatttgtacagaaaacatcaatgctgcccacagtcactagtgctttggtctcaaggtcccggcctcagcacctgcaaaactcagtttcacaaaactacctctctccattccaacagaagaaattctgattgcatattattctcttgcttaatgtgtgactctccatgggcttttgatatgtagaatgcaggagctattcatcagaaaagtaggtgagctctgaactcacaggccatttgaatagacactgtgtagccaggtagcctatgcttacacgtgagtagtttgtgtccttaaggaccaagtctatatctactgtcagtactttaaaatatattttcatgccaggcagtggtggcgcacacctttgatcccagcgcttgggaggcagaggcaggcagatttctgagttcgaggccagcctgggctacagagaaacctgcctcgaaaaactaatatatgtgtgtgtgtgtgtatttttttcataaaagcatccagcacattcctgattcatatttaaaacttgcaacttaccccatcccctcctccctgtgctctggcttttggtgactggtatacagagaggcattccctgagtacagatttgagaaaggagagcattctcaccaactctaggcagcagaggagtgccagagagagacacacataactgctggctgctctctttcgaagtccactgacatgtaaccccctttcctccagcaagctagatggcccagttctagctcctgacagggctccagagctggcctgagtcatgcaatgggaagggtggttcctttgcatctggagaatgtcctctacccttctgctttgctctcaggagcaggtacccatttgcccgcaggaggcggggcctcccgtcctaagagacactgagtcatttcccctttattccttaatttattccaaatgcccccaagtttgtcttggtgtagtttggctaaaccactgagacagacagtttgcttttgattttactctgggacaatctttcctttcctgtccactttcctacctactgtcaagactgtcagcctatcagaaaactttctcctgagaagtttctctgagaagtttctcctttatgattttggggttctgagacttctgctgcagtgtcaaatccacttccttggtggtcactaggggacgacacaggagttcttttttcttcttggtagtaagtccctgctcacttgccctgttagtccacctcctcctgcactcctcccttccctcttccctcacttctcttcccctcctccctttgcctctcccctcccctcccttccccactgagccacctctccagcccccaagggacagtggatttaaatgctctcaatccttaattgactaaaggagatccgagttcaaatgttcctctgtaaatgagcgtgttggtctgtcccttggagatagagcatgcctctaactcatatatgaaggctccagaagaattaatccacttacttcttggcaaatgaaataattgccagcaaaatcagttgattgcacttcagtatgtggagaatgaggggagagacagacattccaggtctgtcacatgctgctctgccatggtacccatgccatttagctgcatcatccccacatctttcaagtcttgtgtccaaggcttttaagatgagaagaaacagaaagttcttctctttgagcagtattccgatgtttataaaacacattcctgcatatgatccggcttgatccccaggacagcgtgtgagctgttcagggcagtcctcactcttcccatttcacagatttatccacacctgaggctgcagcaactcctcagtgattacaaacacgggctgctctcacggagattcaattccaagcacacacacggggccggaggaatctgtcagggcatgcgtgtgaggcactggttcatgtacaggcaaaacaaccataaacacaaaataaaaacaaaaaactcttaagctgaagaagaatctgaggtcccatgatatggatgagatatggatctgaggtcccatgatatggatgagatatggatctgaggtcccatgatatggatgagatatggatctgaggtcccatgatatggatgtccctgagggcgcattgccagccagagacaaacttttggagatacttcgggttcctcttttctgagctgatagtaattagtaatttcctaatataaatgcgtggcttggaccatgggttcaattttttttcgtattgtatttgcagacaattgtacaactcttatatctctgcttattaaagaattaccttgaagttaaacctcagatgtgtgactccaggagtaaacagatgtttctagggtgtggccatcaagttagtctggaaattgatattctgtattgatgtactgtagatttagaagtctatcatggccgaagctgtcagacaatgttaggggaaggggtttttgaagaaaatatggcaaggagtcaatgagggcctctctgtatccttatgatctgtaaatcaaaagaagtcacaggttaagatgaagtgggatgatagtgtcttaggaggagaaagctgggcttatactacaggcgaggtgacatcccttcagcatgagaaaacctttgctttaaaacccatgtgacctgttccttttttacctttcttttctcactctttgattgtttcattttatatttatttgagagagagatagaggaagggagagagagacagaagaagggagggagggagggagggagggagggagaagagaaaactggagggtataactgtgtgtctgtaaattcagcacagggtgatctgtccattcatcatgtgggttccaaggactggaacttgagggcaaatgctcttcctcgctgagctaccccaccccccagcacacacatgtacattgccactcttaaattgtatccttttctacatcccactttttgttgttgttgtgtggttgacttgtctgtttttgtcaagttggcactgaactcctaattcccctgcctctaccttccgaatattaagaacacaggcacatgctaccgtgcctggtgccttcgtactttttcaaagcatcagatattttaagttggtctctatatttctaaatcgttgtatgtgtgggagcaacctctccctatcctatcagcatccatatgggccctttttgtcgttttcctccccagaggagcagaggaacagcatcatcaactccagtttggaatcggtctcctcgagtgcaaacagcatccttaactctagcagcagcctgcagcccaatctgaattccagcgactcaaacctggatgtggtcaaacctagtcggcccagttcactgtaagtacgattgcccccgtcccctccccaccgacctccagcatctgtcctaccagaatttctccggcttaacctgattttgggttactgttccatgaacctgacttccaccttccccctgagcttggaacttgcctgatttgttgtggtttttttttccttaagcatcatcagcacaaaggagcgtcttaacataccgcttcttagccttgatctgtgacgcgctgttctgctgagatggctttgctgatggctgttgcctgtgctagctacgattttcttcagtgttacaacatcaaggaatttagcagatgagtaactgagtccgttctgctcattcgtgttgtctcggttttccatcccccccgacaaagctggcagggtttgatgctacttctgtgtctgcgtccatacagaagagcacttggtatgcagcagcctgtgtgtcttctcgttctcaaaccttagtataattgtaacctatgctagatatataaaataaaaggaacttttttattccatctgggactttgagcgtttgtagccaagataaagtattggggatagttgtccaatcctcagcagaaactattcaaccagggccaaaaggttctgtcttgtgacttgagtgcacactgctcagcatgcttcttagaccaccccgtaaatcctgtccgctagggtctttgcagaaagaatgtgagatttgaccagagcagctggatgctcaagcgccagccgtagaagacttgggaaagctgtcggcttcgcttttctctagtgaaaacagattgagcctcagccccaggctatctgcagggcagttgtttctcttggttcgacaccaactacaggatgacactggacagcagcaccttttccctgaccctcagtggtggtgttctgtgatagcaccccctccacttcagatatatgtgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccacccacccctacggtaccactccttccttggtcctctcagctccttcttgtttaaactggcgatctagcatatggttacagctattctttgcgtgctatgagcaaagctgaaactctatctgattttcccaaccaacgccaaccagtggtctttaatctttgtttctagcagctggtagctttggcccctgagtcactgagtacagcatgtaccaagagatagtttagcagctaaatgcaaaggggatatgtcttataagctgggctggaggaggggccttgggatatcctaagggcatctgtatgtaatttgttttttttatcatttattgggatcatttagcatgaaatacacagttattgattgactgattgatttcctagtctagattcagggtttttccagtgattggagaatgacatcaggaatagttgtacctgtttgtgtttagaagaaactggggtccaactctggctctatctcccacaagactgctgtccccaggctgagcgagtccctggctcatccctattgatctggaggttaggaaggcagatacagtggacctggcaccagggtaccaggcttgctcatccctatgtgaaggctgtgccagaatccctagaaactccgcagcaggtcattggccatttgctaagcccaaagcgtatccttgattcctgccctcacagcttctcagcctagaactggcctgggtggaccacaggtggcagttaagtagttctgacaaatggaagtcactgctttccttgagtaaattgtttctcagatgtctgtcggcgctctgtgctgtgctgcttgggctgggtcataacccccttcagttctccatccttgttccttctgagctgtttagagacatgtgatacagatggaaacaaaatgtggccagagtgggggcggaagattaccatccctctgcctattaattaggtataatgtaaggatcacatcaccaggaaactacctgctctttttagttttctcatcctctccccacccccgttttttcataacatgcgggttggtcatcatgaccatgtagaaatcataatgaaagaaacatgtgtatcgctcatgatctgttactcagatggcacctctagtatcccaggacacggaggccctcttgttggtgtgagcataaagctactttgaacatccaagtcagcattgccagcagtccacccgtgctaggacatggctgctatgtgtcagtcttgggcaactcctcacctagcttcctgcagtagccaggtttctcccgaggaccagagggcagttgataatctagcaccagagtctagctcgtctgcaagtatcaacaaatcttgttgagcctattttgtgctcagacctctgtaaagctacttagggtaaaccagaagagcagaattcttgcccttcctgaatttacactcaggataagaagggtagactgggcatgggcagagttgcatgagacttgcagctcgtgtcttcagaatcagtataaactgagtatctggtcacatccatcagatggaagtaatgaaaataaagaggtagagaaagtacgagctaggcaggtgctagggaaggtctaggtggatgggacaaggaagtccagttaatccaacatagactgacacagcctactgacaggtgtgctgtagggaaattgctgggttaggggaggaaattagccaaactttaaagccaagaaattctatatatttatagaatatagaaaaatctatattccattctgggcatagatattaaaaacaaaacattatccagacaccaatcttctactttcatgtatattaactacaggtaaattatagttctgaatataaaatgctaaattatgagtagcctagatgaccttggcggtggtgacttttctcatacagccccaaaggcatgctgtgtgaaggaaaacattgttgtttcaacttcctttaaactaaaacacacacacacacacacacacacacacacacacacacacatacacacacacacacacacatatataagctaagagaacaaaggaataaattacaaagtaggaaaaatttgcaaaacatgtatctgataaagaactggtatccaagacacacaaaaatctcataaaactcaagggtaagtaaacaacaaacacaggtaaaatatgggtaagaaatctgaaaagatacctccccaaagacgaatagtcagatagctaataagcaaatggaaaaatgattccatcatatgttacagggagatgaaagccaaagatactgtgctgtcaacacagccaacatcctggaacaaacactgtaagtgaggatggcagaggcagcagcttccacttgctgaacagggtagcatgttcacttgggaagaaacctcgtgtctcttacaaaattaagcaccctttaccatatggccaaagttaggcttcttggtgtttcaccaagctagatgaaaacttacagacacaaacatccacagggatttctaacagcctgattcacgattgccagagcttggaagcaatgaggagttctgtcagtagatgttagtggataaattgtgtagcatctctgccctgtgaactatcattcaacaatcaaatgatgtgagctggagcctgagaaatggctcagtgggtgagggtgctcactcccaggtctgatgatgtgagttctgagctaggaacccacatagtagaaaggagagggccaactctgggaaggtgtccttaccagcatgcatatgtgcaaaagtacagtaaataaaaatgaataattaaataaatgtaaaaaacagccttatgagaaagtcataggaaccttaaacacatattacgctgctaaagaaactagtctgggaagacttcaaaagtgtgataccaaatatatgacttcctgaaaaatacagaacaatggagtcagtaataatgattagtgcctgccagagatactgggagagggatgctctagtttcagggcactgacactatttgatacagcaccttagtgatggacacaagatactttgtatttgttcaagtcagtaaaacctgtagaacacagagggtgaatcctaaaggaaactaggggtgttaattagtaatactgtatcagtgttgcttcatccatcagagcaaggacattataccaagatgttaaaaactggagaaacctagggagtaaggaagagaagaaaacacaggtctacttgtgatttttttctgtaagccccacacctctcttaaaaaaaaaatccattaacgtatacattttaaaagtacaaattttcaacttgttttcaaaaggaatactgtctacatgtaacccctattaaacctgacaggaaatggcctgcttcactccttacccctctgtcagcctttgatagaataaatgagggccaggatctttgctacccttcttaaaagctcagagtccagactctgcctatgctagctgccccataggatgtgataaaatcggctcagaatgatttccaggccctggccaagatgtctcgtagctctctatgtcacgctcctgggagccagctagcgtgcacaccagtgggtctaaccttggacgtgacagcctatctcagaaagaagcccagtgtctcatctaaccccatccctggccaccagtcatttgaatccaggcacatgaattagtccaggcaagacctacagcaaagctgcctgtaggttagtgatgactcatgtgtcacggttgtattaaaccattatgtttaagagtgatttaataaacagcagtagttagctaatgcaaggcctgtatggttttatcacctagtgctgtgtggagctgagacacatggcaagatagaaacacgtggaaacattctagcttgtagcagggccctgtgtctcagattttagaatcctttaaagaaaatatcccataatgagattctaagacattaagaaacaaaataaaatctggggctaacaattgaagccaataaggaggatgattcagccactgaaatggaaataagaagccttaggtttcactccggcaccaacatagaggcccaaagccctgaataatacttacccttaattctaggcccttgtggagaaatggcaccagtacacatccaagaatgcaggttactcccaaaggaaagccacatccttccacagtgatcaagagagctggtatctgcccagggcctgtaagaagacagtgacgtgtttaaagggaagcgagcaaatattgaataaagtagtacacacaaattaatgccctgagttagcaactcctaggcacatgcttctcaggcagagggagaagggtaagactgaaaaggccttcaggctggtctaggcattttggccatctaagtggtcctgactcccgtcccccaaaataactcactggccagtaacctcacaagtaagttcctttttttccccatctttcctcgtaacacacgtatacatacgcatttcctaattatttccattggcctaaaagatgtgcacattctaaatacttaacagagtccgtctgccagagtcagctgacctcatgtagtagggccagcaagccatgggccagggacctctggagaggatcctgtagcctgcttctgggtagactgtcttctcagaagcactccaggctttcctgccttctgctccgctgtgggaggaggcttgctggggagaaaccttaacacttgaacttagcgtctgttcagttggccacccatacattcagccaacatcagtgacatcaatgacgatacagtcatttacaaacagaggggcagggaatgtcaagaagagacagcaagaacagcagagtgtgtttagcctgtaccaggtgctgggttcaataccagtgtacccctcccctgaaataaaaagcacagccatttctggttctgtgggctttacattccatgggaaataaatagagacaggaaaaaaaaatgagttctgtgaagaaaacccacagagagtaaaggagacaggtttgaaggacaagaggaaagtgactttgtctctctctctttctaagtttctacatctgaaaaataaagtgattttaccctcacggaaaggtggtatgaatgttagcgagattgaacttcatattgaattcctaccttcctatatgagcatgttggtgtaaatattactctggagcctctgcacacacagcctgttctctcacactttagttttgtccctcattgttttgctctccttcccccagcaaccccctgttcagaatctgatcctgtagggagggccgaacaccttaacctaaggccttggatagacactctttttcctgaaaaaaaaaaaaaaattaaaatcttccaaatcccatgggctacccagtgagcgtgtgcataactgctgttagttgaaaccaaatgattcacaaaatgaatcacgggcattagacaaatgtttgtcaatggtgctttttttttttttttaaagagactcttatcctcaatgttgttgtacgccaagatagttacactggaatggacaattgtggttttcccaaagtggtgttgttatctacattttggattgtgagctttggagagaggaattttcctctggaggcattggcctttggtagagaaagatctcgctgttagattgaagatcctaccccttgtctatgtgcgggcaggaagtgtctctgcagacttctgcctgcaaaaaaatgggcaatgccttgcacacggagcagccttttcctggtgactcccacttatgccctgctctatctgggacctatctgaaactttcctctgcttctgtgagctcctgcggctgcaaaggctataaccccttgagtcagattatcttggtatggctagagaaggttactggtgtggcctattgcctttttacaaatcatcttttctcctatctcctttttctgttttcctacataagatatcgccccttaattggaaattccgctgagcttcccttgtttagggtgtacccctctgcctggttggacccatctgaattttatgggtaaatatcttcggttattagctggtcatcacttctataatataaagacggctcgaggcagccatcacacttggtgacgcagcatttctttcccatgcactgggcagtcagaacatttggatccctacagcctatcagcagaggggtgtgggaggggctagtgggcactgggagggtgcccaccacatccctggtttccaggaatatgagaatcagaatggaaaaacgcttcacctcacacatattcttttcttttctccattacaaactaaaatatataaagtatctgagtcttttctgtacttactaatctgattcagtcatctaaaataatttcccaaatttgccttgacagtacagtgcatgcttcaaacttcagggtttataattaagagtctgaatgaatggattttatctgagttagctgtcctcagatgccttctggcactctactttgtgggtatgtgggtgttcagaatctggagaaaaggattgtcctggctctcagcacttttgtacccttgggggaactttgaaggaattctgctgtgccttttttttctcacttagggttaatttggaataattttttcccatcatatatataatggggatgtcttaagtagattcagtctaccttgtataaactaaattacattaaagttctttttaaaaagaaattccaaggcagatgcttccttggacagagtatcaagcccaggatcttgtttccatccccttccctgtgttaaggagatcttaagctctgcaggatcttccggaggcttcctttgatctcatacacgtctcctagaacagtcttagctctgtgcagaggcccacctacacaggcacctaccccagacctctctgctaaaggtacccagcagtctctgcttttctaagtctcagaggtatctctgaccttgctagactcttgagaatcaccatgtgcagtaacagagggcatgcggttacctgacttacatgaaaataaaatcatggtttagctcattgcaaagctcttggttctaagcctgaatcatacctatactggcacattgcctgtgcagggttgacagtaatgggctttgtaaaaccttgtaccctggctgaagtcagtacagggagggtactctgaagtcagtggtaaagggagggctggactgctttcagaggaactttatttggtcatcaatgcagtattttctgtctccctaaggatacctagccatccaggttcaaatgactgcttcttgatcatagagagggtggatgaatctaaacagatccggttctcttcactgatccttcactgtgtgtgacatggcattctagtattgacagaacagttctcatagtatgcaattctaaaaaaggtagcccccagtaatcatggacagaaaatctgagagccaatgtttcccaaattgcaggaaagggtagagaatgaaggaactgagtagcttctgtctactcagaggtcaagcctctgctctgccattttctgactgcaaagttgggcacattatttactgtttctgacctaaactttgtctgtgaactgataatggataatgcctaccttcagccaggcctggggacatacacctttactcccgtcaatggagaagcagaggcagatggagatctgggagttcaaggccagcctggtctatataatgagttcaaggtcagcctgacctgtatagaaagtccctgtttcaaacaaacaaaaagaatgcctatattcaaggtagattaagataagggataagtctatcataacaataaattccatggttcaatgtaagcagtcattacatatcagttgctggtataattcatagtcagtgagccacaagggatagtatctgtggcagcgtgatggtcccagattatattgcctagtgacattgtacatcataggtggcatcacttagcagtatatttctcagaacatgtccatgttgacaagtaatatgacaagcaacacatgcgttcttgattttgttgttttgattttttgaggcaggatctgatgctgcccaggatgacattaagttctgtatctccatagctgtgattatctttatcctcctgtttcccaagtgctgggatggtaggagtccaccaccactgccagcctgacgttttgaacctcgccctttgcctttgccaacagttttcaagcattgatttgctcagtagtgacaggtgcatgctctgactctgatgtgacacaaagaagcccagactaaaaatgttgagacaactttaaaagtgaaatgaaatagctaataccagattaaatgtaaataataaagtacaatggaatccatagaaacacgccattacaagataagctttaaggtatttgtacaaagtcagccaacagatgtatgtgtttccccagaggagccttgtcaagccacctaccatgttgtttctctgggtagagccaactggaactacactaattaggttagaaactaattgcagtctcaagtcttcaccagggaataatttagcctcaggaattcctctgcagcttctgactctgtgttaatttaactgccattatggcaaaaagcaaaacaatttgtaaagaaaaagcattctaaactgtagggtcttagtcattaactcattcgtttctcttccagtgcttcccagctcccttcacaaggaagcagggtgcttcccacagacattgcctccaaggtaccacaaattctctttataaattgaaggcagctggtggctccatggatattgtcaaaaatgcttgaaagagtgataaaatgattgcgttaaataggaccctattgcttctacttgccctttgtacaaatcgtgtcttcagggaaaacggattatatcatccacagagagagaaaggtagaggtgtctgtccaaggaagtgttttcagtcctaagaagagatatcaatataattaaagcagcacaattcagggacaggctcagtaatggccttactgcggaagagtcacataagatagtacagagcatagtgatcaccaaccagtcaccaccctggggctgaggggacaggatggacagcagtacctgtgatggttagtactgatgatcaacctgacaagacctagaaaagcctagaaggcacacatccaggtactgtctgtaagatgttatatagtttaggttaattgagatgggaagatccacccagggtgtgggagaggtcattgcataggctgggatctcattggatgagaaggagaaacttaattgagtgttagtataatcattctctgcttcccaactcagatgtaataacaccagctgcctcaggctcctgcctccacgattcaatagacagaattgaatcccccgctacaatagacagactgtataatcaaattgtgagctagaataaaccctccctccttcccttcctctctatctaactgccttcctcttacatactaccctattttcctccttcctcatcttccccctccctccttccttctctttttctctccctctctcccttcttttcatttcttttgtcgggtattttattacttcagtgcaacagataactaatacagtatcagaacccagaagtgaagaaagttagatagagcctcaaaagggacagagacctatttcaagggacacagcaaaaagaaaattacttcaaggaaccagaatacatgcctgggcactgtacttcctctcctgatagtcttccagggggccttactggtaaacacaggaagccagagggtcctaagctctactgctgagatagatccatgctggctgctcccagggaagactgtagaatggagaaggtatctggagtggtgactcacaccatcagcatggttgtacaaacagcaggagcgctagcagtgaaaggtgccagtacaccaaggggtagaagcagccagtgaaggacagggaggcagtgcttgttgtgtgtagcctgcagaggtactcagtgagaaggaggtacagaaccagatggctgtggcttataagccatcctcctagcagcatcaccttagaatccttagatgaaagggtaaccaacatggacagtctggtcctatgccacagttagttggtccattaactgatgtgggtgggtcttacgtgattttgacatacacctagatttgaaaacaatttacaaacgttatgtaataggacttaggcaagagcccacgggtacagacacacacaggtatatgtacacgtctgaaatttttctgggaagatacaggggaatggatctgtctggttgtcgcaggaggaagatgatgcagtagaaagaacagcttttcatttcaacacttgtacatggtgagcaaatatattttcatgcttgtgaagcttggtactatgtcattataaggaatagctctgtttcagcctttaaactctgtgagcgacgagacaagtaaggagtttgaacactgtgtcttgtaccagaaaggcattgttctcagggtgtcataaatgaagttcagcccatcgagtcattctcccaggggccatgtgacttcgctctcgggctctaggttggtaagcagtggcttggaacagcacaggaactctgttatggggaaagccgagtgagtgccctctcaggcagttatgtggagtggattcagttttacccctgttgcaaggctgtttcagagttcacgctcaaaccgggaagctggaacttagaaaagtagaaggtatatttcaccgtggcagctactcacgaagtccctcacaaggcctagccgacactgccagatgcaagttgttcaattatcttgagctatatatagcgctttcactcgatctgtctttccccatctatatctacccaatttcctctaaaaactccattttgaagttgaatatataatggagaaagagccttcactcctgacctttatggagacaccttagagttactcaataatagtcagcggttgccctggtaacctcagacactctgctcacataacctgcattcatcaccatctgccgccttcagcgccgtgagatcacctgcttagtgttaatgggaagaggatatttcagtgaggtttgaagcctttcagcttcccttgtaggaagagaggcggtgctgcctgtgattactcactaaatgatttttgttttgcttccttcatgactaaggcactgccatacagaggaaagcagcctaggtattgagcaaattggaaagtcctgttcatgatgtcttgttgttcagcaatgaattcacaagctgagatggtctgtgtgggtggaacttgcagtctagaatgcagggtgaacaagtccatcctcgcgccaatcactggaggcataagtagggcccactaactcctctactttggcccaaaggaccctgcttcaaagttgccaaagccaacgctgaggcaggagagggcttcttcagaggagccagtgagttccaccatctcagaggaagcctgtactgtgtagcattcagaggctgtgcctcacactgcagactctgctgcagtaggagcccagtgtgactctacctctggaggagaggcagtccctcatttgcacacatcctcttttccagtcttctttgaccccttgtgtgaaagtggaattagaattagtcatctcagggcagtgctcacagtgttcagttgtcatagtgaaaacaaactgtcaggaatccaggaagaactgtgggaatcctgaagacaacacccgttaacagtggggtccacatgctggcaactgatgcgattgacatgatcatcatagacagtagttagacttcctatgtcccctggaagtttacattattttatccccccctccctccctccctccttttcctctccttatacctctcctgttgacctccacccccacccccaagttgcacttgctttcctttcatgttatttccctagaatgcttattttcatcttgccccccccccccccgggagaaggagcaagggtgtttgctgatgtcttcttactacatgctagaacactcactagtcgagaatctgccaggtctgacacacagtcagttcccaggaggttagacacttactcagaccctgttgctcaggtcactatttcaggcttactctcatttttgtccataagaaaattcccaattaatatccctcttctttacacctagttttgctgttccatcctgagtttcagcatcaatccactagatcccgtgcccagagcagctagctgtgtgcactgtggtcagtgaagctgacactgcttgctgtttctctttgcataccttcttgacttttccaggttcttcttccgcttctaggaatttcagctctgtaccagttccaggggcaacacaaagggaggcttaataaaaccagccctgagtcactccttcaaacacagccagcactgaacctgagcagagacttgcttggctgtgacttgagtgcccctgttgcaatggcctgagccagctttccaccttagtccctgtttttgttttttgtttgttgttgttgttgttattgttgtttggtttgcctctacaagcaagctcatagtataaaccaccaaacttggcacgcctcctgaaggattagatctctatgtgcaaaaacattccgagaaacctaagaccctcacctaggatctgaatatgtaatgtatgtattggcaggaggcaagggagcagtgtgcacgagttcatgcagactcaactcctctttgtgtgttgtcttacgtttcactgtgctccagagtcatgtagaagaaacacaacattttgaagtaaataagaaaaagaccaaatctttgatcagttaagctgccccgtgttttgtcacctaaggagacggcgccacttctctgtgaagattgctttcctctgtgtgtgtaactatggggctggcctggctccacccaacacacacaaccctgaaagggtctgtgcaaagctggggctataaccaggacctcagagagcatatgagctgatactgggtggtatggtggaccagagatgggaagggtgctcagctgtttgtcagcaaggaaatttggggagcaaatacctagaagaaagctttatgggatttcatatatgtggtatgggaggtgacccttcttctgggtcatcacttaaaatacacagtttaaaaaataaaaaaaatgattccttgaggctgggaggagaagttacttgatccagtacttgccacacaagcctggggaggacttgattcaatacccagaacccacataaaatccccaacttcagcagcttgtaactccactgctggtaaggcaactcagtagaatcaatggggcttgctggccagccagcctagcctattcagagtgctccaggtcccagtgagagcctttctctcaagaaacaaaatggaaacaggtcctaaggtgacaccaaggttgacctctgttcagcctgagatcaccccccccacacacacacacacacacacacagggtttccctgtatagctctggctgtcctggaactcactttgtagaccaggctggcctcgaaatcagaaatccgcctgcctctgcctcctaagtgctgggattaaaggttgggctttttaaaaacagtgtatgatgccagatattgaacccagggcctcacatacgttcagtaagtactgcaactaagggcagcccagcccagacttgattcttttttctttcagtcattcagtatgtaagtgcattcaggaacactttattttacagtgcttcgacgtgcagataatgcatttgcttttttatttggtttgttttgttttttagaaattcagggtgtatggtcaacctgttcacaattatcactatgataagacatcatgaccaagttatacagaagttagagaacttacgcgagaacttatttggggcatacagtttgggagggtgcatttatgaccatcatggtggagacacagcttcaggcaagcaggcatgatgcttgagaagtagctcagaacttatatcctgaaccataagcaagaggccaatagctaactgggtgggtgtggagtgcgctactgagacttcaaatcctgcccccagtgacacatctccttcagcaaggctacagtcactaattcttctcaaatagttcagtgcccccaagacaccaaggttgacctctgttcagcctgagatcaccccccccccacacacacacacacacacacagggtttccctgtatagctctggctgtcctggaactcactttgtagaccaggctggcctcgaaatcagaaatccgcctgcctctgcctcctaagtgctgggattaaaggttgggctttttaaaaacagtgtatgatgccagatattgaacccagggcctcacatacgttcagtaagtactgcaactaagggcagcccagcccagacttgattcttttttctttcagtcattcagtatgtaagtgcattcaggaacactttattttacagtgcttcgacgtgcagataatgcatttgcttttttatttggtttgttttgttttttagaaattcagggtgtatggtcaacctgttcacaattatatcagccaccactgttgtccagtggctcatatgatcatttgctttctatttcacaacagagttctgaactaagctatgttttatacaagaattgtttgtgtgtaataatactgttacaagtataataagctacaatgtagtataaacaaatactttataagcactagataaccaaaatttttattaacttgtcatactccagttgtctggaataagacacaaagcttattagttactgtcctcactatggtaacagggtgcccaacaagaagcaacttacaggagaagggtttatttcagcttaacagtctgcatggtggcaggaacacaaggcagctaactggtcacattgtatcagctgaacaaagaagagagagagatgaatgctgatattctgccagctttcttctttttatgtagtcttgagccccacccagcaggtggaatggtgccactcatatttagggtgggagtttccacctcagttaatgtaatctagactatccctcaaagacatattcagaggtttgtttcttagatgactctagatcttgccatgtttataattaatgctaatcgtcaggctcctctgtgtgtgcttgtctgttaaagataagtttgatagggagagagcctgtaacaggggcaagataacagaaatataaaataactaaaaccaagacagatgggaaggtctagattcaggcaggactgtgagctaagatggtcaaggaagactttatgacctaatttgcacttgaacttctatcttgaaagatggattagcttcagaaacaggacagcaatgggaggttaggaggcaagcacacatgggcgtgcacacggagctgctcccagctaacttggagcatgtgtcatgcctatggagtgttatagttgctctgtttctcctgtcaagatgatctttacttccttaggcaccaagtctgggagagcctagtaatacagtcttcccattccgggtttcatgcaggctggatcctcacagaacatcttctctcaatttatcttatgtaattgagttgccggagatgttccctattttcatcacagttttgcttcacagtcaaataggtctaaccatctggaactgttttatttttttcagcccatattttctcccacaaaagcctgtttctatttctaagtgtcacataaggtcctgtgatacactccttatattagttaacttttctgtgataacagcatgaccaaaagtgacatacagacgtttattgtggcttacattccagaggataagagtctgtcgtggcagggaaccatgcaaacagcaggcacagcagcaggggcagggagctgagaaaccacatcttttgctagaagcacaaaggaggagggactagaaatagggctagcctatatcatctcaaagcccaccccagaggtgggctttctccatctaggctgttcctcctccctaaacagcaccacacactgggaaccaagtgttcagatatctagtctatggaagacatttctcatccaaaacaccatagtccttaatccactctgctctgagatttatattataaaaagctaagtaagtatgtttgaaaagaagctgtcttgcccccttttattccatgttactctgtaagcacatcagagtgggtctgacacccgaagctttccccaaggactgctttccttggatcaggctgtctcagaccagcacagctctgaggcaactggagcaagctgggttcttcatggcatcaccaaggggagagtataaatagccttacagaaaagtcctgcttatttttactctgtagacagaatgactatgtttagccttcagttactgggagaaacctgcagaagtgcactcgggctttattttcatttcagttggtaacacccgttctctttctcaaactgtaagtgaaccacagagagtgtattccagacagtcagctagagctaacacagtcacaaagtgccatgtgctggatgaagtcacagcctagtcccctgctttatgaatgcctgctttctctctatatccaagaccttcctgagtcctaaagatatggctcttccccacgagtttctgaagactgtacagtagtctaaacctgcctgatgtggcatatttttaaagtacaggcaggtattataatcaagacattttattctagcctgggcaaacttactaactaggatttctagttgcaattgacagcacacctaattcgataacttagacttaaatgggacttactgccttgcagaagtgctgagcacagtaatggctgtattccagcatggcacaggcggggacttgggtgttgtgtttaggaaccagctcctgccatcttgctcagctctcctctagtttacttacctcttaaataagttttctcccctttgattccaagatgatcgtttccagctaaacttccacttaagtctaagtccaaaagaaacgatggaggctctcattcctatagtgagaagagacacatggacaaatattttacacacatctcttagccagtctctcatcaggagtaaggtgctcttttgttctagatttcagttgcacatttgcccttggccaggcaggatggagagggatgtcatgcccggcctatgggctgtgagaatggggaaggaaagtgcaccattccacagtgggctcttcttatacctatctggtgaaggacatgttgcttttataaacctagtaaaaatctgtggctcccttccacaacccctcagtgccccttgcatattctttgaaaatgtcccctttttgagtccacatggttgtttcataatatatttcaagttttatccttgaagaatatgttttataagttaaggcagtgacacctttttagccttggaatcagttgatcatttaaagaacaagtgtcagggagcaggcttttattaccagtacctatcacagatgattagatagaacccatggaaaacatggtgtccttagtcaggccactattagtcttaatgatagtattgtcatcttggaattgaattaatagaggaaaagaagctgcaaaggacctacccttctcttcagtaagagccatgggcttgtaggagcagtgtcttgttggactgagtggttctgggaactgagtggcaggcagatcagcagcggagttttctggatttcttccagaaacaccaggacagccaaacgccagcttatgagctacatggacatctacaacacgtggtgacattgtctaaaacctttgagcatgaatcagaactgactctcctaccaggatcacattgagctgctggaaaattccagctttgtggttggtgcctggttcatacctctgagaacagacttttctctctgtagttgaaaccaagtctccatagagagaatgctgaagactataaatatacgttcactaagcaccagtatgtcaggcactttgcatgttcttacttaatcataataaaccatgaagtattattttaatactcttttacttataaggacataaataccaagacattatatatgagagtacacactgggatcagaacccgggctgttcaggctgtttgagtccagtatccctatccttcagttagtgaaggtcttggtggcattctaggttcaaatcctactgccttaccccagcatacctcagccagcaccttgattgctatgatgagatggtttgggtaatgacaacgactgaactgggtcatgtaaaggaaggctctaaagcagcccagatttgctccctttcctcaatcctccattttctggtatctgccagattcagacaatgaagcaagaaccagcaagaacatggaggatggatagtgagtagcagaagtgtacctaagagcaagccaaccagctacaattcaagagaaaaggatgggggaggcaggaaatagccagactaagcaacaacaaaggacaaagactataaaggaggaaatgaggcatccaaggaggaaagagagtgtgcttgctgtatgtttactgaccatcccctgttgccaagcaatagtctacaagttttacgtacaccagccacttcatcttccttagccctgcgaagtgcacacctgttatatgagtagtcacattttgctgatgggaagactgcatttaagggggacaaaatgcattgtccaagactacagagctgggtggcagagagagaatttgaagccaggcctgtgtatccctacctaccaagtctcgtggagtcttgggcaaatgtctctcctcgccatggtgtgtggccccagatcctgagatttgacaggtgtagacaacagatcagtccagccctgcctgtgcagagctaccagggcttcctctatcccagggaggggagagagaggagcacactgaacagcaatctgtttccaaagtttgacagtgaatagagcccagggtccatacttggttgctcacctcccctgcagaatgcattctctgctctcagaaaaaccatgttttcatcccaccacctgtcatgaatgagcacacaggtgtgtgcacgtgcttgtgtatgtgggggggggggtgagggggcacgacacaaagatcaccctcaggtgtcatgtggtaagacactaacaaccttgttttatagacagggtctcccactggccagaagttcagctggtaagcccctggaatctgcctgtttccacttatccccactgctggaattataagcacatgtctccatgctcttgcctttatgtgtgtgctgggcatcaagttcaaacagccacacttgtgcagaaagagctctactgactgagctccctccccagcccacaaactgtgttcctcatgtgcaggagacttctctcccatttctccatctcttccataaaataagtaaaacctttctctgaagagctgaccatctgtctggttgccactgcttccttccccgttaagaaggcacagccttctctctgctgtaggaaccatactggggcccactcaccacattcccattttatggtaggctggtcatcatatttattgggaattgaagttcatttcgctccctttcctttcttttagttcttggaattcaaatgtccctgcatcctcggggctgaactgagttcagcatgcttgataagggatggcttactgcatgggcatcatatatatttcaaattctgcccatcacagtcacactcctctcttgccagcaaaatctggggcagcactttgaagatttgcaaacctagtctaagtatgggcatttgtttgctatttcaagtctttgtgtgctaacaagttctatatgcgtgcgtgtcactgcagcgcagtggggtaacatgcgccaggtatctgttaacaactactttctgagaattgttgataacagcaacaacagcagcaacagcgaagttcaggagcatgggatctgttactctttttaaagatatatacaactcagtaagtttagaattttttctaaaagtgaagatgaacaggctgagagagaagagaaattcagtgtaaatctgtctgagccacttagctgtcatgaagagaagggggtgggggtgggaatatgatgggatgtaccattcaattatctgttcaaaggaaacagaacagtctactcacttatcagtttgttatcagagggtcagcatcccccttacacagaactatctaagatacagccagggggaaactgaccacccttcatctggacccctttgcatcctgagtccatctccctgaagaattttcttgtttccccaaagaagtataggtgcaagtctctacaggcactgaatgcttgtgaatgacaaagcagtcaaagtcttgaatatatatatatatatatttgtttctcctatagatcatgattataagtggggtgtgatgttaaatagtgtctagatagagcatgttgtttcctggttgtgtgtactaggtggagggcagattcctcttacaagtgtcatccctctagttgcccagccttgcttttgagaggagctatgcaatcactggttctaagctgagtatcaaagaagtgataaagtgcaggcatcatgttattggctgagataggatgccagaggcatacatctattaccaaggaaatttgcctaaccagaattcttgtttacatgggaagcacttcaccgagcacttcccagttgtctacagagtgccaccataatgataagagcttagtattcagtgcctgtgaagacttgcacccaaacttctctggtgaaacaagaaaattctgcagggagatgggctcaggatgcagaggctccagaggaagaatgttaagtttctacatggctgtatcttagagggatagtgcctgtatgaagggggatgctgtagcagaatagaaatgcagaaacattgacaaggagacagaattattgggcaccagggatctctttcatccaataggtgttcccaaaacatggagtacaggagcagagtcagaaaactagacaatcgccccagactagaattcatagtagttgtatctgtaggtagaccaaattgctcccatcaccaagctggctttattaataatagttaactttttttttcagcactagagaatgaaccttgaaattactaggcagttgctttattaatgagttacatcttccaacccattttgcttttaattttgcaacaaattttcactaagttggatttgatatgtacctaggatggactttgaacttaaaggatgttttaatcttttgcccttagcttcctgtagtggtcttcatgagaatgggtccatatgcttatgtttggttaccttgctagaactatttgagaagaattagtgactgtagccttgctgaaggagatgtgtcactgggggcaggatttgaagtctcagtagcgcactccacacccacccagttagctattggcctcttgcttatggttcaggatataagttctgagctacttctcaagcatcatgcctgcttgcctgaagctgtgtctccaccatgatggtcatgaatgcaccctcccaaactgtatgccccaaataagttcttgcgtaagttctctaacttctgtataacttggtcatgatgtcttatcatagtgatagaaaaataaattaagatacaagcgtgcaccaccagactggactaataatggttactgttgccctgagccattacaaaagtcactgctttagtaactaaagtcacagttggtgcctacatgaccaaaatactgctggtcttcctctgaggttgttgtgggaaatattaaaaagaatggctagctcccacgctatgcccagctactctctgctcaatgttctcgcagcctgtagctagtcttccccagttagcagtcttcccttctccagtttgcctgcctcagtgccacctgtaccttctcagccataaaccccctgtggtcggtggtcccaaactccagtaacccagtaaatcaaaactctagaagcttataattaatcagtcagatttatatatcaataaattctcaattcacaagatgcccacacaataatttcagagccaattgataatgatacaggctgcccacctaggttagacaagttatcccaatattctatcctcttatgatatacatatctacctgtggccatttaaagccacgtggactccagatcatcttcctctccttctatcgtcctttcttctgtccttccctctgtccccatctctgaaactcttcactctgcctcccctttccctgtccaatcacaggcttcttgtattaatatttaaactgattggacagagaaaattctgccttatgtggaatcagacataggaaaagagagttgtctttcctacctaggcttttctactgtttggaaatttcattgactgatatcatagccatcaagagtaatagattaatataaaaattaaatatgagactacatactacctttaaaaagttgaaatgtattattttatatttacaggtatataccgctgtctcatggttgttggttatccttcataagagtatcttgaatccgtggtttatcaccaggcagccctgtagcaatataggattacctaggatccgaagtaattggagctctcgtccaaatatttgctgatagacaacctctgagttcctaaacaagtgagcagtaaagtcccacattgcattcctctgcctcgtacctgtcagagacagataagtacacatgggcagcttctttgatatgtgtccaaatccattatcagagataagcaagcttaagtacaaccccatgatttaactacatttcagatttggtagggagcggcaggaaggatcccagacagaacccaatgtgctcagaatgcatcggttgctccagctccccaaaggcccccttccccaggtagggaaagagcctagaaattcctttcagtcttctcttcaagacagctgagatgacctcagggcccagctttattttttggtggcttacaaatggctaattgtagcactgtgtttaccactaaaaaatagatattaatctaagctcatgcttgcagttggcaaaatttctaagcaggtaagattagcaagcataagtcaaatgcagggttgccttcaactacagaatgtggcatctgaggatggtggtggactgggtgctactgtacctcagtgtagcacttcagtttttcttttacaggtcatcaatacttccagaattgttttattaaaaagttttctttcttgccagattttgaatgtttactagaaagggctggaaaaaaatgagacatttcttctcttgaagaataataaacaccaaaatgtaaaagatctgctgacaaatacccatctttgcctagactgtgcagtctccccagccacgctgccttcacccttgtgatcagagacccatcttggagacagtaggactcctgccagcagtgcttagccttcacctgggagattcctccccacccaacaagcacccgaggcccaggagtgagtcccaaacactctgataggaatgtctctgaaaggattttgtgtcctcctctggtttgtcttctgggaataacatacccgtattcagaatctttaagaagtcctttcaccactgggtataaagagctgggctaaaaatgagaagttgcttagcttagccatagggtagcttagagaaagcctttaagtgttcatgttacaaggtgattggagagacaattcattttggaacccggggaagggatcctttatattagagttcaacataagctaagtagcatggtattaggcagacgtctagagtttgcatgggactcaagtgccaacactgtagtgcaagctgccaccataaaaagactcagctggttatcatccttatgcaatttccagctcataaacttagagtctacagatgcttataggatccagcatgcagagaaaattacatattgaaagaaactattaactaatttcatggaaagcaaagaagcgagtgacctctaaggtgggcacaatgttggttgtaccattacttctctgtcattatttgagaaatcatttgccatttgcattccatctagggggcatataatttgggtggcctgttagttctgttgacctggtgtaagtttccttgtcatattaatctccctgatatctttttttctaaattgatcttcttcacaccaggagccatttttgtctgtctctgtactataggcctcacattttctatactatttgttgaatggagaatgtgttcatgactacatcacctacctttagggtttagatccatgaaatgtatatgggatcccctccccaatgctagcaggccatgatatgcctttacggaccacaaagagtctagtgaggatgggatggcctatctgtagcatggctatgcctctaagatggcctattctgtagtatggctatgcctcaaagactgtatgcaactggcccacagttcccttggaggttagagtccattaagaagcaggttaaaacttgggaaaactgctagaagacttgggatctgactgactctgttgtcaagaacagtattaatgctacaaaaacctattaaggtacttttctggtttctgtaactccttcgtagagagtgttccgcctaatgtttccattaacctcagtcatagccctggctgtgctgtattccacgtgcctgtccccttctttggttactggaacagcacatggacatttcatgtcctttgatggccagttacatcttgtgcacagtcatagcctggaattctctgcttgaacctggaccttccaattacaggttcaatgttctttctgctgaattggcaccaagaaaagcagccttgtctttattgtgtgaggatggaaatgtaggaaactatgggcccatctgaggtttttctctctgtactagcctagccttacttcattcctcaaagacccctggagtgcacctggcgggtgtgtgtgtgtgtctgtgtgtgtgtgtctgtgtgtgtgtgtgtgtgtgtgtgtctgtgtgtgtgtgtgtgtgtgtgtgtgtctgtgtgtgtgtcctgtgtgtgtgtgtgtgtgtgtgtgtgtgtgtgtgtgaatcatccatttcctttcccttggttgaatttgatgttctcttcagctccatcccaatggacaggttgatttttttttttttttttttttttttggtcactaaacaacagctacccctgtattccaaatgttccctctacttcagatcctgagcaggaggcttcacgtgcactcagaattacccatgggagggactctattggtgaaaaggctcttaggtggaaaggctcaggagggccatctatctggcacatgtcactcagcttgtaagtggcagagctggaaatcctcctaagactaactggatgagtgttagctgtttaggtagctcatattctcacttgtcttataagctaccctgggactaggaccttacaacaatgcaatgttctgagaaagcagactgtggtgccttcctgacgttaggattatacaggtgagtgactaggtggaagaagagaggttataagtctgtgtgaaaacagtagccatgccagctctcaggagctgccctgggccacctaggccatatgctttccatgcctgtggccttctcgtcagctagcatggcagctactcccaaatgctgtcctaggacccctgaatcaccttttaagacctgtagctcagctcacagggaggagttggagttttcaactcagagctgttgagtgaccactttagccaatacaggaggttttctggacatcatattttttattttttacttgagctaatttgcttcaaaatggccttttttagttcccatttttcaaaaatctggactcatttccaatgtttggtagatctagtcttaatgtatcatcacaagaaagtcctgggctaaatacttttgatccctttcttgagaataaatacaggtatctcccctgtctctctatcttccagcttaatctacttgtctctacgtactcattcagtggccgttctcttcactgagatctccatgaccccgctgttaaacctcaaagaccactgcagcccttttcttgatttctgccaacactgggcaccattcactctctgatgctctcattgcttgcttgttggctcgccttctattactattactattactattactattactattactattactattactattactactattattattattactttgctgcctctctgtctcctttgagggttcctttgcccttaaatgttatttcttgtagtatagtagtttattcttctatgtgtttcagtcaggctctctctatgtagcccaggctcacgattctcctgcctccacacctcactagtgctggtctttcaagtgtgtgctactacaccctgtttaggggtctggtttcaatttttctctggactgatttcatcattttctgtagttccacttgccagcagtatgcctactgtttgtacccagaccttctgcttgctctctagacccatatccaatggcctttgagcccctcccacccactatcatcattccctcctcctctgctcccacatatgttcttcaccctgtttccatgaattccgactctctacctgatgccgagaaacctgcccaacttcctgtactcctcactaactgagtgtcagtgttcaagaactgtcaaccttgcctctgtcttaccagtcacctcgacaccatctctgctgctgccagcctttcccaggctcgttggagtggtcttcctgacctgtgctcatcctgtgtggccactgtgacgttggtctaacatgtgcatttgaacacattactctccagcattggcatctccagtggcctctagcgatcctataaactcagtgaaccttatattcttgaagatgccttagggatctgctcctggctgacactgctgcttttgttcaaactctcctttggccccactaccttgtttcacttcctccaccttgccctgcttcctctcaccaccggggaacacaatgtcctgaaccatcacttctgtcagaaagcctttcacgagctctctcattctcaccttctcctctgatgctttctcctacatggggagcgctcgtctacccagcagagcatgtttgacagtgggatgcctagctatttgtctccaagcctctgcgagcatcacattttctattttgtattttctcagtgctaatcacagtacctggaaatatcgataaaaatatttttgtggcatgagtcactaaacataaaagacatgaagcgatttctagactgttctgtgaggagggggtttctgagtccctacttaggagatggctctgtttgtaagtataaggtttttgtttttgttttttttttaagttcttaaacatttagcatttctagcaatgtcttagattcaggaaattgggtagcaggccctactgccatctgcttgcatgtagattgaaatctaattcttcctcaaggcctgtcccgtcagtcagtccagcttaccttgcttaaccccccgtggctgcctcctttgcttgtcaggctcctgtggtacgtgtctagctacaaacctagcccattcttgcctccatgccatggttgctacaaaagggtcttcccagtctatgttattcagcccaccctgcactttctgaccccaacctatcaccatctgacacatggtttcttcagagcatcttcctgcccggcagttcattgtctcaccttaccatattgagagcttatcagagaactgccatgccttgagtattacaggagtcctggcatctaaggtaagaacttcagaagagtgttacacaaaaccattaaaaaaataataaaattggatctgttgttaagccaagaattccaaagtctgtcatacacagaggatgttcaagatcatgtcttactcatcttatgcaaatgacctaggaaattattcacatagcagttgagttttatatactcatagcaaaattcctgccctttcctacataaaaagacaaatatttggttctgtacagggttgcttggcagtgttcctcttgtgtagtcactgtgttatccattctattcttaaaataaaaataagtcatggttagattgtttctttcaaaataaattgtcttttagagttcctgtcgccaaaggctgcattatataggttctttgtaaggtaatggtacctgttggtcagagtctttccagtaccatgattggctgtttttgttcactgtttgaacccagaattctggtaaccgactggctgtcttcttatggtttgtgaaatttagagtgacccccaaaaagccttccctaggtaaggcctgtgggggaatttgaagatttttcttggtggcaataggcaataatagccttcaaaagacacataaatgnnnnnnnnnnnnnnnnnnnngaggaggagggggaggaggaggaggaggaagaggaagggaggaagaagaggaggtggtggttgtggtagtggattggcacagtcccagtgtaaagtatactagaaggttttctgtgactgcataacaccaggttcctaaatgatggactcacttcactatgaagtcacctgcttgctgggcctgctgtgggggtgtgaaagatgacaaaatggcccgaatggtccacctgacaaggacccttactactaatgagagctacattgttaaggcatgtcagtgcctgttctggaagtatgcaaagccccgtgttttcaagcttttccataggattctgccctgtcttgagaagtagcaaaactctctcacaacccatggtctgctgggagcagcttgttgactgagttaactctaggaaactcatttctcaagttcttccctgcccacatgtaccatgagttacccagaaggcagctgctgttctccccagtggaaattccctcaggctcccgtcggaggccactcctccctgtctctagtttgggtgaaggcgtactgggaaatggcttcctgaactaagtcctcagtgtccatggtcggtctgtaaatgctaatgagagttttgaggctccatggcagtattcctgctcctcacaatgttcctctagcccctcaattgttacaggtagaatggaaggtaggaagatagtagatagaaggaccattacatttttaaaatgtctttacttttattattcagggtgtgcatgtttgtgtggggcagggcacacatgtggccatgacgtgtaagtggaggtcagaggacaactttcctgaattttttattatcttccaccatgtgtgatcttggggatacaactcaggtgttcaggcttgctcggcagccctttaccctcgagccacctcacaggtctctcagtgacgttttaaagatagatccttctatttccccttatttgttcatggttgccacatggtttgaaactctccttgtctgtggctagagaaatactctctagtaagatggtaaggtgttgagattctggaagtttcccagaggggaaggggttaaagcgaagcagtgtacatgggtctatgctggcaatgtgagtattacattatccatttcagcaaataccttggaccagatccatctgtcacatacagagataacattgaccattcaggaaagacttgccaagtctaagatgccagctgtcctctcctgtctgctgtgggtagagactgcctcttcataaccagctgaggtagccattgcaatgatctaggcctccaacccaaatcattgttctctcctttgtgtcccctttaaaagaaaataatcaagtaaggtattccttcactggtcctgtggtgctgtggggaatgttttacttcccacatgaacccagccatgctgctggagaggcagagggagcgtgtgcatgcaggctcagcatgtgagcggacagtatctaagcttaaacagggagcatgtgcatgcaggctcagcatgtgagcggacagtatctaagcttatacagcctctcgcctcagtggtccagcgtccaagtgcaggttgctgacgtaggcactggaggaaccctgtcactctcagttgagagctggtacaactaccactcagtacttgccttgtatccaacactacagaaatccaaaggagttccatctgagaactcagattcactttggaggacttctgcagccccggattagatctgctaatttttatcttagctgtctcgatgggtttctttcataaaagcatcagaatccatatacccaagaaacagaaaggagggaggaggagccagcaggcatgggtccgagttgccccagtgtgggcaagattgtagatcagcgaaacctttgttgggagcagtgtgtgggcagcattagtgaaagccacaggctttgctttgacttagcactgggtcttctgctatctgtcatatggagataatcagagatctccacaaaggcaaatagttttcattatttgaaatagcaaggggcaatagtagaagtgtccctcagtgatgatagattggttgttttcacatggtcaagaattacaacacagctattaaacagtacagtgctgatggctgcttatgggcacgagatgttttaaagtaaacttgatactatagggaaaatacaatatcatgcaaaacatacatggatgagtatgtgtagaaaagtaatctaaaataatccccagtgtgttggcagatgaacattttgacgactagtttgatttagattgtgcttattatttctttattttgtacattacgcttggattttgtttgtagctagaattagcaacaattaactttttctctatatatcagataaatgtgtgtgtgcttgcatgcatacacacacacacacatttctatatttattttttctgttctttttttttattagatattttcttcatttacatttcaaacgatatcccgaaggtcccctataccctcccctcaccctgctctcctacccacccactctcacttcttggccctggtgttcctttgtactgggacatataaagtttttaagaccaaagggtctctcttcccagtgatggccgactaggccatcttctacatttctgtatttagaaggtataatgaacatcactttttaaagaaccaaaatgacagaaaagtaaataaagtcacctggctttggctgtttgaatctaaagaaccccgagccctccctactacttatctgggcttttggaaaactatgtgggactatatagatactaaggttattaattcctatccttaaatgccttccattatcaaattcattaacagttcctgcctttatgtcagagatgctttctgtgggccaagcagtgtccccagctctttcgttcacaacattgttttcaaggcaagggaagggagtgaagcagagttacaaagctgcacacaaagaggtaacgccatactgcatgtctcaacgagcatgccctgccccttccactttgaacccactgaggcaagcttctcactgaatgttctctagggttgccttcctcaaaggagagaccctactaaagaactagcatttagcctattggcaaccatgaggcaaaaacaaggaggagcataatgtaaaagcctggtgacccaagttcaagccccaagacccaggtaaagggagaaggagagaactgactccagagagctgtcctctgacctccacacttggcactcaggctttcgtgaagacagacacacaacaatggatggacaggtgggatgcatggacggatggatggatggatggatggatggatggatagatggatggatggatggatggatggatggatgatgcataggtgcatgcatgggtgcatgcatgggtgcatggatgggtatatggatggatgatggcagtgtaggcgggtgggtggatggattgatggatggatcaatggatgaaagaaagaaaagaagttcagatggtatatatggtaaaaaggccacacttggtggtaatttttcttgctggatggtcctgaagtggtatagtaagggacagagagtgtgccccatagtctttctcccttttccctttaggttctaggtattcatgggagtcctacctgatgaccttgcccaatcctgtcttttcccaaagaccttacctttacactccccagtcagattatgtttccattctctcaatccctcacagcagggattaagtttcaacaggtgaacacttgtaggatctacttaacccatggtaaattgaaaactagatgtattcctaaaataaaattgcatctgtactgaacacatgcagacttctcttgttattttgtttaggaaagaaaaatggctttttggatagcattcatattactttagggatcgcaaaaaaattgcacacacttcactatttaatgcgaggggcttgagcatcagtgaattttggtatctggggggtcctggtccccacgctcctcaataggaatagggtctggtgtttctcaggatgcttaccaaggcttctggtgacaacactgaaaggaagtggaggaaccagtactaaagaaagcaggcactacctcctggcctgtgggaaaagaggctgggcttccttcaaatgagcctccctctcaccatggaatccaggactttcagtgtcctctatcagggagctatttataaatgcatattacctgatctccttctccatgtagttaaaggcatggtatacatgtgttctgtttatatcagtgccttaggcgttatagctgctgcagctaccaagcactgtgtcctttagcctaattttcattccgaaaccgagaagcatcttcttatagcattagccaagcatctcctactcacaacagctgccgactagtaaacacttagtatgcgccaagccttaacggattaagcacatttgtgtgtacagtctacttatttctcagcagtccccagggtgtgggcattattaatgatcccagttttgcaagagaagaaaatgaggcacacagaagttaagtaaatctccccgggtgatatgggaacaaagtggtagaaccagtattcagagctactctgagggcctcctgatcctaaatcctcacaccgactgttgattcactattcttaaaatactcttttcatttagcagtctgtttatcatgtatgacagatattctctggaaacagacaacacatcaaactactgaaaggtttccaaacgcttttctgtgtaatgtgtgtttatgagctcaggaaactggcattgtgaccgcttcagcagattcccgtcaagtctactgtacctgtgtcgggcaggttcctcttgtccaccagacttgttaacttagtgtaccctgtaagtgcctcccagagcagcagagagggagaaacctggcattgccactgtatgctccttaggaaaaggttcagcctctctaacccgcatcttaccccacctgagaaccaaagcagccgtcacagggtgactgggccaaggcagcagcaaggagttgtgcccagcccagacctagcatgtgagcaatacgctctcttgccagggatagcaggctagtgttttagaagtggggctttgtgtccgtgttgtgtcttgtctcagcagaggcctgcttgctcttgaccctgattgtcttttccaactgcatgagacctcagcctccgtaaccttaaaccctgcaagggaatgtggaagtgtaccgcatttcacaggacaggggctcaacctgccccaacccagactcctttagtcttttccctaaatggcagattggcattgaaagttgattaattcggtggataagaagcttaacgtggttttagagccaaaagcagtaaaagtttattcgaacaaaaaaatttttttaatgtggttctgttttccaagcctgtttgtgcatctttgccagcagctgtggcatctccaccctttgtgtttttcatgtaaattaccagggctttgtgatctgaaaccagcttgataagtcctctactcagtagctccataaaggctgccctggtcaaggaacctcaaatcttcagttcctgaggggaggagtaatgagctatggttgggagttcctgtatggagtctggagagtttagcattgtttaacaaagcaaggttgaggaacctgttccgatagttacctggggaccatttcttggccttgccctgagccttgtttactgggtctttttgtcttcattggccaactttctgtccttgttcttctgggcatccttgagcaacagtgatgcttaaagaggagtaacaaccacagtagccttatccagatgttagattgaaaattaaaaacgttaatttttaaaggagtaaaattgtaccgagcgtcctcaggttcaagctgacttggacacagtagaaacctagcagtctctggctgctcgtccgaacccatgatacaagaaaaggagaccatgatcagtatagatttgtgggccacaaccccgctggccccattcagctgcttgctagcctgagagttagggacattttctgcctttcatttatataatttgctgatgtttatagtttctaatattcttcctttggaaggattcttccaagcgattccccttccatttccatagctgccccagggatgtcagggagccctagcacaagcagagtgccgtgttgtcatggtaaatttggggaagggggtttggggggaccataaggagaaagggcttgtagatgtatagagagattggcactgtggaaaaattattgtcacctacgtttcaaatggatggaaatacagactggcgacctacaaggtagcagaacaggcacctttctgcatggattgccataagcctgcctgctgacagaaagtgaatgaacgtcagaagttcttggtgtagaacagtggtctaagataagggagtgggctaccggtgatgtctgagcatacatcgaatcccggatcccctcgtgaactggagatgcagcagtctgtgcaaaggaaggactccccaggctgtttggctggctgcttgggtcttagctaattgtttttcctaggaagaaagaatcacagccccctttaaggacatacagaaacatcattgaatgggcaagcatttgtcctccggacagaacggtgttttagctttgccaagaagcaggtgcttgcagaataagtctgttaagctgttaccagctgctgcctcggagaactctgctggagccaggtcctttcctaccgatctccacttgatagaactttctatcaaaataagaccttgcccattaaatttatgcagtgtcatggagcaagactatcctgaaaaagattacaagtggagaaagtgggggttggcttagttttaatcccagatagcagatactgaagggtgttccatggctgggtttattaagacttcagctcaggtgttgccaccaaagaagctgacccgtccacagactctaggcacctgcttctacactgccctgactgtaatttctcttcttagctcttagtaccatcgaaaatgaattcttttttacttttgtttgcttaaagtccattattttaatattcatttcacatgtgatcattgctaaacttttaaaatcataataatcaaaatattctcagacaaaactatttggagcaagtatctctaataatgcatgtgttgtttctgataacttatttataaagtttatttctactgtagtcagaaaacacatgaaacagaaattctacaaggatagttacaaaaagtgcacaaactggcaactttgttcttcctctctcctacctttatgtttactgtgcttgaacacgagggtcgaggggtcccaggcatcttctctactgggttcctgagacctgctagacttcctgtcttataaaaatcacctaggaatgctgggtaaatatcaagtaataggaagtaaccagggctaagggacagttcactcagtgtgctcttagcggctgaggttttactgtacctttggggtacaggaggaaaaccctgggtttgggaccagaaagtctaatacgagctgagccgtgctgagtaagggatttgctgtaaggctcaaacccttccccagggaggtggttgcaccctcacggtgtgagcgcagctccagcaggcagacactgccttcccgggttttatttttccccttttaacagatggtcccaatggacctgcttccaaggttttttgaggaaatatcctccaaaacaacccaaaatatatttttaagtcttccaacacatgcttcctaaataaaacaagaagcattcggtaaattgcgggtgacatacacagtagaaaaatgctgtaggggaaggagcttccagtttgcccaggcatccagtgcctggtgtcaggaacactggaggatgaggccctgtgccctggtcttcagacatggaggaaaattaagacacttccaaggaacttctagaagaaaaaaatatatatataagaggaaaagcatactttaggcaaagatttcttagatatgataatcaatgcactatctacaggaagaaaacctagataataagaccatcagtgtttgactttttcaacaacaggataaccaagaggagtcctggtgaggatccagtatggatagtgtagcagaagctgaaggacttgaaccagacaataactcattgcaatgaatatttgcaagtaaagatgcgtgggcagaagattatactgtataacatattacagcttccaggacaagagattttctgtgctttgcagggtttttgtttgtttgttttcagttttgttcatttgtttacttttaaatttttgtttattttcttttggggagcttggttgctagggcagagggggatgggaagggacagggagatgagtgggtttgggtacatgatgtcaaacaaagaatcaataaaaagtcaatttaaaaaaattagtttggcctttcaaaagacacttgagaaaaattaaaagacaagatgcaaatataaaataatatttgcagatatcattactgataaataacttgtgtccacagtctgtacagaaatcttacaaattcatatgaagacagtaggtgtccgtacaaggcaatatgattcaacaataaagatgaattgactagcatacatgctccaacatgcacaaaactcataaatatgctatgaagttaacagctcacaaaagaccaggcaagatacactcgttttgtgaaatgtccaggcaaggcaaatctgtagggcctaaatgttgcccagcgcctgcagatggcttggaggagcctgacagttaatgacagacaggacctttctaggaagagacttgcacacctcctctgtgctctcaagcatgtgcagggaaaactgaaggatttcaaggcatctaagtcacacaacaaaagttctgttttgagctctcctgggagtgcactatctagtctgtaactgttggtagttgttttcctgtatacaataaaacaaacgataacaaagtgaagattttagaaaaacaggactgtgaatggatgaatgtgttttaatacattaattatttagttctctgaaacattagactttctaaaaatgtatattacacttttacaaaagttttttaaaaagtgggtttggtggctaaggaatttctcaagtgtaagcagaatgtcactgagagagcccagctaattttaaatggaacatggatgaacttttttttgccttaataataatgagattttatgatttaaaaaggattagggtagaggtgcatgttttattggagagatcaagttaaagaacttaaaaatgttatggatttaaagcatacatgtgacaccagccatccagtcatggaactgggtatgcgtgcatggctcaggacagccctacatgttatccaattgaaaaaaggaagccacttgtgactgagactgaataccaaagcctaggaattcacccagcatctctttctcccctctttcctaccaggggaaaaaaaaaagactgtgggaaactcccctgacagcctctctcttttttcttaagcataatcgtcctaggctggtgaacaagtggctggctgcagagctgttttgaccaaccagaaagagcagttccctttgacctcacataattctgatttcagaatgtcacatgttgctggctgccagtagtctggcccttggtctctggtggacacagtgtttgctttcctaaaatgttttgctttaaggctgtggagttttgtactttaacatagcttttgaatatgaaaaaaactcattatagttcaaagaaacttattatggtgcataaggaggagttcaaagaggatataataatgacagtacaaggtagagtcaagaccaggagagaaatatagtcctcagggcttaagaggagaaagatccaactctgtgactcctcgtgatatcaaagatgcatcaggaaggaggaggcatttgaagcatgctttgaataagtggataggccatggctagcacaagcacaggaacgttagaggcagaggcatgtgtaccagcaggagcaagaagcggggaacttaaagcatgcccaaggcacacgtcagctacagctgctgtgacaacagggtagcaatctgaggttcctgggccagatccagacagggttagggctatggtgcctgcctgtttactttatttgtggcttgtaagattaggaaaaaaaaagcagttgacattttaaacggctatacaggatatctacatgacatcctcaaatttgcttattggcctgtgatctaaactatttactttatagttattcagtggccctgatttgggaaggctggcatggtagttcatacctagaactctcagtgtttgagtgtgtgtgtgtatgagtgtatatgtatgtgtgggggtcagttagaagagtcagtaatttgtgcatatttttagttgtatatcaagttccaggccaacccaggctgcatgagatatgtctcaaaagaaggggaacggagaaggtaagaagggatggaggaagaatggggggtggctagctgtaatactagcatttaggagtgcaaaactatcttaagttcaaagccataaggccaatttgaactagatataacaagactctgtaacacacacacacacacacacacacacacacacacgcatgcatgcatgagtgtggtcgaagggattgggggtatagttgaagagtgctcacccaggatgctgaggccctgcattcaatccccagtagcagggtaaaagccccaaagaggggagtaatgaaaggagttttgggtcctcactatgagagcccttcaaatgagggaaacctgggtaggttggagagttggggtgaaggttctaagtgtgcatttgaagaagtctcaggacatctctaaccttaagtacaattgaatccagggaatcacatcttacgattgtttctcatctctctcattttaaaacttcattttctggcaaatatttgctatgcaattatggaacaagatctctgttccccctattccaatacacttaaggtgttagatccagaagggtgggtgttgacatttttcccgtgtgagtacctggctaccagattctgcttatctgtggagcagcgactgcactggtggggaggaggttccgagtctccctgcagtgatgtgagtgacactggggtgggtaagaacttctccaggtgggaaagctgccgtacagtaataaaatgaacttctacatgccactctgccagggaagggatttatgctacgtttagtaaaccgtgggacattccaacctttattaagcagtgtgtttaggaggtctgtgtccctatagtatgctgttggatgggtcaaaaacaagactggctattcctttgagaaggtcttagttattatcctgtgatcagtgaggaaacattgaaatacttcaagcagaaaaattacatgaaaaaaaatatatatttggttttttgaggcagggtttctctgtgtagtcctgtctgtcctggaactcactctgtagaccaggctggccttgaactcagaaatccacctgcctctgcctcccaagtgctgggattacaggcatgtgccaccactgcctggtcaaaatttatattttaaaatcatcaccaaaatgatatagccaaccaagtatacttcacgggtcctgggctgcacagagttggagtgtctggagagggggtaaatattactaaaacactgcacaaatttctgaaagaaccagttaaaaacaaaataaaatttttgtcttgttctgtgttaatttttgcttagtaacacataggttctccagcgttcatttggatccccctcaaatttagcagagtcagaaatgctaatttgtgacatcataattaatactgtcttgtgcatctacttctattgacaacactgtgtttgaagtataagaactggaagagaatatgaaaatcctattccttccatttgtttttattcatagatgttaaaattctttttaatttcccctagtgaaaggtggctttgctggaaaatcactcaaaattttttacagtcaagtcaggaattcctcagagctaaaaacatagggggctgagagatcacagtaaagtccactgaccctgcacccctggtgtcaggagaactcatggaaagtgaggtgacaggagttttgctgctgtgcacactgaaggagcaggaccagcactgaagctagaataggggagacattcgagtagcctggaatcggagcacaacaattttccacatgcttacactacggagtaaacagcagaattcaagaggagtcagctattcacttggaaggaaggaaggagagttggagagtgttggcctttgcatcagagctcgcctcttcttatttctctgcctcataagccttctgtggtatccggaccgaggtacggttataagtatttaacccttctagctgatgtcattatagaaaccctttttctattgcttgaagctctgaacagtgtattaatttagactccttattttatctttacaggattactgaaaagcttaaaaaatctgagaccaccactgctaattttagatacgtttttctttgctagtcaacattttggctcttattaaaaattcaccctgctcacctctgagtagtgcagacaggaaaccttccctgagaggagactgtatagaaaattgagccagatggtctggccccttgctgtggccaaaacatattttccagcctactcagaatgtgacatcagagccatcctccctgactgccctgtgggccagtaaagaaaagaggctgtggatggttgtattaacttcactaaagaaagcaaaaaaaaaaaaaaaaaaagtccctaaaatagtctgcataaactcccagtgaggtgggcgggtagggaggttagtttgggtgcatagaaggtgtgcagtgagaagagtcacaatggcacctgactgaaaaggtggagaacagcgtcatttgggagctgccaaatggaaatgtacctatgacacagattgttgacgcaaaatctaagttatccattggccttctcaaacatcctaacaagtacagcgagcagtttgggtggtagacagtacaggaaactatttaaaaatacagcgacagtgtttgtctgtggacaaggaaacttacgactttctgttcaattctattataaacctaaaactacttaaaccataaagcttaacagagagagagagagagagagagagagagagagagagagagagagagagagagactgtgactgtgactgttggagcaatggctcaggggttaagagcatttgctgctcttgcagaggacccaggttcagttcccagctcccatatggtgtctcaaaccatccatcactccagttccaggggctccaacccatcttctaacctccctcaatactatgcacacatgtggtacacatacatacatacatgcagccaaaacactcatacatataaaataaggataaataagatgtttaagaactataaagatgtatgcacacagacctggaaagttcacttacagtgtgtaagctgcagcataaaggctcagccctgccttgctggagcatagtcacaagtcactcagagttttcactcctcttagtcagatactcgactgcccttaaagtacctaattgtttgtttgttttttcagtgttagaagtaaagtgtagagaataggtaaatttggtaattgggaatctgggaataatgtagatagcatgtttctataaaagcagtattttattgcaatgttttcaggttgagtctcttgtgctctacaattttaaaggccacctagcacacactactcattcacccttgttatgatcaattgtgctgttgtatcaagacactaaaagtattttccggttttcttttcgtgaaatttgagggttccacattttgctcttccagagtaataatagtactgcacactctgggcagaggtggttcaggggacagcctcaggtggggctcctcgggagggagccggactttactcacaagcaccttcagttctagtgaacgcctcaactggcgttttctgggcagggaacctgtgaggtccttgtgctggcagggcaagcacttcacacctgagccatctcctcagccctgctctgcatagtactcatgtctgtctatctggatgtgcacacccagtgctctaggggacaccctggaaatgcagctgctgggctctagaagccaccttcacattgctcagaatggctgtagctacgtgtttctgcctctccttcagtagagttcagtgtctctggtgttctacaagagaaacaccagccttcttctctgtatttgaagcccaccttctagtccttttataggcgtgtaggattgccttgctgtggctctcgtggattcttctggcttacagaaaagcacagcactttctctttggctttcccttttaaagtctctactctttgccctttgtctactgggcacctcttatttgttagtagtagttcaagaaaccagcaatgagttccatgtttatttatgtgtcagagacctttctcctttctttcagtgctatcttttaatgaatacacttgtttgggttttattggggaatttaattgtgttgagtcttgttttgagagaggatcatactaaccttgaactcattacgtagtgcaaggtggcctctgctcacaatccttctatgagcccccccccccccaagccctgggattgccgggacatggtgccatacctggctcaaagttaatgttttaatataatcagacctacctgtatcttccctcacagtacaccattggataaatcccaccctggatctgtggcctttattgtttgcctttggtatttagatctatagtctacctggaaatcatttgatttgtatggtgtgagataggaggtccagtgttaccaggtatccagttattctagtactatttatagaaggacaccttacatttttatcttagaaaatctaatctatgagtgctatatttatattattcttatccatgcttgcaaatttcatttttaagagccatgtttatacctctctaacatcagaacaattgctgtaccttactgtagaacagaagaagagtcagtccagcgacactgtcttgtcttgtcccttcccttcccttcccttcccttcccttcccttccctcccctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctctttgcatgatatcctaaggaaaatcataagggatgttttccaggaaaccgttgctcactgatttggaattatattacccaggcatgcttttggcttttccatcaccttattggggagaggataaagacatataaataaggccagacgagactggctttaatggcttcagtattaattccagatctgaaggccagctctggcccaggcctgaactacaggcatgtaggctacagatcatgggtcacttctgacagaggaataaatgcaaggtttatgtctcctccacagtggaatgctggctcgggagcctttaccctctactcattccttctatttagtcttcctgagttctggactagctgaatactatcttgactcagctccaccctcaactaggtattcactgttccttggtgtggttgttcatctgtctgtgtgctttcctcacgtcttagcattaggctgatataatttagagacataaatattgcttccatgtagaaacagagcaccgagaggatattacactcatttttacatcattggaaataccaggaaagggacgggggcaatgtaagctaatcttaaaaccaaagcaacctgtctggtcttttggacatgataatgctctctgttgttggaatgcattcactagatctcttttgaaaagctatttggcaggatatattgtgacccttaaaagaagatccctaaccttttacccactaatgttacttccaggaatttatgctaaggaaacaattggtgacacacaggcagtgatcctctataaggatgtgatggcagagctatttataccagctaaaaggggagaacaatctagattacacacagagtgactacatacaacacaccataaatagaatgccctgtaaccactgaaaaacgtgctagagcctattaaatgacattggaaatccttctattgagtaacatcatcaacaacaaaacaacctgatagtcatgtgtatataatatgctgatcccaaaagtcagaaggcattggctaagatgtatagtgattatcagttctgtaaaattatatacaacttcactgcttttcttttttttaagtatttttccatttttatacaaaatcataacttggttataagaatttggaaagatcagctctcttccctttctgtctcctgtgctgtggagtgaacccagggtcttatgtcttgtagataaacacactatgtcgcacatccctcacccaagataaacttcatgtatattggtgagcttacgtctgcagtaagagcacccttcctcttatacaagccctataatgatggtgtaaagacccgaaagggtctgctgcctttctgttgggtctgggagcctgcccagggagcactgttcatagcatggcaagcataccctggctgggacagcacacgtcctatcattcaagtgactcaccacagagggtgtcgagctgatgacattgctacacactgtacttgaactatcagccacaacctcacaggctgccaagcctcccacttatcttcttcctaaactgtaactctctcactgtgtaggatgtcaaaggaactgcataggcagaaaactccctttgagggcaccatgggccaggacactacagctgatacaagccttccaatttgatgcaaagcagctcagtaaatgttgcttccacgctaaagttgaagccattattgcagttgggccttgatgaaggcttggcaggcctccaggaatatttagggtgaaaaatgtgctggggtattcaactgggaactacccagctgggctgaggcttgtaagaagcctttataggggtcatctgctcaaactctagttagaaagttatttcctcccattctaacctctattgtttgttatgtttggctttattagtgggaaaagaatccagaatttcttattggaggttttagggccgaaggtgaaattgaccattttctgttggtctgatttgtttgggattgtaatgatgtgagaggtttttgttggttggttggttggttggttggttgttaatttttgtcattttaattaagaacctataaccagctgttgctgtcataaagagaaaagtgttggttgtacacatataggccaccatcaccatcatcatcatctctgttcatgttctctgtccctcctatatgccgtatgaattccatccaaactaaaggagaatgtctcggtgtctcttaggggaatcacttctatgcgtacaacccttctgttgttataagctctcttcggcatatcaaaatgggtgctagtgctattgatagggacatttatgacacgtctctgaagtataaactgaaaaacataattgccttagtagtggaacacatcataaaaagtaccgaagagtgtacgtgtggttattaaatgaatgccagcgcagaggtaatagattttaaattctggtcacttcatagcaagtaaatgttattgctatgactaacgcaaacaaataaaacactgttagacatttaaaagagcagttaatattatagcagttgacaagagatgtgaagagtcacttcttacagaagttacagtggccctccccctcccccacccccagatcatttcagccatgctttcctgcccgggaactgttgagatgtctgagaatatagagcagcactcagaaccccatattgtattcccagactgtatttcccgtacagatgagataggaagctacaggcatttcctcaataaagaagtaattttaaactatttcgcaaatccttttgaattgtttgggtggtgttaccacaggaacagattagaccaggcctctgagcccaggttgttcctttgaccctcccctggtaccacttagttttctggttttggccatgatccaggagtccttttcaggccttcctggctggcacattatgaagtgggacagagagagacctaagaaagcatgacctcagctgctggctcagtactaagggaggctgcacagcataggtgagggacagctcaactcatagcaagtcaccgacctcccatagtgattcttcctgtcttgcttgctgcttttctttttcacctgttgcatctcatcaaacatgctttaagctctgtgagccaggagctttagtaaattgtactatcgtagtaaaatgtactattgttcattatgggtgctcatcaatgagtcattgacagattgaagaaattgataaaaggatctattcttgaattttatttcttcccttgtatgaattccatctgctagatgagtctaccagacaggaccctggagacaggaccatggagcctgttggaatttactatgtgttgagtcttactgaaccagctactatgtttccattctcccttacaaatgtggtagacatctgaaggaaagtcataagtcagtggttaggagaaccactaatgccatgggtcggttaagcagctttttgggggcctagcggaacgctggcaatgaaaacccaggctttgggccagagcattgggtgaatcttggccctgtcatgtaaagactgtcaagcctagctaccatagcccagggcttcacatctgtgaagtggaaattccagcagtgcctgtctgtgggcttgctgagtatcttagcaagtgccactagtgtagttactagttatctcttaatacctgcagggatcacatagacagtcctgctacagcgaaagaacaatacttccttgctcacgagattcatagactataggaacaatactaatgctgacaattaattaaatgtttcatcagtttcaaggatatgaccttcacacagagtttttttatttgaatgctgacacaagtgttcatattgcagcattttacacacacacacacacacacacacacacacacacacacacacgcacgcacgcacacgtattcttgctaaattcccatctgcaactagcagccagctgaagatctccagggactgtggccagttctatgactagctacgctcaccatcttctcagccctctgtgtttgcactttctgtcacatactgtgacttacacctaggtgctaaggtgattgtataatttgcagaaataattcagatggtcaacatgactaactaaaatgtatgaggcagattatggtaacttcaacccctcctctccgaccctttgatcagctgcccatcacattatgaaatggacaaatttgaggttttggttctgttttaaaaattgcctattggttgtgggttactctctgagcatctgcgaacaagaggaagcacagacctgggccacacatctccagggagctgctcacagccataagcgctgtctctgaaaggtgtgtatccatcctgcctgtcccctagtgtgttcctaatgcacacttggatctacatggcacacagcccatgtagttaaaaatataaacaggaaattgttttctggctgaatggcctttgtggcccagaaaaaaaatattcttttctgctgagacataactttaaaagcacacaacagtgaaaagctaaaggctggatgagagcgaggtcagtgtattccaaagcaggcagcaaaacacatggatactgattcatgtaggtaggcccactgcatgtccacagtggccagtggtaaagagatcgtggagaacctcaggttacctaaaaagcattagcaagacaggccaaagaggcttgtctgtgcatcaatacctcaaatgcagaggactgacctggagcacagagacttgacagcatgcctctggtctttgatgctcctgtgttctgctctagcgccctgccatttggcctcccatgaaccgcctgtgctcccatcgtggcttccctatgtgctgatgagttttctgattgttatgtcttgcagccccccgaatccaagcccaacttcacccctctcgccatcatggcccatgttctcggcaccatccagccctatgcccacctcatccacgtccagcgactcatcccccatcaggtctgtggcagggtttgtttggttttctgttgctgccgttgttctctcattggcttggtcctctcttcatgcagtgttcagcctcctcgtcaactttgttccctgccatccaaacctgcacttgctttttgacaggccagaagaagcggtccgtgaagactccaggtaaaactgcggatgatgactgacttgtccctgtgtatgcagagctggttagggacattgggggtctcctctgctctcctgcgaaagaaaaaaaaccaagaggcacaatacgcatggccttgcatggcattttaaactaccctttccaacctttacccacatttctgaattaacctctgctgcccggaacaggggtctccaaaaatagtacctgttttgaatggttttctgaatcattgggctctccatgttttggtggaagataatattctaggggtcaatgtataaactggcccttccttgtcacatttttatcaggtagtatctggcaccatttgcttatggattgggccaataaccctgagcacagacagctagccactgaaaccagatccactgagcaagagaggaatataacacagaataaaagtcagagacacgaagcactttctcttcaaattcctcagggcaccacctccctagccccacgtactccagggatcttctggcctcccagcccactcgtatctctctaggtcatgaaccctgagtcctcatgggaataggcaccgcctctttcttgaacaacttgacctagttgttctcccagagggccatgctgcagtcctgccttgcagagcttcacagccatgtgacgcaggtttgcttgagctctttgtagaaaagaagcccttgaaattgaggggaaaacaggagaaagggccctgcagacatcctctgctgtttggagccctctctgggcagcatctcacagacaagccaagtgcagagtccaggttgaagcaccacaggcatccttggccttggttagaattctgcatcccgcccagtcttcttcggagtgagcccatcacccaagctcacctaatttataaagctgatactcactgtttggaaaagccacactgtctgtgtatgcaagcacatgaattactctcccgtgggcatcatcatgtctattgtgtcattctgtctcatgtgagaaccagaagacaaatggtctgaatcatattgcagaaaaagaaaatggtagcttcatttgatgagagccatggcagagttaggagtccttgctgtctgtccagcatttttactctaaagacctaggcagccccagtgatggttctgtgccatccgacccctcagctctgctgctgggtaagatgtgactttccacctagcttggtcctagacgatgggagagatggctctgcagtatgttctttttctcttcaccccctagataaagtaaaaatcaggtgttgttttcctaacacttgagctatttgtgaattccttaggtaactcctaggcacttaggagacatttcctttctagccaccagaaaccatgtgcacgattccagttaggtcagtcactgacccgtgaggacctggagcagaacacctacaatggctcactcaattattaaatagcactcctaaatggacattaggagactggggctggcctagaggcaagtaaatggctgctcagtactgcctcctctggcctctgttagaagaacaccaatatgatgctatcttttaggaatacacaatcctttaggaatctgtcattttgaaataggcaagccacagtagggcttgaaattgggtgtcatcgagctactgcttatgctaagataagcacagatcaggaccctgctggaaaagacagcccactaggagaccagagactggttccagtccctaattgctgttacagtgtctagccaagaggtgggggcgtagacccattgttcaggtctagtgttgcctttccccaaattgactaaaagaacacaaaagttcaaattaccttcctttgacaaggcttttaacagcagactctgaatgaggcctaattaggggtcctggcaacctgtgggaatggcttcctctctccattcaagccacttcggagcttcttgtttcaagctcagaggtagaggtactttttctgcacagaagaactcgggcggaggaggcccactttggcccactttaacatttgccctctttctctacttgcctgtccacttcccaagaaagcctccacatcagaccccctattttgtacctgggtcccagggaactgccttaatgatcaaaccactgtgagctggcccctccccccgcagcagcacgcagtgtagagtgggttgtcattctgcaagcttgcaagggcatttgagggaaattcctctgagtgttttcctggcctcattccatgctcagaggcaaaaattaaaagtgaaccagcagaaggctccaaagttgttcatgcccttgaaggcccagcccagtgctgaagaatgctctgatgggaactatatccagctgcagagggcaggaaccaaacaacccacggtgctgccttcagtcagagctagagagtccaaacccaaaccgctagccaacacaatcctccatcgggtacaagactgacagcaatggccaacttttatcaaggcataacttccccagttagagttgccagatatgcaaaacaaataagcatatagcctactcagatttgaattggacataaataaaatgcacttcttagaatatggatatcttatggaaatgtacttaaaatattatttgcatgaaattcagatctgactaggtgtcctttctctggtgaccgttcttctgggggatggggacaactccctttaaaagcatgtcctctagggcaagacatgcagattagtgcttgcctaggctatccacagtgccggggtcttcatctccaggactccaaaagtgtgtgtgtgtgtgtgtgtgtgtgtgtgtgtgtgtgtgtgtgcgtgtgtacacacatgcatacacagcacaccccttctgcgtccctctctaagtacctctctgttttctgtgcatcattaggtagttggagagaatcaactgttaacagattgtcagctgttacagaaaaacagactatctcctgaccctcatctttactcttaacacactgttttcttagtagttcattactaaattgcaaatttttaatattggtggactgtgaaccccttcaaataataatcatggatgctagagaccatggcctctgttctctaattaccacacagtcctgtttcctgggtggctcccattctgttctgtgaactctacttaatgagtttaataagtagcctctaggagaaccctatccagagaaactttgccttccctggtctcttcagcctgtgtccacctatgccgccctgtgctcagaggcagccctgcctcaacatggtctcgaccttggctcctatggcctgcattccccttgtaccctgcatgccattcaaggctccacatgcttgtcacccacagtgtaaggtgcggctgtgttagtgcctttcacagtctcctgactgttttcaccctgtaggcagggcagaaggcaggagaggaatatacttttgtccaacctgagtggctacgcactgactgctaggcccttgctagccaacatgcagctcattgtttaatggaatgagaccagaagagctgcatccagctggaaccaatgagaaccaaaggcttccctcctcattcccggtgtccctgcattattctctccccctttcccaggtctgcccttcccaccatcaacacttggctataaggaaaccagagagaacagcagggaactgatccttccctggcaacacattctggataacccccaattctgctccaccctactgtataacagactctctcaattgtccatttttcaattttcaaggacccaagactagaaggaatggcccccactttaggtttccatcacccatactcatccttgccaaagagagcctgcacttgggatacctgagcaatagcagttcagaagattcaggatgctccgcctcacctgagaccaggctcctcctcggccactagtgcacactgggagctggggtatctccagccccacgagcctctcagagtgtcaagtgaagataaattaaatggcatacatcttttgactcatttcttaggctagtgttccttctggctttttttttttttaaatgtgcttctgaattccagagtgtactccatcagatgacttggagaaagtcacttgtagcaaataaagagtagccttttgacagttagatgtcattctgacctgtgaaaagtctgcagactgctaagagtagtcagtgccaaagtcaaaattgacaggaaagagtaaatttaccctcacaaatgacaccacatgacggcctgtgatggtcaaacttttgcccctgttttctggtgcataactttttactggaacgtatcccccaccgatttgtttacatattgtctctagctgctgtgttacagcagtgtagcatgaagtagttacagcagagaccacatgccttccagagctcaaagatcggccctttcaccacagaaatgtgcccgcctcaactcgggctgcatggaagaatcgcttggaaagtgacacacagatagttcagtttcaattctattatgtgtggttccatctgcaagtccagaggacgtgtaacaattcttaagggcattctgataacgtgcagagagtgctgtcaatactcattgacaaagagatcccaaaacaggaggtgagctcagcccttgtccctccctccctccccccccccccgccctctgtaaactaccagactggtgcacgtgtgtgcacacacaccacctcacacacctcctccatccttgctacccctcggggctggagagtttcatctctaaaatgttgctccaccggcaatggagaacatgtgcgggaactcatagccacccctgcctgggctgaaacctggctctgctggagtttctcctggatccccggcattgagcctccaagagcacatgttggtcgtcatatctgtgagcccttggtctcttcctacttgcaagcactctgtccaggaaaggtccttctgcccaggcccaggtgttgtaattcccaggtaaaggttctctggggcacaaggtgaccttggagaattgtggcttcttagagcgtgtggccttttcctgattcttcctcatttttctcttggggccttcccgacttgcctgcctcctgttttgccatctggctgccttgtcctgctcttcccaggagagaggactaggtggcttgcagggaaaggagagaagaaacatgaactctctgtggctttctggggttgaaaacagtgttaaataaacctgcctttccacacacagcacaccattccggaaggcaaaggctttgtacgcctgccaagctgagcacgactcggagctctccttcacagcgggcaccgtcttcgataatggtgagtttcctgtcacctcacagaaatggaggggaagcagatggctgaagttcctacctgggggcatgggtatctctcccccaaatcagacttccggagtattggtctattgggtagacctatatagacatctagtcaccgagttgtttcaaactttgtgtgagactgtacctgacctcggtaattagcatttgtgggctagacagggtcaaagacaagggatccgggtataggatggtggcagttgggcagagatgccagaggaggctaagtgcacctgttctgtcctgtgttccccttgggatctgggcctgaattgtcttcagcaggcaagacccactgcccagacagcagtgtaagcagtaagcctcctcctgttcatcctcccttaaccttgagaacacagaacagacttcctaacgtgaagtcacctacaccgcagcagcggcttgtctggcatcctggtgtaagtatgtatcgcggcactctgtaaacctgcagtcaggacctgcttggtgcaccgttatcccgttccttttccatcttccccgctaaaagcatactttacagtaagaagtgaagccatagctcggcgtaataatttacctaagaggaacatctggattcctgtgcgcacacaccaagtttctgggacagttgctttccatgggtgaagttctccttcagggtcacaagcgattaagttctgattgcttcaaaacaagccaaaaaggcagctgcctgcttccaggacccggacatgtgctctggctctttcctggcctcatgtggggtggaggcaaagggcacaccaatctggctgggcacccctgactggccctagacctgcctctccccatgtgacagaaaatgagcagaggtggagggcagttgaggtgcctaaacagcacaggggaacctgaaccctagagcgaggccacagtacatgttccagcccgaccatttgctctgatgtgacctgaagcaatggcatcacttcccagtgacctggttctcttctctgtcacagcagctaacgcacttaccttacagggcacagtggaaggacatcaagctaatatacagtgtgtataaagtggcacttgatgcatatgaccttatttattgtcaggatcttgtgcctatcttagaaaaagactgtggcgctcccatctgtaagcaagggcagctttgccttttggttaagatggtcccagcctgacttatcagctagccatacatactgtttatattgttggagcctgccgtcaaatctagagttcctggtaccatgtgtatcctacaacctgtattctgcccacttattagtcagacgtgagtagacagagtgggaaagagcatacagtgcagggagagttccagcctgggccacctgggccacctgggcttcctgggtcagcagcagttgggacaaatttcaaactgtctgtgtcctgataagcccaaggtccaccgtgatgctcctccaagtccaaagtactgtcctgaaactttgactctgttgactttcttctcggagctttaataatcagagcatataaaatagccagcacagccacctctcctgccagcagctgatgctcgcaagtctagcagactggcatgtataataggtcagctgaagactgccccaaaccatgccatggtcagtgtgccctgcacagaccagctgtgcagacacatcggagtgggcatccccgatggagcagctgtacccccgccatggctgagcagtgtatgttcagagttacacaactctcaccacgatctaattccaggataacgccacacacacacacacacacacacacacacacacacacacacacacacacacatgggcatacacacccatacacctgtgcccatatcctttagcaaacatgctggttttacccctaaaactatattctgtctccaaatattggcctactttggacatttcatacaaatagaattacataatatgtgttctttgaaacagaatgtccttttttttaaatgtgatgttttttcacattaatccatgttgtaacatgtatctgtactttattcctctttatggccgagtagtatctcactgtgtgtctataccacctttttcttgaacatccaccagttaattgctggggtatcttactggttctcaatttttcactattaaaaaataagttctcctgggattgctggatcacgtggtaactccatatttactgtctgaggaaatgccagacaatctttacaaggagcatgtacctctttgcataccccaccccccttcatttttaagtttcctttttgaacaacaacacaaagtcaggcaggcaccgccatgatttttacttgccagggccttcccttcccaatggagtgctctgcccagccagctctgggactcctcccactaccatgaggtaaccatcacacaccctctgaagacacatgtagcaaaagacaagtttggttcccttcccacaggttcctgcaatctccgggggccatgcccagttctcttacgctgacattgtgtgcatgcatgtgactgtgggcatgctcatgccatgatacacacatggaggtcagagaagtgtctggagtcagttccctccacctttttgtgacacagcatctcccttgtttctgctgtgtgctccagactccaggctagcttccagccagttcttcctgcctcccatcttaccttagcagttctggaagtttggaagcacaccattgccttggcttttaatagagattctggggttcagacacaggccatcaagtttgcaccaaaagtgttattatcctttgagctacatccctggccccagacagagatgctaatccactttctaggctgctttgcccggtaatatttcactgggtcctattctagaggagaaatctactttcattctgtgggagaaatcaggcatgacagaaggaaataatgacattatgtgaagtggccatttcctattgctcctatatagactctgaatagataaggcaaagcctatgtcagtagcctggatgctttgtgcagctgtcagattaacgtttcctactgacatgtaggccactgtcgtcatgtgtgtgctttatgtgtggaataaggaagggaagagaagggtgtgttgaggtgaaagtctgatgttttgtaaccattaatctctctgccttgggatttcagggcccaaactttgactctgaagtggtgcttagtcagctcctggactctatgtagcaggggatagatgtgcaatactgggaaatatttccagtgtcagctcttgccaatctaccaggaaactgcccgctttaccagcgccttagacagtaactggaaagagaagtaatttgtgttctcaggagtattattcatctggaagcggtgtgatcagtgatacctagaaaattcatgtggctatagccaaaattgggttcttgggatacccttttcaggttttgagatggggagtcagggaaacatcagtaggtgtaacgcgcttgtcctctgagtcctcagccctagcaccctctcaatagctaaatgtggtagagtgtctgtaatcacagttgctgggaagacagagacaggtggttgcttgctagtcatcttctctaatcaagttcatgggttccagattccatgggagaccctgtctcaagaaataaggtggagagtgaccaaggaagacaccaatactgaactctggcttctacgtacacatgtacacgagtgcacacacatcttactttacacatcgaagcttcagagcacatttccacaaactgatggtcaactgcctctttttgtgattaaagttttattggaacaccccctccccatagttttttgtttttatgttttccatactgtgtggccctttatagggagtttacagagtactattctgagatcacatctagcttttctgtgtcttagggccttgtatctgctctaagcactcctggctaatagcatgagagcctttgggttgtaactttctgagttccttccctctacccaaatccccatttttccccctcctctcctccccttctttctttctctccctccccccttcactatgtttattgataatctgtcactaccctaaggggacatatatgagaacctagcacagtgtctggcccctcataggtgcttataagacatttgtgtaatgagtaaatgccttctaataacccattacatctgttagcttcctctagtggaggcttcttccctctgggagtagccagccattagagagcttggtcacacacttgcccattgtccatagtaaacaggacacctgtgttgtaccaggttctgccaggaacctgtattgtacccaaatctatagcaaagagcgaagttaggcccaagccagttgcagcttatatgatgtgctcactaggcaagattgccacccaggcagctcctagtactgcatcgtgtgtgtgtgtatagcacgttggacactggggcaggtttgtctgcccaccgcttaccgagtgtctcaccggtcagagtcctgagcaggcataagtacagttgagactggtcagatgtcctggggctctggtgtacctccattatctcccagccctggaactgttcagccggctgcttaacattgtggagcctcgggttttcatctgtaaatgaggatactagcagaattggctttagtttcacactgaaactaatacaggtggagcgcctgggagtgaagctgctgctatttactgtgcactcaacctcttcttaccattaagagccacctcctccaactgaaggaaagcagcttagagcagaggaaggctttactctccgttcagattctggtcttacccatgtgactatgtccacattaatttgtctgaaattgtgaacatgtgcactgcccccccccccatgacactcaccctttaaagtttggctgtgtcatagtggacggggcagttgctaaaggttgttgagccagatagttgataagaagtcagatagcaaaacaaagctttgtcacttcagtacaataggaccaatgaacaccatgtgaggtatgctgtgaattttccagaaatcatgatataggaggaccaggtagaatcaagtccttaatactgtttatgaataagctgtggcttcacctgaaccctgtataaagccagagaacagactacagtggggcatctgagctccctccttcagctgacgagagctcagactttgattcttaactaccacctttattacaaggcatttgtcacacaaaagtcatagctttttacttctgcaaaccagtggcaatgcaggtgctctcgggctaagaaacccacagattccatgagcacatagataaagttggcgccttgtctagcacgagtcagcagacccttgcaaagactgtttcaccccctgaagcccgggtgagccatctctatctaggccgtcctggttttgtccgaggctagccgtagtccgacaattctactcaggttcatagatacctaggtacctgtgctgtttgaacagctgtgggaggaggtggacgcatccaccctccaagcagccatgctgccgaggggcagagctgtttcagttgcctttattttgttcagatcttttctttctaaatcagttcctccccacccccaagggaattagtttattatgtttacttttggttctgaacatctaaggtttcctgaagctttggtgggtgtagataccaagccctttgcccagacttaggtcaaaggtaccgaggtcctactgtctcttgctcttgctccaagtgctggggtagcagaagcaccctgccccagctggctttttacatggatttgaactcagtccttagatgtacagaccaaaggctttccccacccgtgccattgccccggcccctttgctgtgatttacggagagagtgccttacttcttagctgcactgggagttaacaatacactaacggtgcggtgggtcctttaatccacaccagaaaccacagcaaagatcctgccaccggtgggtgtagaggtacagactggaaggggtctagacagcctcagctggcagccaggcaaacggcaagcctactcagtgtttcttataagtggcctagaaagccctttcatacctggagaggccaagtcacccctaagtgcttcagactcttctctgtgtactctctgcaggtctgaggttttgttcttcactcatgggaggaagtttagcaaggtttttgaaggccagctaataggtatctgatcatgtcttcccctaaggaagtgtggaaatgcttctacatactttagctcttctagcagccttggagcctgtgatttggtttcctccccattgccttccataggtttctgttcttctttccctacaaagtgaaactagaaccatacagtagtgctggggcggaagtgcgtttctaaaacaagctcaggaagtcgcttaattagcccaggaaaggaacaggggggggggggaatccattctctccacacaatctgggataattggagttttcctaatccatttagagcgaggaccctgccccaccccaaaatgacctgtacttgtacagctgtttcacaagtagtaacacccccacctccccagacatagtcatcactgaggttcacagttccacctctattccttcccactatgttattctttatagactcagccagatctccccatctcttcatctcttcactcttggtatttcccataacagaaatggatctatattctgtggttgttggaaaaaaacaaaaggatgggagcctttgaaagttcagtagaagaagcagactgctttttgacttgtttataggaaaagctctagagtatagaaaagtaaggaaggctgtgggtggaacagaagggaagcattccgagtctgcagcatgaagaaaggacctgtgagaacatgagaagtagggctgtgggcttaaggatacaaagccgataggtcaggctgtgcatggtggctcgggctgctaattccagggcttgtaatgctgaagcaagagggttgctgtgcgttcaaatctgattgagaccctgtcttaaaaaaagataaaaacaaaaatgaaccaacacacaaaatagataactagtaaagatgagttcttaacaatcttcccagggcatgccatttggtacatagtgtatagtgaaaaggcaaggttggtatgtacatgcatgtatgtatgcagggatgcatgcatgcatgcatgggtggctggatagatggatggatggatggatggattggtgggtgggaaggtaggtagatggatagatagatgggtgggcaggtagatgagtgagtgggtgggtgggtggatggatggatggatggatggatggatggatggatgggtaggtaggtagatggttgggtgggtgggtagatagatggttggatgggttggtagatggatggatgggtggattggtagatagatggatggagaacatcccaactgttgacctctaccttaaaggaatataaatctattgcatatagtttaaaacaggaagttcagaaaattcacagtgcccctgaaactgcatgtaaaaatttgaatgtctaaatgtttcccctttttgttatagaaagagttcagaacaactttcaccagaagggtttcatctcaccaaaggttaaggacctctctttcaaaccagtcctggaattgcataacataagcgattgtacacattccccagacttacctcctacatcttccagtgcacagcacagccaccttctgggctgcctgtgacctcatctcttctctctcttcctatacagttcatccatctcaggagcctggctggttggaggggactctgaatggaaagactggcctcatcccagagaactacgtggaattcctctaaccttgagccccagtggagctgctgagcttcacgtggtctccatgacaactgctgcttctggtgttgtgggccacttttcattgccactgagaaagcagggagcccgactgttgcttcctgccaacacaaatgcatctgggaacgtgtgccaccattctccatgatcatctcagcttacagcacagtaatgctgcaagaactgcacagcaatcagcagaggaggccattggattttgataacccagaggaaggcttgcaaagctgtcttctcacgagtgccctaaatagagagccctgatttcatttcagcagtcatccaaacccccagccttctgggaagaagaagcaggatgagaatagtgctaaagaaagtgcatcgctgctgagttggaagaggcagggcaaagaaactggcacaaggtgcaggctgcctctactgctgttgcttatagcaggcgctctttctctctccttccttctcccagagacacagtgctacaggcagctgggtctgtctgcaagcacacaggatgaaggggttgccgcactgtttatatatggtccaatctctcaccatctcttgagcagctgttggcctataatcagcagatttcagtccagtcctctcatgcaaagaaacacacgcccctcacgttctctgccgctgaaggcttccatcactgccatcacctagtaaccatagcaacccaacctactctaaaactaagccaaaaataatacttctctttgtataacannnnnnnnnnnnnnnnnnnnatttttttttttttaatggtcttccaacaatctgaagcagaggattagaccattagagtagtctatttggggcagatagcccttagaattttttgttactgaggtcctgggattttagagatgattcttgggccaaactttgtagcctgatttttaaaaggacatctatatcactgccacccagaacaaagagagggaatcattaaataggatagcccattaagaatctgtaggacaccaaatgttgaggcctggaggctaggctgggtaccttcaaagagagggaattctcattacaaggacaagcatcacatgacctcaaaagaacacaatcatggtatcttcgcactcgaatgtccttgatagagggactctggacaaactgtcacactttccaggagcctctctgatggcaacgttgcaccagagagtgtctcaggctcctggaattcccttagggttctttaatgaagagaagaaaacttgaattgtgttgaattactgtatcttctgcttttttttttttaaagataaacttgtaaatagaatgatttgaaatattatatggtaaagttttatatttgatattctttaagctagtttgctccatacatttagtattttgattgctgaacagatgtgtttaaaaggttgcaagagaggccgggctaaagagtcaaggtcatgtcccctcactggcccggtgaaagaatgtgtcctcaatggttcctgttggtgagcctggaaagttggttgtattcagttgtctttatctacatgtgatttggggctttggagttcaaaagagcatcttcaagcagtgaattttcaaagaactcccacccaacagtaaagtgacactcaggatctcaggatttaaataggtggggtgagggcgacatgtttgttttttgtttgtgtgtttgttcttctcaggtgtatttcttggtaccccaggatgtccagacaaaaggagatgagacaacactcctttttcccccacatctccaagctagtttataaatgtgtctatcaactctaagaactaaacaagaaagccagctgctgtggttcttggtcattggtgaactttactctcttcctatagacgtgttcccgcacttccccttcacctccaaagtcccggcagccccaaagtaaaaaagaatccccaagatgacactgttacagtttttagaggtgctgtaatgttaatagttcattgtcgggattcagtattgagtttaccagctcaggattatactgttgccaaccaaggacccagccaggagcaagggagacttgaactttcagtcaggcaaacacaggattccaaactgacaatgctgggtgtgatggctcatgtttggtcttagcacttggaagacagagacaagaggattgctgaagacttacgccagccagatgtgaggctggaggagggttgcaaacggaaggaagaaaggcagtacactcaggttccagacctattccctgtgagcttgagaaaaggttgggcaatggggcccgaagggcatgcacactcaagtagcattgctccttccaaattaaaagagcccagcatgatacttttaatatatctgatggtttaaattgtcgcctgccccataataaatgaactatgcttgtagtcagggcccagcacgactgcttggatacatattctttctctcctgagctggccctggtttgaaactgctctcttaggctgacctccttccagtttccctgaggccatgtgtggcctatgacagatggtcgctctgtttccctttgtccagctaggcctccctcctattcctcctcctcgtcctcctcaggaaaaagaactggagagattaatatgagccaagtaggaaggaacttgaagattaaaagtgttatgtgccctttctgctctctgaacacccctgagctccccacaaataaggaaaactggggtagatcatgaggaatgagttgatatcagaatggaagttcattgaccagagtcccaaagatttcccaggagctttgagtttctcttgtaagaccctgggatgggttggttatggtttgaattttggagcatcaagatggttggtcttactctctgagatagagagttccataattgaacagtgccattctgtgctatgaaatgagaagatagctgctttcacatctctgcccccaagcaaggaaaatgagcttgttcaacactgatgaaattctctattttttctttttttaaaataaatgtgtgtgactgacctccattcagtggatgcctcagtctttagtattagagccagtttgtagtatttttaaagccattatgtgaagtcttgtggatgctttttttaattttttttttaaatcagagaagaaatgagaagagagtacttccaactgggcactggtgagccagagccatgctggctggttgggagttacaggcgctctagacctgagtgtgccacatctggatcttaagggaaatccttcttaactgcattcccccccaacccccccaggacagtagcaatcacaccaaaagctgcttcagtcatagaacttccagaagcatccattattgaggcagggggaagtagactaaagagggtgagatcatctgttcttggccggctatatctgcttcctgtgacaaggctgtttacctagcttcatagccagcgagcttgggggtgcaccagtgaccacacatttgccctggcacccactgttcttagtagacaagggaaccaagcgtctgcttagctacctgtctttcaaaggaatgttctggctgtctaggaagggagttgtctgccaattctgtcaaacttgacagtgatcacttacgttgatagccctgtcccaacagccctttaatcagtcaggtgcccctcactccccatagtagtgcatgaaaaaatatcttttgcattcaaatatttctgcacccatgcagatctagtgtttgtctgtgaatgtagtatcaaaatgacaacagcagagagctgggactgaaccttggacatgcctccaacatgctgagacaagactccaccaggcgatgacgggccttcttccctttgccgcccacagcacgtgtctaacttaaagagccaccctaagtagacagagattccagacgtcactcggaggcagccctgtactcatggaaggaaagcatagatataaaaacacccggatcaggaaggaaaggtgagccaccctgagagcaagaactaagcatagtcctaacccacagagggagggccaagaactatcctgtcaaaattcacattagtgcagtcagtggggagcaaggttgtggtaactcagtgtctgagcgacctggagtagcttcaggcaggctggcatactctctgccatcatgcactcacacatgcatacctaccattcttgcggcttctgagtaaacaccaacaaacagcatccccggggttcaagatgcccgagtcagcttggtgtctgtgaaagcatacatgtggggattctaaaatttgtgtgtgcgtgtgttggtgtgtatgtgttcgtacatagcacatacaagcataaaggtgccgcctcgggtgtagacacacacacacaagctggcatttgtaaagctcttacagccttgaagatttggagggaagagttttcagaggaactagagtctgtcagtttcctagcaaaagatcaaagctacaaacgagctgtcatctgaagcctctgttcgtgtttatcacatagttatccacagctgcgttccttggtgactccagtagctaatgctaggctagtgttcaaaagcactctaaaagacatttagtccatattttgggaaagaaactatttgcatgtttaattcatcttttaggctgctgttgagtatactgtaaagtgctgtgtgatatcaagccagtaaagtacttataaatggcactttaatattttcttttgagaaatcataaaacactgttgtaaatttcactattgaatattgactggtacatagaatcaaactctgtaattaaaaagtagcctgcagctaggatagaacatttttcttgttattagagaaaaaaaaaagtttgccatgttcaggcttttttaaaaaaaagtgtttctgtgccattgttcgtatctataaagaaaatacaatttctgtcaggcatctctgaaacctggctttttttatgtttggttcgtgtctgtggcaatccctataaagtgagtggaagtatgatttttgaattaaatgactttcccatttgatggtgtgtttgtttcttgggtttctggttagttttgactcaacttattttaatttatacactgatcaaaggtcacaagtttaggcccttacagttatgattgtcgactatggggcttttttattttatttttttaatgagctgggagtggctctgtgttccacttaccaagaagtcaaaagctaatatacttgaatcggctattcaggcctatcacgtagttgaatctcaaatagtcatatcccacacaatactaatgattttatctccaagagcacataataagcttgagtcttccaaaattcagttttctaatcagttagcccttttctagaactcaatgcagaacacagcaggctgactgttccactgagagttcttgatttttcaagccttccaggaatatcccgagttgtagcttgggacccgggtttacagtgagcctctagttcctgctcagtttccaacgcctcatggatgcctctgcaggaaggtgacccagacagagcagggagaacagagagacaggggtgctcctttggagcctgggtttaaggaggaagttatttgaatgtgtaggtcacaggtgaccagtctacattatccttctttgccaagctcggccttggttgagttctgggaacagcacaaatgtcccacacctgttgtcctcactgagcctgcaggtcctctagaaagagcccttgaagactacacatatgacatgtttggtttctgagttcaaaggcaacttgggggaggggcgatgaatttatttggtgtacaaggccctcatcacagtgccattgaatgaagccagggcaggaactcaaccaggtacagaagtagagaccatggaggaaggctactagctctctttagatttcttggctgcttatacagctcaggcccagctgcctagggatggcaccacccacagtggactagaccctctacattaattaaaaattaagaaaatggctcatagatatgtccacaggttggtctgacaaaggcaatgcctcgactaaactttcttcctcccaggtgactctcctttgtatcaagttgacaagagataaccagccaaagcccacgtgtgtctgacactattgccaagagaatgaactatgtgagtctgttcttgtcttacttggccttgtcctttcccataggctcccagtcgttctgacttttttgtctttgaatgtgaatggttttaacttcagtttacttatgagccacccggagcagatcttgaatggtgccctgtccagtgctttgctgatgtgctcatgatggttccagcagcatggttggttggttggttgcaagagcaccatgggtagaaacgtacttgattgacaattgaaattaggtaactggtactaggtatgaaaaaatattttctcaggtccaaaataaacaagaaatactttctcaggttctgagaattatgccacgtctttcttctttcctcaggtcttcctaggacttcactcaaacaccacacatctgtcaatgcttttaatagtactaggttaagctccaactaattaagctgtctgactccggctttctcggcaaccaaaagtagctctaaccatgccagtaactgctcaggtaggtgaggctcctggcccaggacagctgttctaggggaagggagggacataccaaggtaccagagttccaaccaccctgggataatcagccaacattagacatttgctgaagacccatgatggttttccactgaaatgatcaaaaacatctcacagcggttggttgtcatactacatagctacctgatcttttatggaattgaccccaggagtctggccacaggcgctgctagtgaggccccgctggctataatattgcttcctgagctaagccaaaactccagtgaagatttgaattcagagggttctttctggagacatcaacacacatcctaccaggtcttgtacctaccctaaagtccagatgtgctccagtactatggccagatgtcccttctgtattcattaacttgaatctgcaggttaagtgacccttgacaaaaggccccattacctcataggctcagagtataaagcctatcggaacaagactttctgcccttcactcaggcatgcagcttccccggctggtgctcttgactcaacaacccttctggctataagcccatgactaagggccaaaagcccctttactgtcatctgggctactgatgactcgtgctaagctggaggccccattcgacaagtcccagaatcaccctaaacactaaaagtacttcttccttaggacccatcacggaaattccgtgctgtcccatgggatccggtctggtatctatcactctcactatgggaattctttgtgtgtgactgaagtttcccatggtgcagctgtaatccatttccatcctggctttttgtgtggtgaacaattaagtggtttccaccctttttttttttttttcagaactttcagtttttatgcttccactcagaagtttcctcttgaccagttcacatgccaggaaaggaacccgcctctagccgcttggcacccccacccaggctttacagactaacatagatccttgctacaagagttagaagtaagaaccagacaaagcctggaaggggtgaccttcaaggtggaccttggtagctggagagcacaagccggttaggtccatggagagcagtcccgagtctacccaagtggagaggtgggcacaccaaagcacgaaggtaaaggatcagggactggggtaacctcagcataactggaccatggggagacagggctctctggaagttgcaaatggttcaccctcagctgttcccaccttagtgcttaggtttcttagtctcagttgacaaaattctgtactgggcggatccaacacattgctatatcccctccccaaatcttcaagttatagaaagcagtgtcatcgtcccacctaataggtaatgaaactgtttatggtatacacacaagctaggataaggtgaaactacaaccccatcataaatctatctagttctacaatctctgaaaactgttttagaaattccttcctacactatcgtgtctcagtgcatgcacgtcccacccaggaccatttctaagcttggggaagggatatccttccctgttcttgttttggctctctcactctgccccccgtttctgtcttctccatccctgtgaatgatgtcaacagcctccacttggccttctgaccactgagtctctccaagagcacagcctctggggaagctgagctgtagttctacagagagaacgagctgggccagtctgagttacaactgtctttcgtcttgaaacctcttgttcactgatcttgggctgtctgctccccagttgttgggctttcttgcacaaattcttggttttcaggtcagtgcccggactccagctgcgagctttggcaggcccagcacctttgagcctgcactgtggaggcagccccagcagaggcccacccatgtttgcctgactggaaatatggcatgtgaaaattctttaaaaatttattctgaaaacatttcttttccccagctgctgatggcataactttaggccagggaaaccccacggacttgtgtcttcttgtgtgagaaccacaagaaatatttccagcccaatcactatgggtccacaaaagatcatttcgtggcatttaaactccttcttgtgcctaaaagtcagaactagtggaggggcaggaacccaagtagatgacagctgaggtcccagggcccagagaatactggatttgtactggctcctctcctaaagagaaagctcatcagttcttgagaggcccatctgatgtgtggggcctacctcaggtgtggggcccaccgacctgagttgttcaagaaaatggccgaggacagagcaggcctgtgttacagagcccactaggacatgttagacctcacatggactcttcccctctgcacccccttacttaattctcaaaccaaccctgtgaaacaggtacctgctgttattccattatgcctgtgaggaagttaaataccagattaggcaacttggttcaaagtcacagagttaataagtaacaaggcagagctaaccccagctaaccccactgctcacactcacaccatccacaactgtcacactgggcaaggcccagaggctccacactcccatgcccttcggtcccccacccgcagaaaatagctgttgttcttatctgctgacagccagcaaccctttctactggtaagaatacctcacttttgcttcagaaaaccacatgccccttaccctccagttcccaagggtttgtatggcctggcatcaaccctgcctccagtggtgaccatgtgttctggcctggtgtcagatcaagagtttgattgcttcaggaataaaggcggggtctactgtgtcacagcgttgacctggagcggtgtacacaaaccccagcataggataggaaaaccctgtagagaagagagagtgctgtattccaccatccaggaggttctctgagtcacttcttcctacccatctcttatctaaagcccaggctgaggccccttcccttctgtggactggttgttaagcctgaggagtgcatctgttagaaaagttgcctcagagagcaaccagaaacctgtgtgtattgtgattataaagtggacatatagtgtattggtttttgcaatgctggaattggctcacacaaagaaaagcctaacgcctgtctccttacagccagcgaagctcatttttactatactgacatttggtctcctttctgagccaggagaagccatgactgactacatcttctaaggacaggaaagaattatgtctgtcagagccctctgagaggagactctcccagcccctgctgattcaccctgtcacgggctgactggccctgcagtgatgcttcagtgttgagctggcttcaccccagagctctcacaaaggatccccagggcagctctaagcaggaacggcagaaaatcgtgtctaaccgggaaatggaattgggtgtccatggagcactcatcccagagctgagcacaccctgcagccgcacccagacctgctcagcagtcccacaaacacaggcctgagaaacaccagacgcccagttcagactttcacctttccttgggtggggtagcatagctagctgggcctctagagggacatgggtgggtgtatccccctgctgtgatgctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagatgagagagaggagaaaggaagagatgaaagccgcagaagctcctagtgggagggaaggggaatgagaaaggagaaattctagctctttggtgtagcatttgagctttcttcccaaactggccccaacattttttttaaggttgccctactctttagcacacattctttcatgccaatagcttttattggacgtctgtggtgtccatgt

SEQ ID NO: 332 - DNA, 2915 bp, Mus musculus
tagatttgtcttcggcaaagcggaagtttgcagattccttaaatgaatttaaatttcagtgtataggagatgccgaaacagatgatgagatgtgtatagcgagatctttgcaagaatttgctgctgttctcaggaatcttgaagacgagcggagtcgaatgatcgagaatgccagcgaggtgctcatcacacccttggagaagtttcgaaaggagcagattggggccgccagggaagccaaaaagaagtatgacaaagagaccgagaagtactgcggcaccttagaaaaacatttgaatttgtcttccaaaaagaaggaatcccagctacaggaggcagacagccaagtggacctggttcggcaacatttctacgaagtatccctggagtatgtctttaaggtgcaggaagtgcaagagagaaagatgtttgagtttgtagagcctctgctggccttcctgcaaggactcttcactttctatcaccatggttatgagctggccaaggattttggtgactttaagacacagttgaccatcagcatacaaaatacaagaaaccgctttgaaggaaccaggtctgaggtggaatcgctgatgaagaagatgaaggaaaaccccctggagcacaagaccatcagcccgtacaccatggaagggtacctgtacgtgcaggagaagcgtcactttggaacttcctgggtgaagcactactgtacctaccaacgggattccaaacaaatcaccatggttccatttgaccaaaagtcaggaggaaaggggggagaagacgagtccgttaccctcaaatcctgcacacggcgaaagacagactccattgagaagcgattctgctttgacgtggaagcagtagacaggccaggggttatcaccatgcaggcgttgtcggaagaggaccgtaggctctggatggaagccatggatggccgggaacctgtgtacaactccaacagagacagccagagcgaagggaccgcacaattggacagtatcggcttcagcataataaggaaatgcatccatgcggtggagaccagagggatcaatgagcaggggctctaccgaatcgtgggggtcaactccagggtgcagaagttgctgagcgtcctgatggaccccaaagcagcttctgagacagaaactgatatctgtgccgaatgggagataaagaccgtcaccagtgctctgaagacctacctgagaatgctcccaggacccctcatgatgtaccagtttcaaagaagtttcatcaaagcagcaaagctggaaaaccaagagactcgagtgtctgagatccacagtcttgtccatcggctcccggagaagaatcggcagatgttgcagctgctcatgaaccacctggccaatgttgctaacaaccacaagcagaatctgatgactgtggcaaacctgggcgtggtgtttggacccaccttgcttcggcctcaggaagaaactgtggcggccatcatggacatcaagtttcagaacattgtcatcgagatcttaatcgagaaccatgagaagatattcaacacggtgcctgatgtgcccctcaccaacgcccagctacacctgtcccggaagaaaagcagtgactccaagcccccatcctgcagcgagaggcccctgacgctcttccatgctgtgccatccacagaaaaacaggagcagaggaacagcatcatcaactccagtttggaatcggtctcctcgagtgcaaacagcatccttaactctagcagcagcctgcagcccaatctgaattccagcgactcaaacctggatgtggtcaaacctagtcggcccagttcactccccccgaatccaagcccaacttcacccctctcgccatcatggcccatgttctcggcaccatccagccctatgcccacctcatccacgtccagcgactcatcccccatcaggccagaagaagcggtccgtgaagactccagcacaccattccggaaggcaaaggctttgtacgcctgccaagctgagcacgactcggagctctccttcacagcgggcaccgtcttcgataatgttcatccatctcaggagcctggctggttggaggggactctgaatggaaagactggcctcatcccagagaactacgtggaattcctctaaccttgagccccagtggagctgctgagcttcacgtggtctccatgacaactgctgcttctggtgttgtgggccacttttcattgccactgagaaagcagggagcccgactgttgcttcctgccaacacaaatgcatctgggaacgtgtgccaccattctccatgatcatctcagcttacagcacagtaatgctgcaagaactgcacagcaatcagcagaggaggccattggattttgataacccagaggaaggcttgcaaagctgtcttctcacgagtgccctaaatagagagccctgatttcatttcagcagtcatccaaacccccagccttctgggaagaagaagcaggatgagaatagtgctaaagaaagtgcatcgctgctgagttggaagaggcagggcaaagaaactggcacaaggtgcaggctgcctctactgctgttgcttatagcaggcgctctttctctctccttccttctcccagagacacagtgctacaggcagctgggtctgtctgcaagcacacaggatgaaggggttgccgcactgtttatatatggtccaatctctcaccatctcttgagcagctgttggcctataatcagcagatttcagtccagtcctctcatgcaaagaaacacacgcccctcacgttctctgccgctgaaggcttccatcactgccatcacctagtaaccatagcaacccaacctactctaaaactaagccaaaaataatacttctctttgtataac

SEQ ID NO: 333 - protein, 718 aa, Mus musculus
DLSSAKRKFADSLNEFKFQCIGDAETDDEMCIARSLQEFAAVLRNLEDERSRMIENASEVLITPLEKFRKEQIGAAREAKKKYDKETEKYCGTLEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVTLKSCTRRKTDSIEKRFCFDVEAVDRPGVITMQALSEEDRRLWMEAMDGREPVYNSNRDSQSEGTAQLDSIGFSIIRKCIHAVETRGINEQGLYRIVGVNSRVQKLLSVLMDPKAASETETDICAEWEIKTVTSALKTYLRMLPGPLMMYQFQRSFIKAAKLENQETRVSEIHSLVHRLPEKNRQMLQLLMNHLANVANNHKQNLMTVANLGVVFGPTLLRPQEETVAAIMDIKFQNIVIEILIENHEKIFNTVPDVPLTNAQLHLSRKKSSDSKPPSCSERPLTLFHAVPSTEKQEQRNSIINSSLESVSSSANSILNSSSSLQPNLNSSDSNLDVVKPSRPSSLPPNPSPTSPLSPSWPMFSAPSSPMPTSSTSSDSSPIRPEEAVREDSSTPFRKAKALYACQAEHDSELSFTAGTVFDNVHPSQEPGWLEGTLNGKTGLIPENYVEFL

SEQ ID NO: 334 - DNA, 344548 bp, Homo sapiens
agttgaggtacttcccagcatagcatcttgcaactccatacgtggagtttctccctgggtgccagatcccagatcagtggttcaattgtacccgctcgtgggcctgtcctggacacacacctgcacagagggagaagtgaaattgagagggagtgttgaaatttccctgcttggagtaaactgttgttcttatcacaaaggaagtatttgggacttctgtgaacatggcccatggccttttctgagattccctgccctctgacagcttgttttgtgtattggaaaggtctagatgaggatggctctgcaggaatttctttttcactgtaagaatctgtctcccatggaacccaggttgtcccagggtatggggagacagtggagactggtggtttcaggatgatccaagggccttgggggcagatccaccaggacagaaatcccagctctgccgtatactagctgtgtcaccttagtcaagttccttaatggcaatggattatattttcttcctgtatgttagagatacagataatatctcttttctaggaatttagtgaagattaaataattaaaattaatgaggattaaataaggtaatgtatgtacagctatgggcatgattcctggcacaaagttagtgcttaggtaaccattatcattattcttatttctgtttggtttgttgattacttttaacatgtgacatactatttgggctaatatgacgtctgtttggctcacccacttaccttttttattgatatgtaataatcatacatatttatggggcatgtatactattttgatatatgcctataatgtgtaatgatcaaatcaaggtatttagggtatcagtcacctcgaacatttatcatttctttgtgttgggaacatttcatatcttctagatattatgaaatatacaccgtacatcagttagccatagtcatcctactgtgttctgaaatactggaacttattccttgtatctcactgtatttttgaacccattaagcaacctctcttcatccttcccaccccaccccacccccccgcttttttttttttttgagacagagtctcgctctgtcaccaggctggagtgcagtggtgtgatcttggctcactgcaacctccgcctcctgggttcaagtgattctcctgcctcaacctcccgagtagctaccatatgtgctaccatgcccagctaatttttgtatttttagtagagatggggtttcaccatgttggccaggattgtctcgatctcttgacctcgtgatccgcccacctcggcctcccaaagtgctgggattataggcatgaaccacggcacctgactcccacccctttcttagcctctgataactctcattctactttttacttccttgagatccacttttttagcacctacatatgaataagaagatgtgatatttgtttttctgtgccttcacttgacataatgacctccagttccattcatgttgctgcagatgacagaattccattctttttcatggctgaatagcagtctgtgtgtgtgtatttatccattcatccattgaacacttaggttcacttcatatcttggctgttgtgagtagtgctgcaataaacatgggggtacaggtatccctttgatatagtgatttccttttctttggataaataccaagtagtgggattgctggattatatggtagtactatttttagctttttgagaaatctccatactgttctccataatagttgtactaatttacattcccaccatcagttcccttttctccccatccttaccagcatttgctatttttaatcttgatcatagccattgtaactggcttgagatgatatctcattttgattttgactttcatttccctgataattagtgatgttgaacgttttttaatataccctttggctatttgtgtgtcttcttttgagaaatgtctattcagatctcctgcccactttttaatggtattatttgtgggttttttttttttctgttgagttgagttccttgtatacatttacctttttaaaccaataatctcattagaaagctttttttttgttttaaaaaaatatgtatttaagttgtataatatgatgtttcagtatatttttgcatagtgaaatagttactatagttattcttcttctgtgtaatgctatttgatttgtttttgaaaattatctcccgagattttttttttctgacctgctttcggaatgctatccttgggtagtgacttgatttttctcttaaattccatcttgtttgtaggcagacagccaagtggacctggtccggcagcatttctatgaagtatccctggaatatgtcttcaaggtgcaggaagtccaagagagaaagatgtttgagtttgtggagcctgtaagtagatattcagggtttaatgatgtacccatatattcatccctcattctaactagtagtagattacaaaatgctctaagttgttgatgaagaggttgagcagccctgacactgtcccttctgtaagtatcagtgctttgcgagcctggctgccttggattcttcccagcagccattcctgtacaacacatagcaatggagatagagcgtccagcagtcattccttcctctggctacccaatgatgtgccatatgattttcaggtggacagagtggaaatgggagtccagaggggaggggttctctatcttgccatgaaatagtgattataccttaacttccctcctctctcctacccttcttctcttcctcaaataattcagatgtagtagtcacccaaagacatagtacatttctctttttaccctgtggttcaaagccccttctcaccccattcaggtattaaaagatgctatataaagtttctcacatggatttcccacatggatttgttataaacagaacagcatagagactctgctgagtggaccatgatggaatttggacttggacactgtcccagtgaacatgaagattgcattgtgggaaaaagcctgactttagtttaggccacaccagcatggttgtggtttcatttggacatggtgccactccactttgctgggtgtggcactggtgtggagaatccacagcaggaagacttcatggaaacaccaaaatagtatatggacctcaatttaaaactctcgcagaccatggattttccagccaaaatgcagcctctgatttagactcaagcatggcatctctgtacaaataagattctctacctagatttaagaaaggataattttcttttttcttttttttttctttgagacagcttctcgctctgtcacccaggctggagtgcaatggtgcaatctcagctcactgcagcctctgccttctgggttcaagcgattctcctgcctcagcctcctcagtagctgggactacaggtgcacgccaccacgcctggctaatttttgtattttttagtagagacggggtttcaccatgttggccaggatggtctcgatctcctgaccccgtgatccgcccgcctcggcctcccaaagtgctgggattacaggcatgagccagcacgcccgaccaagaaaggagacttttcttaagcaaataagaataaaactgtaagaaactgaaaggagtggccactctttctagtaaagagcattgtgtaccccatgtctaatttataaacttttggggtggatttttttaggcatgtagacttgctggtagtttcatcaagactccaattggtggccaggcacagtggctcatgcctgtaatcctagcactttgagaggctgaggcaggaagatcacttgagaccaagagtttgagatcagcctgggcaactgggcaacatagtgagactccatctcttaaaaacaaaaaaagattacaatcggctttggaaccttatgtctacatcttttactatgctagaactataatttctggataccactcccagctacctcatttggcagattccttaaagtcgtcaattacttcagtctccatatatgaatattaaaaccttagacctaacttccagcagtggtttcagtcaaggtcccaagtcaaaaatccccatctttccacagggtctgttaggtgtgagcagctatctgtcagataaagcagccttattgattttcctgcttaaagcacaaactggcctttcaagcaaaggtttactgaagacttgcttcctgtggtcagggcaggaattcaaatgctgtcacatagaatttgcctttagcattatttttatttgcttttgccagactttctagagaaaaagaacagtgcatttctaataatctttatatatacttcgattaatattattccaaatttgcttgcttttgatgagttttttttgtaattggcccatccaacttttttgaggtgagtgttttgttatccactttgatctctcagtaggcgtacctagtgagtcaggtattttatctgttggcttttgctgaatggtatccacaaaacctcatacaacaatagatgtttacttctcacacatctgtgaggttcagccagcttaggcttggctcagctggatagctttgctgatctaaatgggttttcctcctccttcttctccttcttttgtctctcctccccctcttccttccttctttcttgagaaaagaaatctctaaagatttaccattccatttcctggcatcctgttgtagtgtgtccatgtcttagggagttttcactttaagaagcagtagcatcatggttaaggattctagagctagactccctgaatttaaatcccagcctagccatttactagctgtgtgttcttgggcaagttatttctctgagccttactttccccatctgcagaatggggatagtaatatcacctactttataaagttgtatgaggattgactgagtgtttatccatgtgaggtgcttagaacagaacctgattagaaccaaataaaaacttagcaattattattttttatttatgagcaaacgagtgaagtaccaatattaacagggcctacctgttttaatataaacagttttggtagctttaaaagtatgtatttattgaataccgtagaaaatgctgaaaacccaggtgctgtggctgaggcattcacagcctcactggggtaagcaagatgtgtgtagtagagagctagtcaagatagcaagcagttcagtgacagcttggacaggatggatgctatagatgtgccagagggatttaaaagtataaccatcgtagtgtgcagatgtttttcagttcatacagtgagaaacctggagagctaatgaaaagaaattttcagtctcatgttaggacaaagatagtaatagggatttgcccaaagttaaactaaatgctgagaggctggatataggattcagatgtttggcctttgcttttctacagaagttattgtctctgcacatcagcttctaggcaggtcagtggcttcaggagctggggatggggagaaggtattcatacagtgaaaaagctactgatgagatcagtgattctcagtgttagacatgcacattctcaggcttcactccagacctgaaatttaagggaggggcccagtagcctgtagtttagtaaaccttccccgtgattcagctgcacatttcagtttgagccactggcctagattatacaaaggaagaacatgaaataacaattgatgatattatctgaaactgtcgtgtaccgtgctaagcgctttacctacagtatgtcagtcaaaccttataacatctctgagggtaagtactgtttttatcccaattttcagatgaagaaattgaaacaaataagtttctttacctgtccaacatcatatctagtaaatagcagagctggaagggtctgacttttcatctccatgaaatagcatttgattgcttacaggtgggaaagaaaccagcaagaagtctattgaactaaattgctggagtgggtattcatatttgagttggttacagtcaagggaatcttccagtcatgtaagggacctctatgcaaatcgaccgtgttcatttgtttcttgaaagtaacttcaagtaccaggatattattgaccttcagaaaaagaaacagttgtagtattcccaaggaagaaaaatcagacttctgggatctaaatcagatcttttgggatatatatgtgtgtgtatatatatacacacacacatacacacacacacacatatatacacacacatacatatacatatatacgtatgtgcatatatatatgtatatgtatgtatatatttgcactggaagctttaattttcttgtcacagtactaaatgttcttgagatttggattgcagataatgacatattgactccatgaaggtgaagccacattccctctgttgcctgagttttcgtaattgaaggttggctagtgccccagagaactcattctccatgttcattaggcctgcatcctccgagttttccatcctgaatatttcttggtgcagtgtctcttcctctcctttccctctgcttctgtcccattgcaggccttcattcttttctctggactttgcattctgccttgggcctccccgttctccagtctggcctggaccagaatgcaccttctaacacgtcagtctgattctctctctctctcttttgccaagaagctcctgacagcactcctgtgctaagcccattacatggatgatctgaattaatcttcactgcaactctgtgcaatagtaaaaaccactgttatcctcttgtcaaagatgagttaaagggagttatgtggcttagccccctcagcttttcatcactctactagctgcccttctctttgttgcctgtgcggatgattcttggtagctgtattagtttgctagggctgctgtaacaaagtaccacaaattgggtgtcttagaacaacagaaatctgttgtctcacagttctaaagcctagaagtctgaagtcaaggttttggcaccaagatccctctgaaacctgcagtgaaaggtgacttcctttcctcctagcttcccgtggcttgtgatcatgtttggcatttcttggcttatagatgcctccctccagtccttcatcctcacatggccatgcttgtctgtgtgtccacattttcacctttctaaggacaccagctatggcatctttgtaaaagtactagggcccaccctaatgtcctcatttaacttgattacccatgtaaagaccctatttccaagtgaaatcaccttcagaggtattaggacttcaacatatctttttttgggggacacaatttaacccagtaaagtaggtctgttctatgaatggtgacaatccagagtgatgcagccagcattaacttgggcaattagatttttgctttttaaaatgaaaaaaataaattatgttgtcagctaggaagtaggaataggttttgcttatggttattcttttaggataacaaggatagagaaggaggcacagggaggcgggaaagatctttcctatgtcaggctgtgatgttgtggttgccccgtggacagctgacccctcttatttgataaccaggtgggactgcagcaagctcttcctcctagtgtttgggtagaagcatttctttgaagcagacagctcccccatctctggagtcccgtgggcttcatcctgccccctgaggagtggactttcatttcccactttgtaatacttcaaaggttcatatagtgttgggggtgggggagagaaaaggtgctgggaggagagaagcaagggggaagtgggccaaaaatagcaatatgttaaggagtcatttcccataaaaaaatggacaatcaaggcatgagactaaaggaggaaaaacaaaataaatattagtaactccctgcctttggggagcacttgcgggtatgcccaggtggcatcttagtgagctgtttgagaatatttaattaccccgagcaagagaggctctgtttactctaagtgaaggataaatcatagttaataggaggaatgaccttggaattaactgcttatcttctgcgttattctcaagtcaggggtagtgtcatgccttggaaaggcgatggggcagggcatttgcagatagcagggagagcagagttaagaagaggcaaaacagttttcactgtgaatgctgggactcggtttggcagaggagcctcctctcctctgttattggagccatctaaaaggaaaggtatgggtcttcctctcagaaaagtattttgtatagaataagcccaaagccttcggccgtctttgaagaaaaacattcattatcagtctctagtgactcgatggggcttaccactcattcacggatttatgttaggggtctgtatatggtgccactggatagttttatagccagaggacccagcaatgcctactctcccaccacccatgagaatctaaggggatagatgggccggggacagtggcaatgggaagttaagggccatattgtcataatctgggttttatcttcacagggcccagatctttgattaaactgggctggcctgccctctgagtttaggtccagtgctatatacttttgtgcttactattcctgctgcaaacaaggtgggagagtagggggagggggggcgggatgagattcctttaccgtcacttattatagctgcctctcagaaaaggagagttagttaggtgaaaataagtgggatggaattatgtttagtaagtaaagtaaattttttttttacataataagtaatgtttaacaggttaaaaaaaaatcatttagggactgaaaatctgaagaccacaatgtaaaataaagcaaatgtgtcttggaataaggtggtatggcaggtcagggaggtcagagtggacccctcagaaaatgtgggtcagccttcagaagccgaagttaatgggatagtccccaaataccatggagctgtgctttgtgatagaggtgaggcactggtctttcctaaatctcgttcgggcttttattataatcctttcttcaggttgaagtttagaactgagggaagatgtgtagaacttgagaaggggccaggaaagcataacaacagtgaggtttggatgtaagctccgagaggaaagaccacaggaatgctgtttgtttagtttggataaatgaaggctggtaggggctcagggaggggacattaatagtttttaagtatatgaagccgtgtggtgagcattgtggtgaacagatgtttttaccattcactaaagacaagactaaacaatgaaacgggcttaccttttagcctgagggatttaattgagaatttagggaaaccaccataagtgaaaatgtgggaatatggaaatattttaataaaggaatccatagtgtttacttttgagtagtttggggaaagcacggaaacacacttcagttggatgattttctttgatttgactttgcctgttagactgtagactcaggacaccccacttccttttctgccttcctcttctgtgtaataacctgatactacaaatgtactagagggaaactgagtcagaaccctggtctttggtttctgaggaaatgatgttctcagcaggtggtgaggcccacagggcaagggcatgggtgttgatgccaaggagacctggtttcaagttctggctgccacttactgtgtgttttggggcaagtttcttaacctctctgaacctgcttcctcattattaaaatggggataacagtagtgcttaggtcatgggatgttgtgagtactcacccagggcatggaagggcatagtgcctggcacacaattggtgctctttaaatgtcagccattattattctttattttagactttcaagccagtgttgggagctcagatacagctacataatacctcttttcaacctggttatgtgacctttgcctttcttccttcattacagctgctggccttcctgcaaggactcttcactttctatcaccatggttacgaactggccaaggatttcggggacttcaagacacagttaaccattagcatacagaacgtgagtgggcatagggacaggcttcttttatctggttaaggaaaaacaaaatatgggcctgattgccctagaaaccatccaggtggcttggaatgtaggtgaggagggtgggtcttgcttgggttcagagggaaactaggggcaggcgtttctagagtgcttggtggttctgagttagaccatcatcctcttctccattatttcaaagccctatttatgttctcggaagtgctgctgctggttatgtttcaaatctgtagcgtctgtagcattggagtcaggatttcctttggcggtggaaatcccagcccaacccagcctccattctatgcatctagctgcctgactacatgagaccgtgtggagtgtgtgttctgggaatgggggctggggacacatgctggcctccagctcaaaggatgttctcttgtccaactcttaggaaggctggcaggaaatccaagtccgtgcttcgctcccagtgtggtcagcattcccaaggtttaaacacaggaccttttggtgcacagaatcctgcgtagggctttttggttagcagtcactggggcttgagcccccttcttcactgtgggattggaccatgttattcttcttattttctttgtctctaggtgatcttgtgtccatgtgggttgtactgcatgggttttagaagcctggaggttacatagtagtcagtgttgtctcagagaacaggaagttgcagaatcttggaaaaggtttcacaaagcatggcttccccttaggccaggtttctcagaatgcaggctctgaaatcgagattgacatgcagtgggcttactggaggtgggggcaatgctggtgaaaacacctgtgacagagtgagggcacctggactcgcagagggggaaatagagctgtgatgcagatgcagcagaggtctcagtgcaggggaggctctggagctgggatgatccttcacagtcgccctgaatacaagcaagggggccaggctttcaacccccttctgcctttcctctagccttgtctagtcattgggtgcaggctgaccttgagtgaaggaactccccttttaaggagggactcatctgtgagccatcagcaagcaacattcatggcagctggagaaatgaacgcctaggtccttaagtcatacaggcccctagagcatctgaatcagaatcacctgggaggcttatcgtaaaacacactttttggcatccagaggtgctgaattgatctgtaggagtgagggctgggcatttgcattttctataagatccctaggtgattttgatagtcactagagtttgagagtcattctggtataggactttaaggccaaagtatacttgtcataagggagtatttggccagttcctggaaggttgaatgtcctttatctcattttagatctaaggattctattaggttgatctggattgttaaaacagatactttgtttctttgatttgaataaaattattttcatcctagacaagaaatcgctttgaaggcactagatcagaagtggaatcactgatgaaaaagatgaaggagaatccccttgagcacaagaccatcagtccctacaccatggagggatacctctacgtgcaggagaaacgtgagtgctttgactagcaacagcttgggatgtactcaggcctcttacctagaaggtggaggatgtattcagcagtgcctaccttactgtagatacatgcttggataacaagaacaattttatagttcacctttccaaagagaaagatgatgtccacagaatcttgtctacctttgtttttctttatgaatgggaattcctttgggaacctgcaattctttaaggctctgtggttgctcttctctctctaatgttactctactcttggggttcctgtacccctagtccagctttatgtaccataccctgagcatagcagccttggaaaggtcttacatgctaggcccctgttatctatcaccagtgtatcctttggtagacttaatacttggtgattctgttttcatttgacattgtttcagcaaggcccaaacaatcatgacttaggcctttttcctcttctcctcaactcatttcattccaacacttgaattttatgaaaagtagaaacaaaggctcacttcaagagccaagaagaaggctgcatgcggtggctcacgtctgtaatcccagcacttttggaggctgaggtcggtggattgcttgagctcaggagttcaagaccagcctgggcaacatagtgaaaccctgtctctacaaaaatacaaaaagtagccaggtgtggtggtgtgcacctgtgggcccagctacttgggaggctgaggtgggaggattgcttaccggagtgagcctgttgaggtttataagagctcaggaggtggaggctgcagtgagctgagattgctaccactgtactccagcctgggtgacagagcaagaccctgtctcttaaaagaaaaaaaaaaaaaaagagccaagaatactcattgttctgccagtgatgtctaggaaaggaatgccaggtgctgctaacatggacattttagtgatgactcacaagttcatgccttatggctggggaaaggctctgtgatggggccgtgccgtttaggatagcacattcagacttaattcgtgtatgcaatgctaggaacgaaagaaagtgaatgtttttttctttagtgggtaattcttctcctagtcctttggtagagaacattggtcttttcagatttttgcaggttttgtgttctttcatgtcctgctcttcatgtagagttaggcagatgtcttcactcctaatagctttccgatgggatagaatagaaatacttggtttcactaattattctatttagtaattactcaaaaatttgtttggacttaagtttcctggtaactggggcagtagtggtgttggagtattggctgtgatgaggattacattccttattcttacagagatgagcctgttgaggtttataagaaatgtagctacttcagctgtgtgttttgtatatgcctgaatacaaagtgatcccctctttgcccagtgagaagatccctgcaaaaggttttaggtctacttgaaaatataaatttttaggactctaaaaatatagttcaaagtccacctataatacttaatttgttaatatatcattcacttacatatataaaatcaatgttgtttttttgcactctcatgtcacacacttttattcagacacttcacatgctctttcaacattagtgtgttgattatcatgaggacacttttttgttccctaacacagtccagagcacatgatggggatacagcacttttttttaattttaaattttttgtaacttgttattttgaaataatttcagacatacagaaaagtcgcaacaatggtgtaaggaacaaccataaaccctttacccagtgcatcaatttttaacatttagccacaatgatatcattccttctctctctgtgtgggtgtgtgagtattcacgtgagtacaacttgcatacacacacatacacacttttttctgagtcatttgagaatatggttgcatataccatgcttcttcagtagtgagtattttctaagaataaaagatattctttttatgtaaacacatctgttaggttggtgcaagagtaattatggtttttgccattaaaagtaatagctaaaatcgcaattgaactcttgccattaaaagtaatggctaaaatcgcaattgaactcttgcaccaacctaatatcaaatttaacattggtgcaatatttaatctgaactacagtccgtattccagttttgccagttgtatcaataatggccttctaaagcattttgttgttctccagtacagaacctcatactgcatttagttgtcatgactttagtctcctttaatctggaacagttctccagcttttctttgtctttcatgacattgacatttttgaacaacacagtccagttcctttatacagttttcttcagcatgggtttatctggtgtttcttcatgattagatttggattatgcatctctggtcaaatcctacataagagttcttctctggggccacatctggacacatgtggtgtcgacctgcccctcagtggtgatgtaaattttgatcacccagtcaaggtattgtctggtttctccactatacagtcactattttccccttgtaactaattagcaatctgaaggtaacaccttaagatcatgtaaatatccttctccttatcacactttacctccatagatttagcatccattgacaatccttgcctgagctgatctttactacgatggttgcaaaatggtgacttctcagttccaccaacccctccacatttaatagttgccattcagtgtacttatgtaaggaagagtcctgctcctctttcttcctccctctctcccttcctactgtctatccatccatccgtccgtccgttatccatctttccattgtcagtttggatttatgggttcctcttttgttcaggaggctataatttataactgtccttatttatcttgatgctcaagttgtccaagatacagtgctttgggaatctttgtgttgttcaattactggaattttttccccagtctgtaagaatacactaagatggtttgtattttcatttgtccttgacggcccagtggaaacatttactgttttgttttttaagtttactaaatgacatctaacacttgcagttggcagtcatgccataccattgataattattaaacgtctgctaattctctttatgtttaaacaattttttttttttaacaatttctgctgtgtgatctccataagcacctaaaactagtattggttgaagtcctttgcaggctgactaatgccttcttcctttaatagtgctttgttttcaagtaattggctaagcactgagtaaaatcagagacttggccagaatacgactgcatggcacctccctcttgaggtgacatactaatcttgagggacatagtccttagaggttacatgtgggcattgacagtcacttccactctgcatctctggtgtctctgagctctccttgtctgcttttcagatcttcttgagttctgctaaagtaagttaggggtttggaagtaggtcagaacccctgatgtctgtgcacagagtcacagagcagctgtgtgggaagcatgatgtcatcgcaacagatgggaatggtcacaagcgcttggaggaggctttctgcgttctctcctcaatcatcttactcctgtcagtgaagagagtggaaacttcagttggggcttgatgatgggaacggggattagtttccccagggaacctttacttccgttgtattttaagacccactggatgtagcatcaatgggaaacagtcttctttggtccctgggggaaatcccggggttggtttcatttgagcctgtgggatcagatttctgtctattcattctagctagtgtggagaatatattacttctaacatagtttaagggtagatgagcattatgaattatgggttgtggtttttccagctcatgatgtatagcatacagtggaatgtatagatattttatgggaaatattacctttcaggtcactttggaacttcttgggtgaagcactactgtacatatcaacgggattccaaacaaatcaccatggtaccatttgaccaaaagtcaggaggaaaaggggtgagttcatttttaaaatttgatgtttgatttgcttggctaacatataatgattataatgcatgtataaagtaacacctccagtgttatatttatgtttcatcataaatttaaaattaataatttaaaaaatttttatatagtagttccaggaagcctaagaggctgaagaatcgctaaaataagatgattactcttagctctaacttacgttaggaactgcagttaagaaatatttttgtatttcacatatatacaatatcaagcgtatcaaatatttttatatgctaaaaattattgaataacctcatcctgtgaaactgattcagtcccactcccacttgatacctggagagctgccagtggcaacatagatgtcctggttacctattgctgtgtaacaagtcaccccaaaacttagcaacatttaaaacaacagcaatcattttagtatttctcattgtttctgtgggtcacgaattcagggggcatttggatgggtggttcaggcttgaggtttctcataaagtactaagcagacagtagctagagctagaacaaggagggtctgaagcagctcaagctggccagatacagctgtcatcctctctcctgtatccttttcttcccttttccctctttctctgcatactcccagggcctcgccatttggtctctctgtattagcaagtttgggcttcctcacagcatggtggcctcagggcagcaaaaggttttaggagtgaatgttctagaaactaaagtagacactgcattgccttttcatgacttaatctcagaagtcatagagccttacttttaccttatctattggttaaaatggtcacaatagccctctcagtttcagtgggggaggaggtagaccctgcctctccatgggaggggcatcaaagtctcattgtaggaaaagcacgtggcatagaaggtgatatgtagctatctttggaagagacagttgggcacatatggctccctggtgtccccgccattgggcagctccttgaatgctcctagttcttccctcctcctggctgttgcctctcgcctcctgcctgcttgtgagtctcctctgagtgttcccacagcaggccacatgcatttctatggaggtgacctgtcttttctctttgctcctatactttattttcttcctttgatattctacatttcattatgatagccctagctttgatttttttcttttttaatctattgcttgggaggttttggttttccaggatttgagatttggtctcttccaataactctggaaaattctcaccaattatccctttgagtttcgcctccttcccattctattgtctccctctggagatatttaaatgtttttaatacaaatatttacatgttttatctgtttgagtctctggactatattctgaataatttctcttactctgtcttcagcttaaatagtttttcatttgtgtctaacctgtcgataaactagtcctctacaagcattccacttcggtcctctctgcagtacatttttatgcaacatgttgagtttgcgtgtgtgtgggcattatagagtaggggttaaaagcgctggctttgctctcagtctgcctgggccagtgctgttaggtgctgttgtcattactgttaggtactcagccatgttgtgctccttgttctcttccacttccagtttttcttcctggctttcttttacttaagccatgatagagaagtttatcagcatctctgttccttccctgaatcaaagcaataacaaagccctttttatgtttcttggcaggggcaggattgatttataaataatctcaggaaaacagacattaaaatgtcataacagagaaattacatttaggaggaatattaaaaacctacattattaggtgtcccctagttttcatgaaatggaaacagagttgtgcctgctttccttggattgagccttagtcccttcccaattcttagtccttctagaaatcagcttcaccaaattgttctctcacacagtctgtttttgggccttttatcttgggctttctcagacttttaatgaagaactcttttgtattttctctattcctttcttatcacacttgaaagtgaagggtagaaaccaattatagtggatgtttggttctccagagactttagagagttactagaaagcatgtcattgggtagtgaagaggtttatgtgaattagtatataaaaattttttggaacaaatcctgacacataatgggtgctatattaggaccttgatattataagagttaattttcctagtaattccttacatttaaattatgttttatatttttctgcaaccttttatttatattaccctgtttgatccagttttcctccttttacaaaggaggacattgaggttaggagagagtatgatttctaaggtcatttaacaagttacagagctggtgctcaaacgctctttccacagtctgaatctcctgattctgaactcattatacttcccatgacgtcactatttcctcagctttagggtgaaggaaatatgaggactggctgtctagaggtgatgtcttctcgattgtgtagaggaatcatgtgatgttgttgtatatattttttaaaaatagagaccgaggccggatgtggtggctcacgcctgttaatcccagcacttgggaggctgaggcaggtggatcacctgaggtcaggagttcaagaccagcctgggcaacatggtgaaaccccatctctaatgaaaatacaaaaattagccgggtgcagtggcgcatgcctgtaatcccagctatttgggaggctgaggcaggagaatcgcttgagcctgggaggtggaggttacagtgacccaagatggcgccattgcattccagcctgggcgacagtgcgagactccatctcaaaaaaagaaaaaaagaagaaatagagatgagtctcactatgttgcccaggctggcctcaaactcctggtcaccttggcctccaaagtactgggattaccagtgttttctactatgcttggcctgcatacatgtttgaacagagctctcctaggagctagaggtagatagaacatagataaatagataacataaatatcttttaacctagataattgggtgttttcttttcctaacatgctctttctccacctgttaggttccctcactgtccttttcatttggattattttcctttaaaagtacccactgttctcatagcttcagatctggagttgtgagcagatttgccacatcctcctggagaccagaccctgtgtgtgacggaagaatttccctgcatcctacactctgacctgaggcacctctgcagatctggagcagcccaaaaccgatcctatcccttcttttgattgaaacccttctttattttcctgctgctctcaggatacaaacgagaatcctacatggtcttgcctctgtcactcctcaaagtcttcttctttctactttccctcactctgggcttctagccacaccagctgccctgctgtttctccaagcctatgtggaccctgaccccagggcctgtccacctgctccattccctcctccttattttatttcctatgaattctttcagtttcagctcaagaaagcttttcctaaccttcctgaccaggtcagatctccttaactttggctttttaaaaacagaatttttcatggttataacttttcatttacttgtttaagtgatatccacgtcccccactttttaaagcaatcaatagttgaacagaccatctttatagatttttgctgatatggtatggtcatccttggaacagaatattaatcttcctcctctttctgcatgtatttggtgatcctttatatatccctattccctcccatttctctgggacacctcatgtaatctttcaaagtggaagctggtccatagccattaaatcagatttatagttagacatcagcaaagtcagaatctcttatgtttgggtgtttgcactcagatattttacagactagagaaagagcagttctgtctgagaaattaatctttgctattcagtggaagacaataggtataaggcctgtgaatataaactgtctcctcctaggccttctgtgttttgtttgctcttctgatattagtgggtggttaaattttaccttatgtagccacactttctgttatttcaacaaactgggcaagcttgctaatttcccctgttagtttagataaaaaagattgacagaggcaggagaaacagaaaccctaacaaattcctaagtgacagtaagaagaaatcagggacagcaacttctgtgtttctgggcaataaactagtgctatgagatgaaattgtcacattcagttgaacaatggaatactactcaacaataaagagaaataagcccttgatatgcacaacaatgtggatgaatagcaaagcaattacgttaagtgaaaaaagccagacaaaaagagcacatactgtgtagttccatttatataaaattatagactatgcaaactaatcaatagttacagaaagcagattcagcgattgcttggggatgtactaggaggagggatggattgccaggggatacaaggaaacttttggggatgatggaattgtttgctggcttggttgtggtgttggtttcatggatgtatatgacatcaaaatctataagttgtacagttcaacatgtacagcttataccttaatcatatgtcagtaaagttgttaaaatgtatttattgaggagctactcttttctaggatccagttgggcccaggagacaaaagtaagcaaaatttgacccagtctctgttctcagggtcctgtggtctaatggagagagagacattattgtattcatcacctatatcaatgcgcagtttcagctatggtcagtgctgtgatggagggagatgtacatggtgctttgtgaacacgttctggggatatttgttctgatccaggaagatttttttggagaagtgatgaccaacccaagatcatagaagctcagagttaggaggagaccatcttcttctactcttatcaaacctgcaaattaaaacaatgtcaacactcgtttatctaccatggacagatgcggtgccatcatgatccacccgtactaaagatgtttgggtccaagtctaacatggtatacgaatgtaagctgcatgaggctttgtcctggaaaggtttatagtcacccttccactgcccatggtcatgagcactcagatttgagaagatgaaatgattgctcctgtttacatgtcatgtatgtcctgggaggagtagagctcccattctggcctcatcttgatagtctgtgtgttcccactagggagaagatgaatcagttatcctcaaatcctgcacacggcggaaaacagactccattgagaagaggttttgctttgatgtggaagcagtagacaggtgagtagctagcatgcttttctcaggagcaaatagagctgaatttctatatcttactttttctttccagtcaaaccttttctgcttttttccccttctccccctccctccttcctttccttctccccctgcctccttcctttccttctccatccattcatctatgtccagggtgctggatccaggctattgctgatttgcgagaatcattagaacctccctatcttttgggttcagcactgaatcactggcttggttttgttttactttaatattagtgctttcatgctcagaaatgtgtgttatatctccaggagattgagtagtagacttttaaagaaaactatttagcatgattgtatcagctatttgaattttttttaactgaaaaagttagtataatgattcgaaaggcattgaaatggaagaaatttttctcaaataaaaaaacagcttttagttacatttcacctaccagtgtgtgtgcgtgcccaggaaagacaccaaaccactcgtgaaatcacaattttttggagagagagccgtgtgttgtattcctcgagatttatagagtctctcattaagttgtaccatttcgtggtgttaagctagtttgacaacattccaattctttgagacactttacttggcaacaggttaattttttcaatgaaacccacgtgttaagcttatttgagctgcctgttcaagatcaggaatgctagcaccaagatccttaaatctcagcatgatactccgtataatgccatttaatctcttccttttattaaaaaaacattataccatttcatcaagccagtactcacccctccctgggaagttcatctgtggccacctttccctggctctatggcatcctgagactgagtactgcctggggttgcactgccttcttctggcaggtgtctactctgcactgcaggctgctggggctgctggaggctgttaggcctcccatggagacagcgtgcccccttagcctttatcagaaattcgtggaaactaactgcatctcttaagcaatttagtcattacatctttggctgtcaagccagacaacctgggttcaaattttgactttgctgcttagtagccatgtgactttgagcaaattacttaatcttttggaaccttgattttctcacctggaaaatgaagttcccaggatggttataaggattcaaggaaataatgcatgtaaaatgcttggcagaggggcagataataagtgctcaacaagtattagctgttactcttttttgctaatagcttatcctgcgtgctcctcagacttggtatttcacttctaaacacagagaggtacatatcctttactgtgtgtagaggtgtgagaggggaaggtaaagaagaatagcatgggtgtggggtcggaggatagcttgaactggggtagcaaaggggaattgcaaacagccttccccaaaccaaattttgttattactggttttaaacaaaacctaaaccttggtgctttaagcatctcccttctcttttctaagcatgtgattgaagggaattcatattattggcatccttgaaggaggttcagaagatctgtttgcatggaagtacagccacctgtgatgctcatcaaatgcacagttcctagagataaccgtctgctgcagagctgctttgaagagggcatgctttgtgttgcagctctctgtcagattggaaacaagcccaaatttgctttctgaagctgaattatttttgtgttttcatcttcagaagtttcccgagaagttgcggagagtggctttttaggcgattaaagctcactgtggcacctccatcttatttccacccttgccagcacttcctagcaccttccctcctttatgactcccacaacagctgtgcatgtcccaatcataagcaaagagcgaatgtgtcacattcagcatactgagtgggcttgcgagtcgattgctcctgagtttctgtccctggttccctctgcatggcgtggagagatttcagtcatggttcagttgagggggctgaatctcctcttttttttttttttttcttttttgagatggagtcttgctctgtcacccaggctggagtgcagtagcatgatctcggctcactgcaacctctgcctcccgggttcaagtgattctcttgcctcagcctaccgagtagctgggactacaggcactcgccaccatgtccggctaattttttgtatttttagtggagacggaatttcaccgtgttggctaggctggtcctgaactcctgacctcaagtgatccacccaccttggcctcccaaagtgctgggattacaggcatgagccgccacgcctggcctgaatctcctcttaatgaacaggaggtaagtagaccgtcctaggaaacacctcctctcagttttctatatagatcccaaagattaggttacaatacagcaggattttcctcctttctccttttttgaccccagtgcctttctgttttttttccctcaatatttagaagggagtccgggtagagaaggaaaaggcattttcatgcgctgggtagctgcatccctgggaactctgcccggaatccttttctctcaaagactcctgtactttcctttttcaccaatgtcctttagcgaggaggtgattgctgctagatgccctgctgtcctgccttccacaggttccccagctccacctgctggaccagagaggcagaggatcaaaatgcaagtttagcacctaggaaatgtggaagtgaaagaggggatggttatatttaatcgcataagggtttaaggtactcctggagtatgttaactggagaatacacaaacatttatgtagtgactagaaatgttttattctatcaagatacaaatacatgttgaagtgtgaagtatgtgacttagaatatgggatattgtggatttttaagattgaatacatttatcctttatacttaatgctgatatatcatgttattttgtaacaaaagctgtatcctttaggaggtgatatcctaggaggtcaatattgtgagttgattaccgtacatcaacgtattttactgtggtgaaaaccacgtgcactcagttacagattcctggtgcttgtcccacacccacacagttcgactttctgggactgagaccctgaaatccatattttcaagctttttagttgtcctttattcttactactacttggtatgttaaatacaatgtgtttcacaatacagtttcatcagaacacatgaaaacattttcctaatttgaaaaatcacaacaagcaactacagcaaaacaaaacaaaaaaaaattcaggctcctctactaaggagctgaatgcttacctgtatggaggaggagaatgtaactactaggaaaggtgatttctggtctctgagacagattacttgaccaggcaaaaggcaaaaacaaccaccacaataaaacccctgcctttttaaaggatgtgaaaatggaggaggagtgaggcaactggtagtatcagagcatttcctataagctgaacactttcatccttgtgttgtgtcatcctcactacaacccaggggggtaggtcctccattattcccatactgctgaggaatctgcagtgtagggtggtgaggccgtttactcagggctaaggtgggatttgaactgaggttctcaggagcctgttccagggcacattggtgcctcaagactttggaatttttttttttttttttttttagatggagtcttgctctgttgcccaggccggagtgcagtggcacgatctcagctcactgcagcctctgcctcctgggttcaagcaattctcctgcctcagcctcctgagcagctgggattacaggcatgcaccaccatgcccagctaattttgtatttttagtagagatgcggtttcgccatgttgaccaggctggtcttgaactactgacctcaggtgatccacctgcctcggcctctcaaagtgctgggattacaggcgtgagccaccacacctggcctaaacttcagatattttagaaacattttccagtgatgagctcagagctgttggtggttgcatttcagagacaccgcagtgtccagttttcaggctgtgaaatctgggaagtgctattggcaccctgtcagttgcatttggcattgtaaactacaatgaaactgtacaatataaagtacaatgaactgaagcagcaaatttgcctctcttcttatatctactcctctgtgaccttcagaaagtcctcccgtgactaaattaaaagaagcaatgcagatagagcacagtgacaggcacatggcactgaataggtgttccatgaatggttttttggtttctgtacaccttttcttccatcttttatttatttgtttagaggtgggtggggtctcctcatgttgcctaggctggagttgaactcctgggctcaagcaatcttcccacctcagctctcgagtagttgagaagataggtacaccactgtcactgtccctagctccaccttttatttttaaggtgacactctttttttttttaatccaggacagctagcatgagtaggagatatcctagcagtagtatcacttgtcagctaattgttttcattgtatcacaatacattgctgtcagtttgttaatcctcaaatccctgacacataagtcctacagaaaactgttgtcattctttgaacaacgaatgaactgaaaatcaaattaagtgttaatccaggccaatgggatttagatctatggttcttgaactttatgtttcaaggatccattttattttattttatattttattttattttatttattttatttttgagacagagtcttgctctgtcacccaggctggagtgcagtggtgtgatcttggctcactgcaccatctgcctcccgggttcaagcgattctcctacctcatcctcctgagtagctgggaccacaggcatgcaccaccccgtctggctaatttttctatttgtagtagagatggggtttcaccatgttggccaggctggtatcaatctcctgacctcaggtgatccgcctgcctcggcctcccgaagtgctgggattacaggtgtgagccaccgtgcccggccgaggatcctttttaaaaccaaatacatttctagaaatctacttttaattcttatatatctaagttgttttacctttgatatctaaaaagtagacctatactctcatctctgtgtccacacccttttgtattggcttctacatgatttcagaggtcacatctcctctaatttcttttctctagtgccttcctttttttcagaactagtttttggggtgggggggatgttcaaacctgaactactgaggaccctaggattacatggagcaaatgtttcacagactaatgttagctcttcatatctctgctttccctcaaaaagatttcattgttcctaacatcgaaaagctaaagttagtagaaattctttgtatttcttcaatctcaaaccgaaaacttgcttggatcaaggtatcatgtcagtccaatcaatataatgattctttgaaggttccttctgatttcttttgaaattcagtttaaagactctagcattaataatatgatatggctttaaataaatgtaacttgtagtagttgtgtggtatggccacaacatgctccaaaggataattttaaaaaatttcctagcagatactagttatagattaaattgtgtccctgccaaaatcatatgctgaagtcctaatccccagtatctgaaaatgttgccttatttggagattacttgatagagataatcaagttaaaatgacgtcattagggtgggccttaatgcgatattaccattgtccttgtaaaaaggggaaatttggacccagagatggacatgtacacgagaagataccgtgttaacatgaaggcagaagtcgaggtgatgcacctacaagccaatgaacaccaaaggttggcagcagagcaccagaagctagaggagaggcatggagcagattcttcctcacagacctcaggaggaacccttgatcttgaacttttagcctctagacctgtgaagcaataaatttctgttgattaagccagccagtttgtggcactttgttacggcagccccaggaaatgaacgcagtttgaatagggagggcctttctcaatgaagcagcactcatgcacccagcagcctttaaatggataactcaacacctactgcttgaacaatcccattgccaaggaaccccacttcacaaagcagcccattcacataaattaccttcttcctttcttttcttttatttttttacatgattatagcctaagctttcattagctttttaaaaatcacccttttttggcctagcgtgatgactcatgcctgtaatcccagcattttgggaggccgaggcaagtggatcatttgagctcaggagttcaagaccagcctggccaacatggcaagaccctgtctttactaaaaatatagaaaaaaattagccgagcatggtggtgggcacctgtaattccagctattcaggaggctgaggcagaagaatttgcttgaacccaggagatggaggttgcagtgagctgagatcgcgccaccacactccagcctgggtgacagagggagactccatctcagtaaaataaaataaaaatcactttttttattctttaatgaagcagcattcttgggtgcttttgtattactttgccatagcaccaagcatttgaaggtttataatttatattggttaattgaataaagactagattgatcattacaaaatgtgtcaactctttgagaggatttagtgtaaaatttctgggttaaaaaatgggacatgatttcaaagcagccattagtggtagcaggatgtgaatcggtagtacttgcttatgtctgtgttctgtcactttgaataattcactccgtcatgcagtgtcttaaggaaattcatgagcaaatatagggaaaatatttgtttaggctaaagaatcatggtactagtcatttgccagcatccctggatttgtttattttcaagaaatttctcacagatgtaagtgacacgtggatattttctctcaggtgttttccaggagggcctagtaaaccatgtgaaaaataataaaactttttctgattccctgaatcaataaagtctcttgaggggcagtgtttacactggggaagggaaatgattacttttttctggggttagctgactctcaccaatgtccatacatttgaaaatgctgtgtgttaagtgcccctttcccagcattggtactctctagaggtgggcagcaaggatagcttcttagagatggcaaggatatttagtgctggagttgtaataagggataaggcaagaataaacttatcttcatggagcttacctttgagtttggaatgctcatatatactcaagcaactaaggtataaacaccaggatgttgagtgttccagcaaacctggagggccagaatactggggggaaagtaacaaacaagaggactttacccttccattcttacaggggacgatggcatgactggaatacgctgaattcattccctccctccttccttccttattttattgagcattactacatgctagagactactggcagtggagatataaagtttacaaatctgtaggactttcttaacagacctcatctgattttctttcataccagttccaaagtccttgttttgcaagctttccatgaataggtaaagggcagtagctctcctctgatctagtcccaacctagcatttcacatccactgtcaactctattcttcttcttcccaggtaacctgcatttgcacagtaataagcttttctttgtattggttggttgggtgtttaattaggtatgttttatatacctctgttcaattctaaatatctgtctcaggtgatttgcttccagaggcagaagaacattttatgcagcttttaatacagtaatatgtgcatatggctgttcaattttattttttatggtgacgtaattttgacatgggttaattattttctttgaggccatggtaaactattgtgtaagagactagaggagcttaatcaagttagttgctatttaaactaaacttttagcaggtgctcacttaacctgcatttgtgtactgttagggaagagacccaggaaaactgaagattggtgaaagtcagaatagtggaggccagaaagatttttgaaagatctgaagaatctactggaaccctcagcaccctcatttcaaatatgtttgtatggcaggctgcatgatgcaggtaaaaaagataagagcattcctaaatttgaatttgggatctgttccttactagctgtgtgactctgggtaagtggtttaaccacatctgtaagatggggtgaattatcactacattgcaggattttttctgaaggtggaacacactaatattcccctctgatggagtcctatgtctgaaaacatggctgttgaatttttttctataccctaaaacctggggctttattgttgtgatggtgaaccttagctttggtggatattcctgtgagcctgctttttgtcttaatggtgctccttttcctgtagtgtcatgagttttcaagttatctataagctgagaggaaatacaggtgcattcgggttatatgtgcaaagggcctgctagggtaagattccattttcaaactgtgtatgtgataacctgttattgatacatgcttcaaataaagataaagtgttatgccctctctttccaatttatggcctcaagaagaaactgtattaattttaaattaaaataatattgtttcttctagcttgctaagaggtgtgtgtgtatgcatttgtgtgtttttgtgaaattgtgtgactgagattatgtgttttccaaaaaggatcatcttatgtaacagactttgtttcaacattcaacctctagatggcagttttgtgtatgtattagtaactattagaaggtccagttgaaaatcagctgtcctatatacaccttgtatacattgacagaagagtgtgtgtgtgtgtgtgtgtgttttctgtagaaaaaaataatcatgagagtattattccttaaaggaagaagagtatcctaaatgactcattcattctctagaaattccttcctcccaccctttcatcacaaatcattcatacccactttcttgcaaaaacaaacatgctcagttagttgggcctctgtttaaacattaccctttacctggctctttgaactaaagtgccaggccctttgctttaggaatggcttatttaggatggtgcagaaaagatgagtgatttcactgtcctgtgtgtgctgagaacctggcagtcctacttttccctcctggtgcaacgtgcctttatcttttgcaacacatgaatccatttttcctggtttcagacttcccctccctccccttctcaccccttgtttgaaataatattttattttgccttcctgctggttggattagagtgctggtctcaatgccatgacatttcaggcaggaaatggagttttccttcctcagagggtgttatatgactctgacttccatgacttgagttgggagacgataccatagtttctgaattgctttttggctgttctgtaaaataagttagtggagaagttcttggaatcttagaattcatgtagtttgaacttgtcatggagtttttttttttcttttaattaaatgagagcatgcctgtttgctgtttgattctggtttaacaaagaatggggtatggtggttaatggacttgattgggagggtgattgaggcaaccctatttttactctttagtctgcctggtgaaatatggagttttattggttgaatataccagtttatttaccaatttctaaatataaaatgagtttgtctttttaaaatcaaaaccaaaaatgagctattatgtaattctggatagaagaaacagttcaaccagtacattccacttatgtacatttctgttgattgtgagatagaatagtaaaaatgaaaaaaaaatacatgaaacagaagctatattttcatagtttgttatcaatagtagtaacaggtatttgcattctccttgagtctcactcatcccatcagtgaataatgccttgtccttgtgcagtgtgttaacatttgcttgcttctatgtccctgatacctagcatgatgactggcacataataggaactcagtcaatatctgttgcatttaagagccatgcaatttaatatgccaaagatgtctttgggcttcccgatgttttacgacttcagtctctcataaaaatgtaagaacttatctgatgtggttggtgatacctactttttagactattattattgctatgatcctaattattttaggaacattcctctaaaaatactaaggttgcaggctttaataggttatgattcattcatttattaggatcagatcctttttttttttttttttttttttgatacggagtcctgctctgtcgcccaggctggagtgcagtggcgcaatctccgctcactgcaagctccgccccccgggttcgtgccgttctcctgcctcagcctcccaagtagctgggactacaggcgcctgccaccgcacctggctaatttttttgtatttttagtagagacggggtttcaccgtgttagccaggatggtctcgatctcctgacctcgcgatccacccgcctcggcatcccaaagtgctgagaggatcagatcctttctaaataattgattagaagctacttccaaaaccttcttagagggttgacccttgcttcctccctccctcctctttccaactctccttccctccctccctccttccttcctttcttcttctccttaagatgctggtctttctggatcccaggacatgtatgctacatgcacaggggggcagtacaacattgtcattaaagcatgggctttgctttagattcaggcacacctgggttcaagtgcaggctttggcacttactagtggtgtgacattatgcaagtaatttatgtgagtctcagtcttttcacttttaaaagaagaaataatggtagtgtctacttcatacagttattgtgaagaatgaatgataatacaagtaaagtccttagcacagtggttagcacataataaacactcagtaaatctacctgtggtttgggggctgccagttgcagcatcttctggtttcttacttcctctgtctctcacctgtaccacacccagattatcatggcatattattaattctttccatgcacaaaggtcttgcagaaggacctcaatggtttattacatcagagcacgcatagtagtgcagattcatatgttctgtctccaaatagtagattaccattgccttccagtgatggcactgtgtccttgagtattggaagaaaaagggaagtagcccaagttcctcctttgtggatgacctggagatactctcctgagtttgactgtaaggtgaatcaagaatatagacaggcatccttcattgttggtcttaatgcatgagatggatgactttataacatgtaatgatgacctagggtgaagctcagatagattcagaggaagacacagacaacagaagttgcaaactggtggtccacagacatgcttggtttggcttgaatagtgtttgaggcaacagtttaaaactgaaaaaatctttaactgctgatcatgccttcccgcatgccagctaccggttgagctgaatgacagatatttcctttaggtggggtgtgtgctctctgttctgccgcagtccccaccatgccctgttgcccacctcccccatgaagacgagtgacagcttttttgctttgcacttgcactgttgtttttcccacagaggggagataattctttgttctttgtttctatctgaaagtaaaactgcaaaagaaaaaaccaagagcaacataagaccaagtctattttccttggattaaagaatttcttatccagtttccctaatttttcttacttaccgagtctccgtagacatttgggtctgtaatctcataaacagacatggaaaaggtgtcattctccaagattattctatgtggctttggccatatctttgtgtaaatgaagctcttctgaacccgaaccattgcattgtccaggaactgttaggaattcattttcccagtagcactttagaaacaaaggaccacttcccttccctggcacttgcaaaactcttcttgcaagtggatggcagctgatgctccattccttatcattcccctttgtctcctaaataagcataaggggcaggtttcagacacaggctttgagattgtgtgttcctgtgggtgcctcagctcttctactttgaatttgacccttaaatatacagtagtgtggatggaagctggggaatgaactcttgccaacagaagatttatagtcttatgaatgagtaaattctagatctttggaggttgatttagaaagaacggtactgttaaattctgagtgtttttgtttcagtggggtggagttagtaatagcttttccttgtccaataggaagtgggtaaattgccaaaccactgagatcactattgttgactcagattcaggaataagattagcgtaggaaagctgtcgagtaaccctggaattggggctggttgtgattctgtttgctcttggctggtgagcaggctatgagttggtatagccagtggtcccaggatcctgaatgtgttgctaaaccatatactgctttccatgggctgtttttaggggccagggttggaggagatatggtgttgggtagcaacttgccctgtaatagatggagagctgttttctccatggctcctgcagtgtgagaggtgaggtgccagcttagagaaaattccagatcctcgttcatgattcttaagcagatccagattcttaagcagatccagattcttaagcagatatagcactaaggacatattcagagtgaaaaggaagtgctgtattttaagtggattcttagggttgagctctacagaggatttttaagtcatttgctccttctctcatctggcgggtggagggagctccttggcagattttttagaatttgccaaagaccccttctctgttcttattagttatcagatgttaattttaaaagggagtggtaggccactttgttgcgttactcaggaggagaaaggaaatggccattatgtcagtgcaggtgtgtcccttcagccctcagccctgtgtgctttgtggtagaggcatgaatttcagtgctgtgtatgagtgtgttgggagtgggaatcacacatgtcattagcacctgtgggttgtttcttttccctttgaaactatacacacctgcccttctgcagccgtaattttaaccttaccccatacttaccatcctgttcctgctcaccccacctctacctgcccctgtgattacaactaatttttggagcattcatcgtgtgcctgacactttgaaatgccgcatacacttctcatataaccttcccagcatgccctgaggtgtaatcctggtaacgctgggagacaagtaattgaactgctctatgctactgttctttaaaacataggtaataagagtagcacagaatagttcagttgctagtctgccgtggttatacatctaggaagcactagaatcaggataactagtgagcctaagttattgatgagaagtcatagctcttgggtatttaaaacgatttttactgaggtgtaatcacagtaaaatgcatgactccaaagtctgtattttaataacttgttatacacacacaactgtgtaaccacccagatgaagatatagaatgtttctgtcactccaggagatacccttgtgccccttctcagtcactgcccatatctcttttcaaaaaaaaaaaaaaaatcactcttctgacttctgttgccatagatgagttttgcaagtatttgaacatcatagaagtggagtcacacagtcacataatcttttgtgtctggtctctttccctcatcattatgtctctgagattcattcgtgttgttgcatttagcagtagttgactctttttttaaaaaaattgttgtatggtatgccattgttcaaatatacaacagtttatccatttatcaatggatatttatttgttgttgtttttgcaatttttggctattctaaataaaactgcaggtattcctgaatgcgtcttttggtggacatatgcactcatttctcttgagtatatatgtagaggtagaattgctaggtcatagggcaggtttatgtttagttctagcagatattgccaaagtagttccatcaacttattctcccatcagcaatgtatgagagtcccagttactctacattttttgccagtattggttattggtggccttctaatgccctctattcaggagggtacttgttatatctcattgtggttttaatcacatttccctcataagtaatcagtttgggctctatttcttagccttattggccatttggatgtcctcttttatgaagtgcttattcaagtatttattgtattgggtggttcattttttcttactcacttgtaggcattctttacatattctggatatgattcttgcaggagatagatattacagatatcttctctcactctggtttgacttttaattttttaaataaaagtaattaagtaattaaattcatcttttgatgagtgtaagttcttcattttggtgaagtccaatttttcaatattttttctttatgattaggactttttgtgtgtgtgtgttttttttttttttttaaaaactcattgcctttccatctcttgagtattttaagacagataaaacatggagaaccacttctatagaaagtaagccccagttattctggacgctattgaattcttgttttggattagctcgttgcctagagtagcgttgtaagccctcatatttatgaagcactttaggtttttacagagctctttatcattcaatctcatttaatcccgtgcaggagctcactaaggtgtttgcagaagtgcatggctgattttgacaccagaggacttgggtggtcaacgtgagctctctgggggctgcggtgccatcacatttgccatggcattgtgcacaagagttaagggttggaatgcctgtgttcacatcctggctctattatcttgccagctctgtgattgtggacaagatacttaacctctctgagccttggttttctcatctgctaaaggggaataataagaatatacttttctcatgatgtagctgtgaagagtgggtgaattaatttatatatagtgcttagcacagcaactggcatatactgctgggttataattattactgttcttttattgtagagggtctaataggctcacaattctttgtagaggtaaaaagagctctgatatttactccaatttctctttcattgttttatatgttcccttcctcattccatattatcctccttctttttttattttgagacggagtctcgctctgtcgccgggctggagtgcagtggcatgatcttggctcactgcagcctccgcctccagggttcaagcgattttcctgcgtcagcctcccgagtagctgggactacaggcgtgtgctaccacgcccagctaatttttgtattttttagtagagacagggtttcactatgttggccaggattgtctggatctcttgacctcatggtccgcccacctcggcctcccagagtgctgggattgatgttagtcactgcgcccggcctatcctcctacttttaatctctctcttctctgtctcccctgccctgcccattttttgctatgaagaaccacatgcatttcaaacatgaattaaattgacatcctgtaagagaaggtctcaaagtatgttattgtataggaactgacatggaaagtggagggtcgttgagggttttgcttgttttattttgttttgagggatagttgttagtagggacataaggaaggtaaatatggaaagaaagttattgttttactccagaataaagatagttcaccctttttatcttggttcttggaaattcacatgcaagacatgtgaatccgtcccctaccccacttcccctgcaaaagggaacaagaccacatgtggaaaagaacttgtattttgatatttcttcttggaatgaaaacaaatcctgttgactttcctggttaccaaggccaagtggcccacccttcacagcctctgaggttgtcgaacttcctctgtggcttggggtggaaatctcacactgtgtgccatgaagttgatgtaatatatgtgagcccctgagaccttggtatgtagacagctcttgtgatctcactgtttgctggtgagccactagcaggaaacgaactagagacatgttggctccttgacctcactgcagaaaggagggtaactttgctctctagggcagggggaacaggaaggaaaagagtagggatggagtggacagcccagggtgtgggcctcaaacttaactctgcatcaagatcacctggggagttggttaaaatccaagttcccaggcacagcccagttcagattgagtagagtggggttgggctggaatctccatgttaagggaatgtctgattctgaagcaggtggtacaggagcagcacctacagtaacactcaaagacccaaaaccggggacttgagagttctgcaatagacagtagctgcagaggctttttgtttcaaagctattaagacgtcatacttggtctttagagaaaggtggaagggtggaatcagttcattgtgcccttaagccacagggtcagttctgtggagccaccactgtcagcagtctgcagatatccactgagtctggcacactgaatgggctgatggtgggaagtgggcacttggttgggtctgagaatgagaatttctgagaagaggagggagagtcctggaaggtgctcatggagagaagagttattccatcttctgagtcatctttgtattgtggtgccagtcccagtgtgaccttcatgggaatgaccatcctcttgggatcagtgttccaccatcatcaacacgcccactcatctagctgcccacgcctcccacccacatacaaccccactcccctttctgtctcttgcttgttttctcactcccttctcttgctcgtttgcatgctttccctctgtctctcccgacccacacgcatttacaccctcacacattcacacccctaccccatgccccttgtatcctcaacctgtctgtatttacatgcccacggctctaaatttttaaggggatgtcaaggaatggttaatgaaaagaatcaaatgtgacttttaaattatgttaaacacaaataggtttagcatattcattggaactatagctataagccagaagcagagatgatgggtgggtgagaatgaccaggcttgggtgcatatggggcccaggcttgtgctgctcagggtgttgctcagcctgtgtggttttaataccatattgttgtatgatcattagcagtgtttgtgtactcagacaggaatcggactttagttcttgctcagtggacctcttcctcctttttaggctgtctcaaattttaaagaggatggttttaactagcaattcttaactttttgagggttgcagttctctttgagaatctgacagacaatttgaattgtttctacagaaaaatccacatacatttgagggagaggaggaggtggtttggggacactctgggatctattttcaccctaaatgaagaactcctgctttaatgggcatagagggctttcagccgcttctcccaaggtcgtttttatggcgcagtctctttttcttgcggagtaccatttgtgatgggaactgaacaaaacccatttgatattgtatgcatgtcttctggagggcttgtgctcagttttagagagcaagcagatttcagtgagtgaaatgatctcatgcatgtaaagcacttagcacctgacatgattaagtattcatttttaaaaaatactgtgcacatttaatcataactaccaagatgatgaccaccataaaacttctccatgtctgaagcagtttagaagcagtggactagatattaggagacaagcatgcctccaggttggatattttctcctcttttttttatcttgagtccagtaattccattcacttccacaaacatttattgcatttctaccgtgagtaaaatactctgttaagcgttttgaggtctagaaatgaataagatttcaaggaattgaacaacgtctaaaggcatcacttaactcctctacgtcccttacctgtaaaataggatcatgtcttctgtgtttctgcctctctgagggagatgggctgactgagaggaatttgggccatcctttctgagagtagaaggtggcttagtaaagccgagtgttttgcccctctttgtgttgttaaccctagcagccactgactcttttgagtggatgtttaagatttgccttcaccaatctctctacatgtggcactggtttcatatccatgtccctcctttctctgcaggccaggggttatcaccatgcaagctttgtcggaagaggaccggaggctctggatggaagccatggatggccgggaacctgtaagtaacaattcagggaagtagagcaagaatgaaggccctgagttgtttgttgcttccctagtgcagtgatttttgctgctgttctaaagccttgggttcttgaaaccagtgtaccagaggtggttttttattcctaggtttatgtttgtggatattgatattgcttctgtatagatgtagttcttgagctttggcctctctgtcctaaggcatggcttctgcatagaattacaccagaactcccatcttttatcattgacttctggttcagcctcccgtagtaacttacctccccttataagcagcgggacattatcaggatggatggagggaggtgagcctggtaatatgatccctgctgccatttcagcgatgctggcctcagctgggtgatgtaatcttgtagttgttctgcatcttgtgacgtgtaaaatccataagagccctggaatcactgtagtcgtcttatcttagttccaaggatctcaactccagtgttcagcaaatctcaaggttgcagaaattgtaagagtacagtctaactatgtgccaccaacaaaagagaaaaagaatctacaatgccagagggccaataattgatacttacacaggtactgtccaaagggaggaaatgtgtgcaaggaagaagtaggccatgggctccattgactatagaactctttgcgtcaggctggataatgccagctgatttgtgtgtgtctttctcagcttaccctgatgaggtggtctggcaacatagattatgtacctttctactcagccatattttatacaaacatgggacgtagtcaactaggcataaagaaatagctagtattgtatgacatttaataatatagagcaagatctcttaaagatttaaataactgatgatttaggcacagtttgctaaactataattaagcattgtttaatcttaattcttctcctgggctaaaatataagatagctctgattatctctgtatacgttgttacccataggaaccctcaaaaccagatacacatttctacctttgaggctttatgggcacaatagctatttgatgtcaaaggcctttgaaagaagcttcctaagtaggtctttctttttgctagcattatctaccatttgttgagcacatttttacatgttaggcacaggactgagcacattacatctcttaacctgtttatttctcttagcacttaatgaaataagtgctgtgattccattttatagataagtaaactgaagcttagggaggttaagtaacttgccccaagtagcacagatagtaaatggctatattagtagggtacaggctaggttgctattaacagagagactctgaagtacggtggcttatgtaagatagataagtgtatttctctcttagagccgagaagggaggagtccatgcctagtagggtcattctgctatcctcagcccatggcttcccacattgctccagtcattgccattttccagccagaaaatgaggatgaaagcatttcgaaggacccagaagatgcacatgtcacttccattggctcaaacataatggtacagccatatctacctgcaaagcaggctgggaaacctaggctgtacataggcagtcatgggccctgccaggaccctggacatgttattacttcaaagaagaagaggagaaaggatactgtgaatagttggcagtctccatcctagtggcaaagctagaatttgacccatgtctaatcctagacatatttggttttcatctttaatggagataaaatttaaaattgccttcgaaaaattctcagttcatttttacagtactttcactcactcccttgaatgattcttcaactcataggggaggaagtgcccaggaagaacaatcctgtatgggattctattcttggtatgggcaaaaaaaagccaaattacaacaacaaaaaaacccaaacccactactgtctctccccctgcctccaataagctggagttctaaaactgcctcaccaattaattccattttaagtctccccatcctctctccccaccacttagatatttgttctctgtctgcgtataattggtcttcttactaaccacttcagttttcctgtagattaacatctggcctctgcagatggaaagtgtgctgttgaaagaaacatcttcttgctccagaatgtacaaatgaaaacaagtttaaacacaaaataattttgtttctaaacatgatataaaattatttcctcacaggaacatatagcttgcactgaaaaccacacttctgtgtgctttttagtttcctaaagagagagataaatatagacaaatgatgtctgtgtaattgacagtaatactaggcttaattttgtctcccattgctgaaagcctctaggggacattactagagatatatgtccagtagacaattagcagctccagctttaatcaccatctccctaatgagttaaatctgtccccgtgggagctttggatttctctagttagctctttctctagtcggtgttagtgtcgttgccttatttcagggagctgttatagtggcaactatttcctgttttatacttctatctcagttgttctttgatggattatttggtgttggtggattttttttttttttggagggggttaattttagtttctgttctttttgttctttcattgtccaataataccttaggatggttggttgaaaaacaaagaaaaactaaatgagtcccaaatcagttgattttgcaacatttcatttttaaatgttaaatttagttttagcattaaatcatacttttttaatacacagtcatatcctagtctaaagaaatgttgaatgtctttatggtgtcgatggacatataatggaggaagaaattagaattgtcttcctacaataagcattatggattttatctacgtagtaaatttgaattattttaattcaaatgtgggaaactcaattcaaacttgaagaaaagctggatttattgggttacataactgaaaaatactggagtctaatagtctgtggctcatccgaatctgggaacttacataatatttggagttggtttcctcttttgtattggcttcattttccaacacgttcttttcagagtggtgagatgcttccttactattcattccaagcttacatcttattattaaaaacatgggtcagtaacctttttctgtaatgggccagatagtatttcaggctttgtgggccatgtggtcgcgattgcagctactaactttgctgctgtggctaaaaagctgccatggacaatatgtaaatgaataggtatagccttgcttcagtaaaactttattatttacaaaaacagatggctggcttgatttgggtcatgggccatacatagtttgttgatccctgatctgtaagtctagtggaaagagagcttttatgtaatcattccaagaaagttctttaattggattttattggactaactacttggtccagaggctaggatggatgaattgaccagaacttactcatgtgcccattgcactggagctgtataaatgatggcagaaggtcatcttcctctgagagaaaaagcattgttgtatgagggaaggaggtagacactagtcaagaaaagcagcacagtttctacttactctcagatgtatgttcctttaaattttatgttcagaaaacttcctctttgaaacttggccaaggggggaaatgccaagtttaccgctaacatcataattagggtaaaagactgaatgctttccccctaagactaggaacaagttgagggtgtttgctgtcaccactcttactcagcagaggactggaagtcctagtcagtgcagtagggcaagaaattaatataacaggcatacagagtggaaagaaaggtatacaactgcccccactttcagataacacaattgtctatgtagaaaatcccaaggaacacacacacacacacacacacacacacacacacacaccccttctataattagtaggtgagttcagcaaggtcacaggatacaagatagacatatgcacaaaatcaatcatatttctgtagattagccataatcatatggtgatcaaagtcaaaagtgtaacaccattgatagtcagtctccccaaaaatgaagtgactaggtataaatctaattaagcatgtagagggcctgtgtgttggaaattacaaactgctgctgaaagaaactaaagaggatctgagtaaatggagagacattaatgggttggaaaaatcaacatagtaaagatgtcaattctccccaaagtgattataggtttaatgcaattcctattagaatcacagcaagatttcttatagatacagacaagcttgttctaaaatttatatataaaggcacagaaaccaaaatagataaaacaattttaaaaaagaagaatgaattggaagtagtctgtctaccctattttaagactttctttttagtgacagtaatcaagactgtggtattgacagagggatagacacgtagatcaatggaacagaataaagaacccagaaatagactcacacaaatatgcccaattgatttttgacagaggtgcaaaagcagttcaatggaggaaggatagtttttttgagaaatggtgctttttagaactaaacatccataggaaaaaaaaaaaaagccttgacttaaacctcatatcttatacaaaatttaattcagaatggatgacagatctaaatgtaaaatgtaacacttgaaaacttttagaagaatgtgtggaatctaggactagatgaagagtttttagatgcaatgcggaaagcatacacaacccataaaataaaaaatggataaaattttcttcatcaaaattaaacgcttttgctttgtgtgtgaaagaccctggtaagaggatgaaaaggcagtctacagaatggtagaaaatatttgcaaaaacatatatccgataagggacttatttacatctagttcttttttagatctaggattaaataaataaataaataaataagaactctcaaaacttaacagctaaagagaaacagtccaattagaaaaagggcaaaagacacaaggagacattttaccaaagagaatatggcgaataagcacaggaaaagatgttcaatatcattagccattagggaaatgcaatctaaaaccactatgaactatcaccttccagaatgactaaaattaaaagtagtgaaaatactgaatgccggcaaggatgcagagaaactggatcttctgtacactgctagcgggaatgtaaaatgaaacagccatgctggcaagtcacttggcagtttctaaaactaaatattgctgttactctatgacacagcaattgctctggggcatttaatccagagaaatgaaaactgttcgcacaaaaacctgtatgcataaacctccctcatagcagctttattcataatagcttgaaactggaagtactacagatgtcctttaatgggtgaatggttaaacaaactggtacatccatgcaatagaatactgtttggcaatggaaagaaatgaactattggtacacaacaaccgggtgcatcttaggagcattatgctaaatgaaaaaggccagtctcaaaaaaaaatatactttaattttgtaacatttttgaagtgacagttttagaaatggagaatggaatagtgatatccagggtatacggacattggaagtaggaagcaactataaagggggtagcacaagcaagtccttcgtggtgatggaatagttctgtgttttgatcttggtggttagttatatgaaaccatattaaagtagttatgagaaactgcagcaaagtatatgtgtatacttctgtacaatcctacatacacacagatgaactcatgtcaaaactgatggagtttgaacaacgagtatagtctagttaacaatattgtcctagtgacaattttctggttttgatgctatgttatagttttaaaagatagtatcattggattatggggggggaagtagggcaaaagagtcacaggacactactatttttataatagtatgaaattataactttaaaaaacaacaaagttagctattcagatagtcagataaagctttgaaatgattctgctggattttttcactttctgttaaatctgggttgacaaacaatagggtcactgttgcaactccataagcttttgttttacttttgtgtggccattgtctaaggcttgggaacagatgacttttcatattaaattggacacggaaaccttagttcagactgcataaataccacagctcaggaaaattttagagacagcagagtttctttggcgagtttccaataactaaagttgtctctccttttctcattgcatattgctggtaagcatgtttgctaaaagaaagtagaatagaatttctaccagcccatcatcattgccaacatatacacacccaacttgaagtatttaatatccatctgctatggaaaagatggctcaggaagccagggggactgagtgatccacagcttcagggcttgcgtagcctcttaaaactgcatttccatatatccccttagctgtgattagtggtgtctttctgcaactgcttatatcgcctccttattttagatgtattagtcctccttcacatttcaaggattctttagttaaataaaatatttctccactttgagctggtacttgaatctctttcgacagccacaagttttgaaggttggcagatgctagaattaggtggaattagattaagaaggtaagaaacagatactttagcatcaacaattgtgtgtaagtctgtgtattaggaaatcaccactcttgtaggtcaaaaatagccagatattggcaatttcttatggctccattcatagctgtggagcaggaagaagcaagcccacacgtaagtcaatatcatacccttatttatggaagagggaacactgcctaaaaaaggctggtaattggttgatctcggatagatgattcaggtctcttagcttccagttctgtgctatttttgcgcaacacacaaaaaattgctgctgaattgttaggaagtcacagttgaatggtatcaacctttactttttaagtagagttactctgctgtggctactgcagtggatgaagggaaaagaaggaagaggctaaggaaaaaccactcctctagtaaaagacaatgttacttccttctgctcacctccattttaaagatatcttctgttttcgtctttgtggactttggggctgaacaaaatgtgtcttctctcacctttctctaccgtgcccgagctctaaccccctagtccttctagaactcctggaataaatgggcaattgcattgcatatgttctgcatctaatatctgaaagagtgagctgtgaaaagtttttaaagggaaaagtaagattgattactgttaagatgagctctcaggattagaagcagaatgttatggtggttaagaatgtgcactcacacagcccaagtttaaatcctacaccactgcttattggcagtctcaaactggaaaatgacagtctctctgagcaggtttcctcacctgcaaattgtgataataatagcccctacctcataagagtgctttgtaaggatcaacctatatgtaaatgcctgtacatggcaaagtgatcatttaaagctagttcttactattgtctttttggagaggaagatggatattgggatacctgggttctatttctagctctgtttttaaattacttgattcacttagctcaagtcaccttgttccagttcaccagagtgcagggcagggactgctttcaatagtatggaaaatgtgatttcgtttagcagtcagtgtgaactttcaggatatgactggaggagcaggaagtaatctttagcctcctttgctatgatgcatcccaggcctagcagttcataatcctgctgtatgctaacctcagctcaccagtctgcggctgacacttgcgttttcctttctttgttaaaataagtgattgaaagagtatggatagttaggaaggtatggggtgagcttgctaggctctagtgtgacgatgcaggcctcagtcctttctgagctttctttttatttatttaattttttttaacttttaggttcaggggtacatgtgcaggtttgttatgtaggtaaacttgtgtcatggggttttgttgtacagattattttgtcacccaggtactaagcctagtacccaataattacttttcctgatcctctccctcctcccgccctccactgtcaagtaggctccagtatgtccatgtgttctcatttagctcccacttataagtgagaatatgggatatctggttttctgttcctgtgttagtttgctaaggataatgacctctaactccatctgcattcccccaaggggcatgatcttattctttttttatggctgcatagtattccgtggtgtatatttaccatattttctttatccagcctgctattgatgggcatttaggttgattccatgcctttgctattgtgaatagtgctgcagtgaacatatgcatgtatatgtctttatggtaaaagaatttggccaggtgcggtggctcatgcctgtaatcccagcactttgggaggccgaggtgggcagataacgaggtcaggagatcgagaccatcctggctaacacggtgaaacctggtctctgctaaagatacaaaaattagctgggcatggtggcgggtgcctgtagtcccagctactcgggaggctgaggcaggagaatggcatgaacccaggaggcggagcttgcagtgagccgagatcatgccactgcactccagcctgggcgactgagagcgactccatctcaaaaaaaaaaaaaaaaaaaaaaaaaaaaatctatattccattgggtatatacccaatgggattgctaggtcgaatggtagttctgttttaagttctttgaggaatcgcattactgctttccacaatggttgaactaatttacactcccatctgcagtgtaaattgtgttctcttttctccacaacctcactagcatctgttattttttcactttttagtaatagccattctgactggtatgagatggtatctcattgtagttttgatttgtatttctccagtgatcagtgatattgtgaactttctttttaatatcacatactatgaatgggtgaagagtctgaaagtgaaatccccagtgtggtttctgtttccccgtctcccatgctcacccacccctgatggctaggaaattacattatatgcttcatattattttgtttgcgtgtcttttcctctaactgaatcaagaagccagttgcaagcttcatttttgtgtcatgtgagtgcttttatttaggtggacttcataataggtgcatatgatatcacatcaatgcactgaagtcttacatttaataatattcacttatgtccttgttctctttggttagattattcagaagaacaatttctcatgaaaattaggaaatatttaattaaccaacctgagttacaaggttggagaaaagagaaagaggtcagttaaaattgttttatgttagagagttgatgaaattttctaagaaatggaaattttgatagccagagaatttttgcttgaactttatgacttatatatgttggtggcacttactcaggtcttagacattcttctttcaacattgagcaaatatatttagattgtccagcagtcactttgatgggtagtaaagatactaagatgaggatcggtcacattaacagaaatttctttttttttttgctgtactttccccattgcccagcacagtggctggcagagtaagcattcagcaagtatttgttaaacaactagagtcaaaactaaagggaagggtggaggatgaccaaaattgtttcttagggaattgagttgccttcgttatctgagacctgaattccttgattttatggtttatcttgacacatatttacttacttgtaccagaatttagctcagagattacattttttgtgccatggatacatttggcaatcaggtaaagcctttagatactttctcagaataatgcttttacatgtataaaataaaatacatggttacaaaagaaaaaattatatagaaatatagttatcaaagtattaaaacatttatgatacaataaacatgaaataagatatctgggcaggtgtgataacttctgtaagtgatattttgggctgtgtgcctatacagtaatgctacatggatttctgctggtgacaaagtcacaagtactactgtggtgtgttgcctgcattcatatttgaaggaaacaataaatttagaagttaatgaaaataaaaaggttttttgttcccactctctaagttcatggactccctgtatcctctctctagacctcacttcttcatttctttgcaaatatatttagagacttttcctatgaagtgcttaactcagccaggaattatacattgattagtgggactatttgattaatgtctgtctgcctgctggattgtgattgtggtgggtttttgttgttgttgttgttttggagacagagtctcactctgttgcccatgctggagtgcagtggtaggatctcagctcactacaacctctgcctcccaggttcaagcaattttcctgcctcagcctctgagtagctggtattacaggcacgtgccaccacacctggctaatcttttgtatttttaggagagacgaggtttcaacatgttggccaggctggtctcaaactcctggcctcaagtgatccacctgccttggcctcccaaagttctgggattacaggcgtgagccactgcacctgtcctggattgtgatcttgaagtgataggaacacgtgtgttgtttttttgtttgtctttggtggctttggctcatagtatctggcacagagtaagtgttcactaaatatttgccaaatctttagataaacctagggaatattaaagtatggttggcttggcatgacttcctatctgagactggttcctgaagattccctgctgtcttaatccattcaggctgctatcacaaaatactataaactgggtagtatagaaatatgtatttatttcttacatttttggagtctgggaaatccaagatcaaggcaccatcaaatttggtgtctagttagggcctattttctgattcatagatggcaccttttatctctgtcctcacacagtagaagggcagggcagctctctggagcttcttttatgagggcacccatcccattcatgagggctctgctgtcatgatgtaatcaccccataaggccctactttctgttatcatcacattaattattaggtttgcaacacatgaaattttttgggggaaggcacacacatttagaccataatgcccacctacctttaaggatatttagaaatccactgttcattattctaacttctttattaatttatcagttctaaatatagcacaaaagcccctttgattgtccttagcattttttgcaagcctcagatcattgttgattttatcttcataccactacctttataggcttgagcacctcttattttaattttgattacatgtacttctttaatcttttgccattatttttgtttatattagcttaacctttggggaataggattagttgtgagactttttgaaccttcttaatttgcttgaatttttcataatgcacgttaattttgttattaaacaaaaatcctactggtgggggttcctgtgagtctcatttattctttacccatctaaagaatgactttttctttgtcattggcattagttgcaattatgtagtcatgcctgggtttgtagagcctcctatcctcagctctaatgtgagggagaagtccctctctagagttaaaagtgtagtgtgattccctccagagcttctcctgtgtgtttactcctatacctgcacatctagaaataaacccttctgttgtgtagcatttttgacataataatagctttagtaatagattattaggcctttagtcttttacatttaggttgttttcagcttttgatgacatcattatgaacaacggcttggaaatccttgtatgaacttcactgtttactgttttgaacatttttctaggatacatatcaagtggaattactaggttgaatggtatgcatatttaatattccagtagatattgccaatagatagccccacaaaaaagcaccaaattgtgctccttccagtcacttatgagggtgcccattttctccacacctttgccacttctgcatttgatgagcctgtaggtgtatttatatgtgtgtgtatcaacctgagagtggaaaattgtatcttgttttcatttgtgtttctcagattactaatgagattgacaatcttttctcatgtttattggccgtttctatttatccttttttatacaaaaatgtatgtaagatacttagaacagtgtctggcacatgattcatgccatgcaaagtagtagtattccttgcttgagtttctggccttgggattatacccattgttttactcagttctgcttctaaaagcccaaggtacaaacctaattttcgcttgtgttctttccttaactgattagaattctcctgctttatcctggctggtgtatcctgttttctagcagcgccgccccctccccaaccccattgctcagatttggagcagtgagcaacagagggtgtggcagccaaatgtgcactccttacctctcacctgggctgtcctcattcaccaggctgtgtgattcgacagggaacccactgatcctctgcatctctctgacaacagccagtaacttgttgtatttcccccagtgctaccaagtcctttctaactcccgagtagaaagtaccccatcccatctcaaggagccacaggagctaccatgtctaaccaatgcaagagttctcagcttagaaaagctccctgagggatatgggtctctgcctggctgacgtgtgtgctctttcagcctttctacctgtgcttctatctcagagaagagatggaagatgcctgccactcactatacctattctattctaaagggcagtctctgttctgcctgctctctttttgttaacgctacacacaattttatattttctggaagttccttcctccatttttgtggcctaggttaactactgcccagtcttctctgaggaggttggtgtgagggaggctgcaacgttgaaggtttctatcgccagctggttgctcatttgattcagaattaaggccaaattaagagttctctattttgtttcctccatctggaagatgatattttggcaagtcaagaatttatcagaggcttggttgtgtgtgtgtgtttgcattagctcattaaaagttttttttaaactttttattttgaaataatttctgacataaaaatgttacaaaaatattacaaagaattccagaatactttccacccagataacctaaatgttagtgtcttacataacacagtacaatgatcagacctggaaattaacactgatacaatattattatctattttacaagtcttaaattttgccagttatctcactaatatatatatttttctggtccagtgtcttttatcccagatcacatattgcaattagttgtcacatctcctcagtctcatttaacctggaacagttagaggcttggctttttaaaggaacatcaccactagctgatgtccagatagttgaacatcaggagagcatcctatctctgttcccatcttgcagtgtatctgggaactgttgtcactatcctcccttcatctaggtaataattcatacatttccataatcaaaccacttaagtttctctctctgcatcttctaaagcctctctgacatatattcaatctcagttttgtagatttccttgtaatacatctattgcttttgaacattgtatcttctaccctatctactcacatcatatattcttccttatacagtttgttatctgtattgtagttgttggtttaaagacatttgaggccataatatgatcttactagacattccgagctgtgacctctcacctccagcaacagcaccagttacattgaccctctttcagatattgggcagtgatttgtgggagtggagattatggttggattagcttcaattttttttttctttgtgggaaatgcaatttgcaaaagaaagttcttataagagtgagactttgttcatttgaagaatgatggagctggcttttctgtcaatttctgcagctttttcttattctccaaaaaccagaaagtggtaatatttgttagtgatcaaatcaaagatgatatttaaaaacacatgttgacaggaggacctagaggcattatgagtattagaaagtctgcaaattaggttgtttgctttgtggtgaggtgtgaaacaggatatgcatttttgaaaatgtatctttggatttgctgaactgggctcaaatgtggtcaaattgagagagcttatgatgccagttttactgcattctttttagttgtgttccccaaaatcctgccccatgacctttaccagaacaagtaaacacatcctaaaaacaaagttatgttctagtatggttttaaaagtcttcccttttggttatttggaaaatagtgcaaacgtgcggtctagtggttatggccaaaggcagagcaaagggagtgcggccttagccagccccagccagctgccattgctcccacgctctgtgtggtcttgacccaatgcccagaaaagcaaggttccccactttctacctctttatttttaaaagtaaaaaaaaaaaaaaaaaaaaaaaagagagagagagagatggggtggagggagaaactgagctgagagacctctcaggttagaaatatgtcctcttgcaattaaccattgctagttagttttcactataaatctaaagagagctttatctcagccaaactaaggaaatcatcaacattcttggggtaaattgatgtggactttttgtttgttcatttggagggagggagggatggtggtgctgctgcctagcattgaatatactggagtacttcttaacttaatctcttcttattactactttgctgagatgaatgtcatctttctcctacagtagttgttggctatgcaaggcattttggatggataccaatacccttctttggcaatttctctgcctagttcttacctctgtgtgttgtcatgccagggagatgttgacctgctgagggcagggattgatcctgtctgttataaccttaaaatttttgttagggtgcttagtagagtgctgtgaaacataataagcacctattactcactgaattaacttggaggcaataaattgagtggttttctgttaactagtctatactcaagttgatttgttgaatgtcttgggttttgttcattattgggccactctgaatggaaatccatgaaggcgaggatcttgactttcttgttcttcactataatcccagaacctagaacagcccctggccaagatcgttgagtatactgattgagaatccatgttcaataaatatttattattaaactaggtgcagtggtgtacgcctggaatcccagctgctcgggagtgtgaagcgggtggatcacttgagcccaggagtttgaggctatagtgtgctgtgattgcacctgtgaatggccactgcactccagcctgggcaacataatcataccttgtgtcttaaacaaaacatttttttttgaatgaatggatttaaaaaagagaacccaagagcatgtttcccttttcagacgcgggctttgatgcggcactttagacgtggcactttcaagcgattcaggatgccttttccttttcttagtaatttttagtatatggcagaaaccatatactaaatgtcacaccagagaaagtctcaggtcagaaggcttattagagcccagggatcaggaattggttgggaagtttgtaacactgtctctagcaccagcagtaaaattaggatgggtgtgcatgtgtgtatatatgaatatgtgtgcatatgtgaatatgtatatatatatgagtatatatgactatacgtacttgtgtgtattaaatatatatatatataatatgtattttaatttcttgccatctgctggctttctttgaatttatgaaaaatatataattgtgcccagagctctggttcctggtggttgtgttgccatgttgtaaaagcaagtgtgaccaccagcatccctgtggccatgctgaagaagctacttattgatagttaacaattgattttagtcagccttccatttcctgagacaattcctatactttccttagctcttttttttttttaagaacattaaaaacagaggttagaaggggatataaagcaagaaaacaaaataataatactttaaaaatcttaggacttaaaattggagggaaacatgattctgaaattcaggccagttttattaattttgtgtccatatggtaagagtacattaaacaggtcgggtacggtgactcatgcctataatcatagcactatgggaggcctaggcggatggatcacctgaggtcaggagtttgagaccagcctggacaacatggtgaaatcccatctctactaaaaatacaaaaattagccaggcatggtggcgggtgcctgtaatcctagctacttgggagactgaggcaggagaatcgcttgaacctggggggcggaggttgcagtgagccaagactgcagcacttcactccagcctgggtgaaagagtgagactccgtctcaaaaaaaaaaaattgaagaaagcacagaaatgtcctgctgaagttttatagttgaatttccagagagagagagagagagagagagagagagagagaggagagagagagagagagagagagagagagagagagagagaggagagagagaggagagagagagagagagagagagagttgagaatagtagcgagcactaccgtccagtttttgttgcaaaggattcagaggccaagtgatgaatatgttcctctctatgaacaggctcaggacccgagccatatcactcaccagttccagtaagccttcatttttgccactgtcatctctctaaccctaaaatccagtcattatgagtattgtccttttgctattctttggttggggccaatattaatgcatcagaatcagtgtttggaagttcagatcaattttacccagaaggtaggctgtttccttggataggtatcagtattttttctttggctcaagacttttcagtacaatgttctaaactccagctaccatgtagttgactttgtctatttattcatcagaatcaaaggaggattggtacaagcagaggaaatagacacaaagagcaagtatgaggggcagagtgggagggaggtagctggaatgtgaatgagccaactaatttggtgagcagggcttctcactctaggatccatggatcaatatggacaggggcatagtggtcatgtctgtgaaccctctgcagtgacatacagggtgttggcatatggacttgctaaggagaaaagttcatagcatttattaatttgtcaaagggccctgtggcctactgccaataaatgaaaactattgaccaggtcatttcatgagaataagtatttggaggaggttgctttgttcttaatatccagaaaagtaatggcacattatctctcctgggcccacttgtgagctgaagagggccttggaaggtctcagctgagtgcatctttctgatgtctgcctgcattttgatcttgcccagagataaaatacaaccttgtttctttcacagatgagtttatagagagaacaaacttttaggtatgggtagggtgtgtgtgtctgtgtgtgtagtggaggagtgaatggggaggggcaggacaggcagaaagctgaaggcggagagagagggaacccacatgcatttgagggatgtcttcagtctcatcatggggtttccatgttggattaaaactgattatatttacttcattttgattagtgtatatactttcctttttgtgactgcaacaattaacagttaaactagtggtgggattttttttttttaagtttttgggataggttctaaaagttgtacttgcaagaaagagaagtagtatcaatgctgcatgttctttttcctaaacaactctattcatttctttttctattcctggttcacacaagaaatccttaaggtgatcctttttttgctgcatttattttttgtttggttccactattgttatcagaatgtcatgtttcctacagcgacacccaatttgagttattgacccagaaagtcaacctcaaggtcataagaagttctgtgcatctgcccttgttttaaacttatcttaggctgaattatgatggatacctatttagattagagagggcccctcccaagtaaatacacaacacaaagatgactatatgagttatagaaataaagaaaactgttcaggaatgtggaatgggtcccatggaaggctagcatctgtcaagagagcccatcttgcttgcaaaccaagttactcctgtggtgtgtttcctgtgaagtagattctaggttggtagatctttgagaagtgagaataagacctttccctttccctttcccttcctctttccctttcccttcctctttccctttctctttccctttccctttcccttccccttccccttccccctccccttccctttccgagacagagtctcactttgtagcccaggctggagtgcagtggtgcgatctcagctcactgcaacctccacctcccaggttcaagcgattctcctgcttcagcctcctgagcagctgagattacaggcatgtaccaccacgcccagcaaatttttgtgttttcagtagggatagggtttcaccatgttggccaggctgatctccaacttctgacctcaagtgatccgcccgcctcgacctcccaaagtgctgggattacaggcatgagccaccatacctggccagaccttttcttaaaatggtagttgttttagggacctttaaggaaggctggaaatgtaaaaagagaaaagaggaagcaccaatatttattgcttatttaggccctggtgcctctgtgtattatttggagtagcagaaggaggatcagtctgggatttgggctggggtctaatctagtcagactttaggccagttagctaactttcagggcttgattactgtcagggtggtagtatgtccgtcttgaggatcttatcatcctttaagggtccttccagctctgagatgtgagtccagatcttctgactaaataatcagccacaacctggccactcagagtagaggagggccctatcttagggagtccccaggctgctgtggctgttcattcagaaagcttttctgcaccttccagatgggaggtgaacagaccacgagcggaatacctgagttggaggtatggcatgtggattagtttcctagagttaccatcacaacttccaccaactgggtgggttacaataacagaaatgtattctctcagtattggaggccagaagtcctgaaccaaggtgttggcagggccatgctccctccagggaagaatccttcctcacctcttccagtttctggttgctccatgcatcccttggcttgtggctgtgtcatttcagtttctgcctctatcttcatgtgaccacttctctttcgctgctcttctgtctctagtaaggacatttgccattggatttatggcccactcaggtaattcaggattatcttacctccagatccttaattacacttttttttccaaataaggtcacattcacagattctgggggtgaggacatggacctgtccttttgtgggccaccattcgacccactagagcaagggacttttctttcttggtctctgcattttatgggtgtcatatgccatctttgctgccaacattcggcagtgcagtgaaagatgcctctaactggggaggtttctcttctgggagtgttgttttatttctttttctgttgtctgagtcagaggtactctcatctgttttggtgtttgcctagagatgactttctcattccccctcaacatcctatgtaccgtagtgtgtctgcaaacagaggaaagccttgataccttggtggaggtgatagggtggagtgctggggcactggtgatagaagagtgcaaagttatttttaaaaaatggacctgacagttctgtggaccattttttcagctattcaaaggtacttatatttactctttgggagatcagtcatcccattaccactggcaattgggtgttactgtatatattttttagcatcccagctaaaaaatcttttcttttttgacagagtctcgctctatcacccaggctggagtgcagtggtgccatctcggctcactgcaacctccgcctcccgggttcaagcaattctctgcctcagcctcctgagtagctgggattacaggcaccctccactacacctggctaatttttttgtatttttagtagagatggggtttcaccatcttggccaggatggtcttgaactcctgaccttgtgatcctcccaccttggcctcccaaagtgctgggattacaggcatgagtcacagcacccggccccaactgtgcttttttgtgttaagatgattgtagccacaatgtcatggagaggatataacttataacaccttgcactagctagtccatgtaagttgttctgtggtttagcttgacaaaatgaacgcccacaccaaccaggattgtcctcactggattcccactaccgctctcattcttgacatacaagggaaggtgagctgctcttcaaaattttgagcctctgaaatttaattcagtgaatatttattgggtataaactctgtaccagccactctataggtgctgagagagtcaacaagcaaacagattggtcacctgcacttatgccgtaaatagttccctttttccttctcgtgtacctttttctagccctgtacggtgcagtggttagttatcttaaactgaaaaacttttcatttttaaaactttcatgcaaaaagtctttgagcactagatatatacagatgtggtccatcgtagctggagtccatttctcctgggtttgtagctttcaacagtctagttcaagcacctgcttgtttcaccaccttcttcctttctaataggctcttcaagtcctgaccctggagaacactgcctgttacgctggttcactattttgggacttgccaaaattaaggcagcctgtcctgtatggacaagactgtccttttattcttttttaatttagtgaggtaaaacttatggagtgccaactgacaagagaccaaccaaaagaattttaccgtgtcccctgttttcttttagatgtagtgacttggtattacctctgcctgaaggtaggtctctccaccatctgcctgagataggggcacagagctgtctcagtttggcactaaagaggacttcccacagaaccttggttgacatcgtccatttggggtggggtgctagaaccacactcttcagacttgggtctctgttggtatctgatcataattttcttgtctcctttggaccaccaagggacaagtttccccattttaaaatacatgatatatggcacgcaagtatgctgtctgagcaaaggcgtttttaagcgagagctgtacaaatattatgcgttctaaccccacagcccatctctgggaaggggcacccagactttgggggctgttgttaaataccactaggcaatcatcaagatctgtttatctcattctttccatgaaatataagaatgttaggccccatatatgggattttcctgagaattttttgtaatgttcactcaatgcagagcccacatcaggttatgcttgctttctctgctcccgtggtcagaattttatctgagcctacatctacccctttggcttctcgtagagtccctttattcttataattgaaaattcccaaggctacctgtactctgtgttataaataaatatggtttctaacaagttgatgaattacacttcccacgcaacctcaactcttctggagtcattcagttggtcctgttttctctccagctttgttttctgtgtctcttaagaacactcaggttccttgttagtccacactccctggcttctcatccagcatctctacaccctcccctctggggatcttgccagttccctcacccagatcagtaacattttcaggtggcatattatctggcacacagtagcatgcagtacatgttgtataagcatatgaaacttgactagtgtccagtggtgatatgacgtcaactcagatgtgtttcaggtgttctgatgcccagctgactagatctagccctttgtccttatggagacactgcagtatctgtctaagggtttttctttgtttaggaatgtgcagtataccttttactgagatatttggtgtagggccagttcctgcactgcttaaatgtcattaattcaaaggtttatcatcaatttaataatcacttttgaggagcaagagggaaacatctcattaaagataaagaaggattataaaatgcattctgggctgggttcagtggctcacgcctgtaatcccaacagtttgggaggctgaggcaggaggatcacttgagcccagcagttcaacatagtgagacctgtctacacacacacacacacacacacacacacacacaccccatctctgcacacacacacatacaagtttggtgtgttggcatgtgccttactctcagctactccagaggctgaggtgggaggattgcttgagttcgagaggttgaggctgcagggggccatgatcattaccactgccctccagactgggcgacagagtgagaccctgtctcaaaaaaaaaatttttttttaaagccccacaaaacaaaacaaagaagatgcattctgattgcagaaaaagaggtgtttgagaaacgaggaaatatggtacatagaaattcctggtgatgtgctgtgatgggcctagaggactgaataggaaaattatgtacacaggaagtttttgataggaatggtattatcagagaccccttcaaaaatccagtgaatactgtggactctctaagaaatttggcacaacacttatggggatttatggatcctctgaatctacccatatcacaaacctcccgcctcaatcattgtagaagagcatgtccttatttgacactgttggaaagctctccaagaaatgactgaggaagaaatttgtgctgttttctatcaggaaccttgtttagattattaataccaaaaagttatttaggcctttaatagggaaaatggaaatagacaaatgaccggttccagatgttagtcttgttgtggcctctttggccagggtgcatctcatgctgtctccatgcatctcatgctgtctccatgttgcactctcagagtgaatccttgtgaagctttatgcttacttggctttactccctcagaatgccagaatcttggctgcagcagtgagtggagtccagccagcctggtatttctttagaacaatctctggagggcttcttttacttgggactcttaaagacaacagggaattatttgagaatattcaaaaccatattgtgtaatgaaaccaggcattggtattaagcataattgtgggccaaggcatccttgtttatctatgttttcattatctgagtccctgaagttatgattaatcaaaaatattaactgatgactgatcactaataaaattaatcacagctcaaatagccctccctgcttgatactttgatttattttaggacatcttgtctgtgtcctggtctgtctctgaatgacagataaataatcagaagcatgccaggcacagtggctcatgcctgtaatcccagcactttgtgaggctgagatgggaggatcacttgagcccagaaattcaagaccagactggacaacacagcaagaactggtctctactaaaaattttaaaaattagccaagtgtggtggtccatgcctgtagtcccagctactcgggaagctgaggcgggaggattgcttgaacccaggagttcgaggctgcagcgagctatgattgcaccactccattccagcctgggtgacagagagcctgtctcaaacaaaacaaaacaaaataaaaaagcagggcaaacagaaattgtaaatcattcaagacatctgtgactttatgaagtctatgaacatggtattggagacttgtattagtccatttttacactgctgataaagacatagttgagactgggcaatttacaaaagaaagaggtttaattggatttacagttccacttggctggggaaggcctcacaattatggcggagggtgaaaggcacttcttacatggtggtggcaagagagaatgaggaggaagcaaacgcagaaacccctgataaacccatcagatctcatgagacttactatcataagaataggatgggaaataccggccctcgtgattcaattatctccccctgggtccctcccacaacacgtgagaattttgggacatacaattcaagttgagatttgggtggagatacagccaaaccatatcaagacctcttgaattgtgtacgttgtcatagacaaaggaggagctggcatattagaacacttaatgaagagaaaacacaggagttgatgacttgatgggcacttgaaaagagtgatttgaatcaaaagaatgaggatggatttggggaaaattgatgaggctctcaattgcttttgcaagaatgataatctttttgatagtgctgtaataaagccaaacttaaaggctatcttacagcattatcataaaatcttgtagaaaaaattgtatctctcatcagcacttagtctttgtgatttcgtacacagttgaaataagaacataaatcttacgtaaatataaggttaccttattttgattattatgttatttttcaaaataaagttccatttagctctctgccttccctccaagaccatcattggaccataagatattggtcctcatgttaggggattcactttgtggctcgtctttgtaccattggtaataagaccttccttcctatacactacatgtgcataatagacagtaggtttgatacagatttctagatcctcctccctatggagagtctcttacgtagtttgatctagatttccatgctgcactgtttttattctctgctaccgtgtgccaggaagcctcttctcgcattgcagtgcacactgctttttatagaaagtgctcctgcactctctgccatgacccagagttcagcttaagtacagagaatttagcagttgaatggcaaggaaaacttctgcctatcaaaacactgcaaacagcgctctctctttttctctcttaccccttccagttcttcccactttcacgcattgcgttttgcacatgctcaggttctcaatctgcaaacgtacttgaactgggcataagcctttgagagatgctgcagatagtttttctagagagatttttgtttcataatgtttcagttaagaatggcatgcaactttaacataacttgaacacatttgaaataacatttgaaaaaactgaaaggacagatatgaaaaatttgaacagaggcccccaaacctatatggtcatttttgtcagggagcattttttgggctttaagtcatgtgtttagataaaccatttcccttccccccatttctcctccccctggtttggcacccagattgtgttttaaacaagttttaggattatgttaactcagcttttatgcaaagatgatctatgtaaaatgcctaaatatttagttaatttcaagatcgaaaagcctctgaggtggtattgtaaccagagctaaagataaatgcaccaatcatatgttgaatatatttaagattagtataagcagattctggccaggcatagtggctcatgcttgtaatcctgacactttgggaggccaaggcagggggattgcttgagtcttggagtttgagaccagcctgggcaacataagtagaccccgtctttacaaaatataaaacaaattagctggttgtggtggcatgtgcctgtagtgctagctacttgggaggctgaagcaggagatggcttgagcccaggaggttgaggctgcagtgaactgtgatcgcaccactgcactccagcctgagctacagagcaagaccctgtcttgaaaaacaaaacagtataagtagattcctttttcagcagccttccttaactattgtgaccttgagatacaggtatgctaattagctgggaaaaatgagtgtcattagcaaattcaacataggccgggtgcagtggctcatacctataatcccagagctttgggaggccagggccagaggatcacttgaagccaggagtttgagaccagcttggatgacacagtgagacgctgtctcttaaaaaaaaaaaaaaagaaaagaaaaaaaaagaaaggaaaatatatagaggaaaatgtgcatatttgtttttagttgttttctaatgtaataaggaattattaaacttagagactatcagagcttgagaagaccttaatagtcattttgagcacttctctcatttatagaaaaaaggcccagagaaagaaaattcatttttgtgagtcacacaagtggctggtagcacagtctgaacccagagctgctggcccttaattttatgctccattatgtcatgctattatgtggacatttgtacagatgatagaacaaaagcacattcatttattttatcattctttgtcaaacttactagacactcacttcaccaagtatattagttttctgtcagtgtaaccagccaccacaaaatgattagcttaaaacaacctccatttatgagctcatagttctgaagctcagaaatctggcatgctgtgtgtgtgtcctctgctcaggctagaaatcaaggtgttggttagctgtgctttcacctggacttggggcccttttccaaacacatgcctgtgattggcagattgggtttcttgtggttgtaggacttgagtccacagatccttgctggctgtcagccaggaccccctcccagcctctggaggcagcgccatgttcctcctcttgaggctcctccatgttcaagccaaggccagcatgttgaatccaccctatgcttcacatcactctgacttcttttgctaccagccagagaaaacttcctgcttttaaagagctcatgtgattcaattaagcccatctggatatctctgtattttaaggtctactgacttgggactttaattgtatctgcaaaaccccttcacagtagtacctagattagtgtttgattgaataaccacaggagggaaacctcaggggagctatttttagaattctgccagccacatctgacaagtctggtggccaaactttggacaaaccctaccatgtgtgacactgttgtgaacctggaaataaaggtgggaaaaggcaactatatgggattggtctgtttttgtattccaagggcccagtaatagaaatggcctctaggcagcaatgactatcacaaaccccatgtgcttggttgaatagaaaagacagagtcatggcctcatggccatagctgaagctgtctcatccaaataagacagctaggacaacctgatacagcaagaagtgtttgctggtagcagcagcagaagaaagtatactataaaagcacagtgatctgggtttacatacttctgtccttcccctgatgacagagcaccaaatagtaatcatgagcctaaattgacaaaagaagttaagttctatgtactcagtctaagagcagaaaatctataagcagttctctctcatcgatggattcactttccatagttacctattaaattagctgcagttcactgcagtcccaaaatattaaatgaaaaattccagaaataaacaattcataagtttttaattgcacatcattctgagtagcatgatgaaatcgcccagagcgtgaatcatccctttgtccagtgctgtctatccattagtcacctagtagccatctaggttatcagatcaaacagcagatacagggtttagtactatctgaggtttcaggcatctactggcgtcttgggaggtgtctcttgttatgaggggagactactgtaatgtgaaagaaactcccattgaaaaatggtttaaagtttagtacctaaaaaggctaagcttaatttattgagaaaagtagttcactttagtggaaccccagtggcttctcattaccttgaataaatcccagacctctggtgtgatcagaaaggcagccccactggccatttttctatgcccagcatgccaagctatttcccaccttgggacttttgctcatgctgttctgctggtcttcagtgttcttcagtttttcacttgcctctttccatagctcactctttcttcttcagatctcaacttataggtcaccttctcagagagggctttcctgattacctgattttataaaattaccacttgcctcttccccacctctagaagcttctatcaaatcacctgcttatcttctgtacagcctactatgttttcttgtttataatttttctttcctttagagtggcattccttgaattagaccttatctaacccacctttgtctcttccatgtctagatcagagccaggcacacagtagaaagccattgtttgttggagatttaaaaaatggatccacgctgggcacggtggctcatgcctgtaatctcagcactttgggaggctgaggtgggaggattgcttgagcccaggagttccagactagcctgggcaacgtggtgaaaccccatctctacaaaaaatacaaaaaactagccgggcatggtggtgtgcacctgcagttccagctacgtgggaagctgaggtgggaggattgatcgaggttgggaggtggagggtgcattgagttgtgatggggccactgcactctagcctgagtgacaaaacaagaccctgtctcaaaaaaacaaaaggggggtccagagagtttaaatgtcccattgtcactaaggaaaatcatggcataatagggagtagcactcagtttaagggaaatatcagcctgtcacctgacctatgggtattactggctatgaatttggcaactgggataagaatggcttaatgactagcccttgtgcagttaatcatagtaagagataaagtctatcctcctgtgcccttgatgttttcagccattctcccacaaggaaatatgttgaaaatattcaacttttagaattcttgtctttgttaaataaaattaaataaatgatcatcttttaatgtcccatttgaagtgttttttagttcttctcactcttcatatttttcctgcttgcaaattctcttttaaatttgttattttcattttcagcatctgttagacaaaaatgacgacagatccatttcctggtagaaattacacatcttttgaatggtgttcctaaccctcagcattcccaggtttgtttaaaatatcactgaccctttgagatactgctgtgtttggtactgagactgagttaatgagaaacttcaaaagcaaagcaggagaaatgcgagtggcgaaaaaatggacgatggaattttttccaaaataaaactctacgcctgtcttctacagattataccagacatttcatgccctactgaaatgtaaatgaggcttatttaatttgggcaactccatgtgaattttaccttgacaaatttgaaattgtgctttcaggtttttgtttgttttgccttttttgcatcctttaacctcagttcaactctcagccaggagctgtcttgagtaagcagcaattcactatgtactctttgggtggggctgcttttggtttttaacaaatatgaaagaataggggaaaataacaagaactgaaagagtaggaaaagccaacaccctttatgccccatttctagatcatttcattgttgaataataatatgataacggatacagggcatctttatagtcttaatcttttcccaggttataggctgccaaccagaaatccacaagaattttccttgtttgactaacaggcctgaatggtgaaaggtttttttttggttgtttacttgtttgtttgttttaaatgtctggttgataagctatctatgtacaaagctttgcttctacttgagtgtgaggtaagtaacctgaacccccaaacagatgagccatgtgaactgtgggtagaacagagggtgggcacaactttttccacaatgagaggcagcttaactcttgtttgtttttttaacttttattttaagttcaggggtacatgtgcaggtttgttacctaggtaaactcatgtcatgggagtttgttatacagattattttgtcacccaggtactaagcctagtacccaatagttatttttttccaatcttctcccttctcccaccctccactctcaagtaggctccagtgtctgttgttcccctctgcgttcatgagttctcatcatttagctcccacttgtaagtgaaaacatgcagtatttgtttttctatttctgcgttagtttgctaaggataacgacctccagctccatccatcttcccacaaagggcataatctcattcttttttatggctgtgtagtattccatgtatatatatatatatatatatatatatgtatatatatatgtgtgtgtgtgtgtgtgtgtgtgtgtgtgtgtaccacattttctttaacctgtcattgatgggcatttagattgattccgtgactttgctattgataatagtgctgcagtgaacatatgtgtgcatgtgcctttgtggtagaatgatatatattcttttgggtgtatacccagtaatgggattgctggatcaaatggtagttctgtttttagctgtttgaggaattgccgtactgctttccacagtggttgaactaatttacactcccacaatataagcattttcttttctccacaaccttaccagcatctcttatttttttactttttaatataggaaggcttaactcttaatatctaaacaccgtacttacaaaacaaattaggattaaaataactacatcaaaattattactaaatctcagatctcagcctaaatgtcacctgcgccttctcagagaggtgattactcctgattactcttctttataaaattagcactttccctcttcccaacctctagaaccttctatcaaatcacctgcttatcttctgtgcagcccactatgttttcttgtttataattcctctccctcctttagaatggcattctttgaattagaggatctctgtgcctattttattagaatatctgcaatattttttatagatcatcagaaatttaacagagtggaaaactgaaaggtgaagtgttccaagtcattaaagattaaaaagtaaccagaattcacgagaaagcaaagttaagttataatgattttttaaatggacataaggatcaatgggaaatcaagataaagcaaagctgaaattatggtattttgatggacttagtgtctagttttaaatgttttgttttgactgacagaactgaaatgctagactgtctgtttctatataggatacctggcaactgaagtaagacatatgatattaaaatatagccttttaccctgaaggatataacagttatgttgaggagatgaagacataaaaaagataagcatgaaatgtaagtaggcttaatgcagtttcccaaactttagttttctccctaccccgctttcagttttgatcatatacctgtaacatttgttctatttactaaattcttttctttgatttgattcactttctttatttacaaaatttccttttaaaaaaataagtgcgtatcctactacctatatcagtatcacttgctgaataaggaaaccctaaaaataagttaaatggcaacaaaactatattgttaagttctagctagatactttggctcctaaagccactgagcttatgccttgcttttctctgtttaaaacaacacacacacacacacacacacacaaaacaacaacagcagcaaaaaaaaccgatgttaagaactgtcaagtcttggagacatgccaatatcaagtagagacttcttttaggctatctcaccaagtttcaaaaagactaggaagggagtatctttctcaggtcgtgacacacaacctgacatgcatttctggatcacctgaaattatctcttgcacggtagcctgtaggggccagcctcacagggtcggtgggcttctccctgtgtgcggcgacgagagagtgtagaaataaagacacaagactaagagatagaagaaaagacagctgggcccgggggaccactaccaccaatgcgcggagaccagtggtggccccgaatgtctggctgtgctgttatttattggatacaaagcaaaaggggcagggtaaagagtgtgagtcatctccaatgataggtaaggtcatgtgggtcacatgtccactggacaaggggcccttccctgcctggcagccaaggcagagagggagaggagacagagagaaagacagcttatgccattatttctgcatatcagagacttttagtactttcactaatttactactgctatctagaaggcagagccaggtgtacaggatggaacatgaaggcggactaggggcatgaccacttaagcacagcatcacagggagacggttaggcctccggataactgtgggcaagcctgactgatgtcaggccctccacaagaggtggaggagcagagtcttctctaaactcccccagggaaaaggagactccctttcccggtctgctaagtagcgggtattgttccttgacactttttgataccgctagaccacggtccacctggcaacgggcgtcttcccagacgctggcatcaccgctagaccaaggagccctctggtggccctgtccgggcataacagaaggctcacactcttgtcttctggtcacacctcactatgtcccctcagctcctatctctgtatggcctggtttttcctaagttatgattatagagcgaggattattataatattggaataaagagtaattgctacaaactaatgattaatgatattcatatataatcatctctaagatctacatctggtataactattcttgtcttatattttattatactggaacagctcgtgtccttggtctcttgcctcggcacctgggtggcttgccgcccacagtagcctaggtgccatacttgggcaatccaggctcagtaggatgctgccgagacctagccacagtgattttgttggtctcgtgtactgggagtagaggggagtttttgaaagccatccagtgtaaatagttggagcgttgtgttttaaagggcctgtaaaaatttttagtttaatctttaatagccggttctaaataagccttttgttttctctctcccactccttttccccttgcattttgggcagtttggtttctgttttcagtggtttgctttgtagcatgcagaatgggaatgattctataaggttgggatggcagagaaaagaatacagaaaagagtcaaatattgacacacacacttctctttctgtttgtaaggtctcagctgaggagtcacacataggaaaactctcctaatcgcatttataacgtactgtaggagagggcatgcacacctacacagacagctctcaggtatctgtatggatgacttttggcctatttggaattccgtgactaatttcctcctgctccccaatagggttcaactttgtattattttttttaattttccagagtactttgacatacctgatctcattttttctacatgccttctgttggcctgtgaagtgcaattaagaagacaactattctgtaaaagtatgtgtaaatacttggcctcctaattgcaaacagaatgacttgggttatgctcagcattgtttcctttcatgagtatgaataataaagtgttgattgtaggtgcatttaattgttaaaacccttcagaacagccatatagccatgaaagactttgttgtttatttaatagcttttggtctaataatctcattgctggaaaaatgtattccaagtctgtaattgagaagaagaaagataaagattctatacaggaaaatcgttcattaatgagttatcttttttcaaattttttattttactttaagttctgggatacatgtgcagaacgtgcaggtttgttacataggtatacatgtaatgagttatcttttaaaagtgtaataatctgtgttttagccaacagggcaataagtaaactatggtatgacaaccctctgaatgcttatactgctattacaaccataaatactgaatgcagaaaaatgcttagccaataaatgaaaaatatatgaggatgtatgcatattattatcataactctttgtgtgtatatagtgcatattgtacatatgtatatgataccacacatagacacacacgcacactcacacatacgtacaaaaacccacagaagatacaggaaaataaaacagctgctgttaggatggcaaattttttttaaggtgttattcttaatgttcgtttagtgctgtaatgtttttattggaagtaagattcagggcagggaaaacagaacgataaaaattgaccacatatgtataaaaacaagtgccagtaagacagagtgaactctggttgtatagagaagtcagatatatgtaaatcttaatagagccattcagtgtcaagcggttagaaggtgtatgtggcatcagtttaacttctgatggtgtggtgacctcccagcctccgatacccaccctaacctaacctagcacctagcacaatgcttggcttgttattgtcatcactaacggatggatggaatcagtggatggttttctaagaacataaatccaaattagaatttaagaggccgggtgcggtggctcacgcctgtaatcccagcactttgggaggccgaggcaggtggatcacgaggtcaggagatcgagaccatcctggctaacatgttgaaaccccatctctactaaaaatacatcagtattctattgatgtgccaatctaggcacttagatgatagaataataaggtaagataggtgggaaacactaattagaaccagaagcatttagttgggtaaatagaaggaaggaaagaacccagtttgttagagaacagaggatctgcaaagctggggaagtagcattctcttgggtatgaaaataggaaagggtggtgcacggatatgaatgatggcagctgggaggtgggtaaactgataaaatcagtgatgagcaagagtttgctagaagttcctgaagcttctggagaggtggtccttgctactattaaaggcattgttcaaagaagggccagaaaacccttggatcaggcttgtactcggaattgtttttagatgagtttccttgctcataggtaacagatccggagcagctttacttcttgcttctcctcctcttcctcttcctcctcctcctattcctccaccaccattaccaccaccatcatcatcccttttattattagctcatttaatcctcataacaactctatgaggtaggtcgtatttccctcagtttacagttttggaaactgagacacagagagattaagtattttacctaaattcacacagctaataaacagagataaaatttgaacccagagcatctggtatgagagccagtgctcttctccactgttacactgcacagttgcgcctgggtaagcaatgattatttccttattaaaaataaagacctatagcttcttagcctgtcctttctcaaaaaattatattaggatctctggattgtttttgtatgatatatttcaaaaaatttttaacatacaaatattagatatgctcactctcaaaatgcaaataatatggaagtagtatgagaataattaccctcattcctcccttctagggatgaccacaggtaatttttagtgactatcttttcagtcctctctggttgtgtatatatttacatgcataggattgcacttcttttgttattttatacatatatctttacatacatatgtattgtgcatatggatgtacatgtgttgatggaattgtgcttcacatgttcttttgctttttgtagtctttgtatcattgtcactgaggtctggccatgttaatgagtttaggtgtatatcactggagctctttgatttgccgttgtgtatcccttccctgacaaactgctggcacataatagatgctcaacaaatatttgtttaatgaattgtgttgattccattatcttatgccacaatgtttaagtagtcattttttattttactcatttatttacttattttcagacagggtcttactatgtcacccagactggagcgcagtggcgcactcatggctcattgtagccttgacctcccaggctcaagtgatcctcctgcctcagcctcccaattagctaggaccacaggtgtgcaccaccatactcagctctttttattattattattattatttatagagaagggggcttgccatgtggcccaggcttgtcttgaactcctgtgctcaagcaatctgcccacctcagcctaccaaagtgctgggataacaggtatgagccaccatgcctgaccaagtagtcattttttaattgaacgtttagtttgtttcctcttctccactagtataaaaaatgccatttcctcatttcaggaaggctggccattttgtgatgagacctttatagtttggcaggctcttggcaggatgaagatgaagctgttttctctccatctggccaggtatttgctggctgccgttgatcagtcccaatggagacagtgactcttgggaaattatttcctcctacattagaggccagatttaaacaaataaagcttgattttatgttggcctgttctttagagactctttatctttggtgggtagaagagctccagttggattatttgtcttttccatgaataatgttcgtttaactgaattagcaggggaagagcaatgaaatattagaaatgcttattgtaccctttagagtagtgcttcttaacctttctggaatctcagagcccttttagaatggctctgggactaagctgtgggtcctctgcttagagaagtgcacatgggtggtcagtgtatcacggcccctgaagatgaggagtatgggttgaggacctctgtacttaggggagctgttgcctgtgtttgccttcccttcctgcatagtctctttgctcttttcctgtgacagtgttttggtgacactgctctggaaacttcggtggcttgttgttgttgttgttcttgatatttttgaggttggggatgtatgtaaagaattaacaagtggattgcatcttggtaggcagaaaggaagaatacagcattttattttctgccagtgtgtataaacagcccacaccagggactttttgtagatactgttagtcatgttaagcagatgaacagggtgcatataaagtgtttgttgaacatgagagttggttgtaggaaaattcccactgagcccagtgctgcacacatattcagcactcgtgaaccaggccttctgctagattacaggaatagaaagataataaatcccagtttctgccctttaagggcttatgttctaggagagggtaagggtcatgaaatgaaataaatggagtagttttattagtgagcctggtttgtttccaaaggccagaaactggctcaaggaaaaaagagaattttttggttcatgtatctgaaaattccagaagtagcctttgactctttctgttttcctctctgttggcttcatccttaggttacatctttgtgtgtgacccaccagccatccacttctggcggctccaacctcatatcacccttaacagtcagcagttctggcaagacgacatacttcttcccctattgttccaatagaagtcttggagttgggtcacatgcccattcctaagccaatcattggggccaggaagagggcagatagaatatgctgattggccagggtgtaacggacaggggagccatctggactgtcatctggggaggaatggttccccaagggagaatcaaggtgttgttaccagaagtgggaatggatgtggggcaagtagaaacaaggaccactacagcagtaatctactaatagaagtttctgtaagatgtgggtggacaaggaagaggatgtgacggtcactctagaaaggctttctggagaaggcgatgtttaaccaagtttctaatgaatgagtcaatgaatcaaagactaaaatagccatctttcaggacataggattctttcatatgaaactttttaaagtgtgattgtgttagtttaaattctggtttcaatcccattttggtaaaatttaagattctacaaattttttaggtggcattggaggtttgagtttaagtaaatttgaagactgagatacaaatttgaaaataattttttttcagagatgtccattataatgatacttaatgtggtgggtctatgtatttggtacatattctaagtaggaggaaaataaccgaagttataactgtttctccttatcactgatcatttgtaagggactatgcttggtacagtactataaacccttgatttgttggtggggcagaataaccatggttataagtaaataaaactagcatgcttttgaagagaatgaaattgcaggagaaggaaagcatctatatcttggaaggttccaggtgcctagaacttgacagtagccattaggagactgctacccggtttctggtcagatgtgttcttgtctcactgaagccctggattagctgctatctcctcagctggggaggccccagggtatcactaattagcagcgctgcaggaagtttgagcaagtttaatcatatctttaagcgaagtcttctggtagtgctagactactcttttctgtacctgctgatttttttttagaaacggaggctgatgacaccttttgagtacttactgtataccattctttctgccaaaaaagtctcgtgtattgtttcttgatcctatgaaggtagacacaattatccctgttttgcatttcaggaaaccaaaagcttaaagaggccataccctcaactttttcaatttagcaccaagctaatctgagagtgcttgaaggcttctctgatgagcccagagaaagacaagaggaagctgacattaaggatgaggttgatttcatttcctatgtgatacacggagtttaagatacagttgtgggccaggcacggtggctcacgcctataatcccagcattttgggaggtcgaggcgggcagatcagttgaggtcaggagtccgagaccagcctggccaacatggtgaaactccttctctactaaaaatacaaaaattagctgggtgtggtgacacacgcctgttatcccagctactcgggaggctggggcaggagaattgcttgaacctgcgaggcggaggttgcagtgagccgaaattgtgccactgcactccatcctggctgacagagcgagattccatctaaaaaaaaaaaaaaagatacagttgtgaggtttcttgatgaggaagagcaagtcagaagcagtgaggggtgactgctatctggctttcatcatgggaaggcctgctctccttctgattcccttgccaggccatttaagatgcttctttgctcagaaaccagttgctgtctgcacattttcttctaatatttgagtgaaaggaagttcatctgaatagggaacttggagccaacactaggggactgccttaaaagactgttacctctttgaggggcctttttttgttttgtttttttaatacaggcttaaattaatcccaaacctttgtattgtattccttatttttaaaaataacttttattttgtgtgtttaaggcatacaacatgattgtaagatacatatatgtagtaaagcagttactatagtgagacagattaacatagtgatcatctcacagttaaccattctctaccccccaagaacagctgtaatctcatttagcagaaatcctgaatgcaatacacattattaactgtagtcttcctgttgtatctttagacttactcatcctatatatttgctacgttgtgtcctttgacctctacacctcatcatttcctttccactaccccaaacctggtaatcactattttgttttctatctctgtaaatttgacctttattcttttttttttcagattttacatataattgagatcatgcaatattgttattattttaatttttttctgtgatgtttttaaaatggtaaatatttctgtgtattggaaataagtttctctaaacaaatttttatttcattttataccatattttattaaattttaattgttaataaggattgatttggggttgttttagattggtaattccccctagtccagttgactgagagttaactgcaggatgaaaatggaccctgacagctcagagtgggctagaacaaatgccagaactacaggtaagggtgtttgttgcagcattggtggaaaagctaagatagatagaagagatcgttaaaaaggcattgctcaaaatagcttactagtatgggactgacaatttccattatgtgtatccataccgtggagtcctgtgcagtattttctatgtgatgcaggtctgtgtgtccttttaagaaaagcactgtgacagtagcgacatccaaaacttcttgaataatgtgatctcatttgagtaaataaaaggatgtttatgaagtctgtgcacatgctcttccttgtatataaataatttctagagatgatactcaaaaatcgttgaaatgttcggggagcgagaatagagaattttaaccttccatttttaaacttttctgtatagtttgattttactccatgcacaagtgttagttttatttttaaaataacagtcctaaaagtaacacttattggttatgaatgaaagagaaatttcagtaataaaacccagttaagttccttaattaaaataaatccatgggtgtggttttagtagctaggtctgttacataccttaagacccaggacatttcttttctctccctcctcccaggctttatgaaactatagttatttatttcatagatgtttaaaagtaggtcagcaacacaaccagaaaaagactctccgttggtttagggggaggtgggtgggagggcgctagcagaggacatcaggttggcttccttgatcttcctctgcctttttgtgtttgttgctggtttctaaccattttcctcccttttcccacatacattttgaagattattttagactgggcagtgccctaacatttttagcttttgccttctgtatttttacagcatgtttttagagtctgtttattttcttagtgtctatttgatcagttcctttaaattttatatctagtgctttattgcttcatatcctgcttgcttctgctatagtttagtgtgcatctgactttggtcattccgttgctatcctgttccatttatcccttttatgtttgtatttcagtttttttttttttaaatatctgaataattcaatgtctccaacccaaatagccagtgaaacttttctcgacctacctggttacgatggctgaaatgatacaagcaaccatcaggcaggaagggctctggttctcgatggtgtattattgttctgacagctaaaccctggcaggatgatgcctacaggctcctaatatggagcgcgaatgtttggaaatgttggaaaattacaggcaatggccctctttacatgggcttttcatgggaatagatgaattcatatacaaatattgcttaatgttttattttaagaggcagtaactctacaaactgatgaaatgtttacaacgtgttttttctgaacattaactcatgtaaagtgtttgtggttctcatggctcccatcatgggtggatgaggaagcagagcctcctccacattcaagccttctgactgcagggctccgctcccgcctgagcttttccttccatcctcgcttgtcttcacatcagtaatactgaaagtatttggcaagctgagcttctagaaagtgatacatttttggaaagattttttcctcctcaactatttagcattgtgaatagtttccccttttgttcctttcgccctctgtccctcaggccgtgttattttcaagaccttccattccattttgctagcctcccttgttccacatccatacctcccttctcatacttttcattccacctgaagagtgggaaatggctttttccattaatcctgccttgcttttcctgtaagatctagcaccaaacctccctcttcccagaagtcttgtctgacgtggtacatccaacttcaatcgtttcaaatctccattggccctcccctacagttctgaaagattctgtcttacacatggggtggtcgaggaggggaggcaggtttgtaatggaaatgatggtagactgagcaaggagatgtagcatctgcttcccttgtgctgctaaacggcatggacttggaaaagctgctcacccctcctaggcctgtggttctgcagctttaatataaaaggggtaggactagagaactgcgtctacagtagtgattttcaaattatgtttcaagaatctttgggactctacagttgctgaggtgaaagaaacctttctcccagcttcttccagagctgccctgctttcatcttgctggtgtactggggtttcacattcaatttttatctgtctgtctatttttgataaaagatattctgtactaatagttttaaaaccatcagattaaatgacctgaatgtggttattgtttcttacacatagttagctacttaataaatagttttaattcaacttagctttgatcatttagcaaactataaagatgatccctgaaagtttagtcttagctttgttctttagatgtttcttgtgtgtatcatctcccaatcgacagtcagtaaacttcatcattcccagtacctaagattgcagtgtgtatacttgtgtatactttattacccagcgtccctgagattacttaataaaggattttataggataaaagtagctccagtctttgtgtcctgggttgcctggagagtattaagaaaacataataaaattggttgaggtgtaccatacatgtatttatcttacatgaattcaactataagcattctgcaaataacaagaatataatgtggcctctgaacaccagtaactgctttgtctggtgctcagctgaataaaccaccgtatggaggaaaaactctccgtggaacttagtgacaggcagtacagtacagtttaaacaaagcaaagtatattatgccatatgcccggcttaagggcttttcacgagaaattctcactctatctggattttgccttaaatgttagctgtagaacctaacacccaagtaaagatatggtatcatcatattctatttcacttcattggaagctctttcccatgaaggattctgcagatttttaatacatggtgatgcttccataaagtactcctttaaagcatttgaaataatctgtttgaaataggagtatgaaaccatttagaaagcacctctctaaaggaaattaagtttatgaagtgaataagtgaactaatgtcatgctagcagcctgtgtagaggatctactgcttctgagggacaggggttatcggctaaaggaaggacagatctcttgatccctatttggcccttttgctaaccctgaaagtagcccaagagcaaggcctctgaaatgctaggacatttgacccaatcattattactacatttttgtatagtctcaatggagtctttaacatccatacataatagatgtatccatccaatataaattcaatgaataaaagcgcacctaagtaagactgtgtattgaaaaatgcaacgttcataagatatcctgttgggaaaagatatttttttacatgccaaaaatacaaattgagactttactaaactagattggaaagacagttctgtagagacatctggttccctgtaggtggaatttcaactcttaaaagcgagcatatcaacttaaatagtatgtgaactagagaatttagattttgaacctgctggttcaaacttttctgtgtttgccatcatcctcaggtaggttctcctcatcgtgtcaaagataggcccttggagaccaggagaagctcctggtctgtaccctacccatttgcacgcaagagtacacctctgtggtaatagttccagcaaaagtcccagggcaggctctttcattggcctgggccaggttctgtattcatccctaaagtggtcactgtgactgaggccactcctgagtcatatgctagccctggggttagctccgcccaaccacacagacagagctgagggaaggagtacactaaaggaaaattgagaagttttagttagaaagtggggatggattctgggctggcagaaagaacagatgttcctcataatgagcaattgcaagggctcatacaagacaagtttcagaggggctattgatggtgtgggtaaagaaaattatataaaagtaacacctcaacccgcggttcttccttgagattatggttccttttatttcacaatttgtggcattgctgggccaataaagagaacttcaaacagatattccacattcttttattggcacacagagggccatcaattaaccttattaaaaaaaaaacaacagtggaagaatcctgttttgaaatcttgatttgctttaaaagcacgtagatggttgttgacagatttttgttggtcctggggctgccacaggtcagccaggtgtttttttccccctgcgggatacggatctttggacatttgcctccagtctttgcgttgaactcagcagtttcctgggtgaggaggcaacctttgtgtgctcagcttcttccaaagcagctgtctctagaagttgctagccatctcctggttaagaaagaagatggaaggtggtagggagaggaagcaaaaacatttcacactgcctccccaaagacagatctgttatcctgccttgaccacaaaaattcacggaggaagtcagtgagtcagagatgcgccagggtgtaagttgtcagcacagttcagcgagctctggtatcttgtgtttctctgttcgtaccactactgctttccttcctggctacattcaccagcatgaagaaactggagcagcaccttgagaggtttcatcagcccatggctgggatggttgacagatcacttgcaaagccatgggaaaaggacctggttcctcttgactcctctgacttattttcagtgatccgacatcttgaaaatattttccatttcactcctaggttcttgtaggccttcccacaatgagcacattcagtcttaaaaattttttttctgctttaattggcgtggggtcggatcgcttctccttgggtcttaactgtattcagaggggcttagggtttgcccaaggcctcaaaggccatgagtggtaggtcatggtcaaagcatgtcctctttcctcaatagcagtgttggcctaaattcattctccacttcttcgactctctttctcttgggtgatgaggaggtatgagataatgtgtgagaaatccttggccatctttggagagaggggctctgtctatgtacctgtgtccccatccagaaaatacatagccagggttggctggtgctgctctcatcattgacataaccaatctgaaactggaaaccgaagcaccagtatagaatggtggccaagagggtggtctggtttcagacaacctgggttgaatttaggtcccatccctgactacttagaataattttatgccccagattcttacctgttaaatggggatgattttaacactgacttcatagagttctcagtgcatttgaatgagataatccattgaaatcaattggcatgatactttccacctcttgaacaccctataaatgttattattatcttaatcctggagctttatgtcaagaaaggagtttgcctttttttttttttttttgtaaaaattgaaaattttcaagataaaaaattgggggaaaatataaagaagcataatggatgatataatggccagtcatgtctcaccagtcagcttcatcaaatcttgacactttaccacatttatttttgaaaaaggaattaaagcattgctgattcatatcctctgataaagcaatgctagggtaaaggaaaaaggaggcgaaactgtttaaaacaaaagtgacttaagacacctaatgaaatgcaatgtgtggacttgggttgggacttgatttaaccaaagcaattatacaaagacctttttgaggccattatggaaatctcaatgtgggctgcctatcagatgatatcaaggaattattaattttgctaggtttgataataccatggtgaagatgaaaaaaacgttattagcttaaagaagataggaatttgtaggagagaagtttgtctttttaatgtttctactttctgcctccttaataaataacagtgttaccttggcagtttcatctgggcgttgtttctctcctctctatatcatcccccaagtctactgaattttgaggtcccagctggtgtcagagttttgctctgcaattgcttttttctggctcagtctgtgtgtccagttggagtgagtctgctcagaaagtggattcttccaccttgggaaccctgtgcatccagagactatgggacatcttccttttgactcaatgtttcacttgggatctggcaaacatagacgtatctcttgagggctaggagtgccactgatggggccacattatcaatccctgcagaagaaaacagcaggaacaggctgatggcttgtgaaatatttttcaaatttcttccatacacaatcaaggaaaaaggaaaatgcagaagtggaggccccagcttctgttctggctgtattgtttgccttccaggcaaagagagtatttgtgtgagaattaagggaaagtgtctcactgtgagcccaatcccagaaggtaattccatatgaagtttattctctgcaggcactgttgtgggcgtgccagaggggagggcggagtatgggaggtgggcagacagcacttcctgcctactataaatccctggccagcagctggaaactccggagtgaggccttcagagaggaatgtcacctggagtggataatgcttgttgtcactttcaagccaaatttataaatatgtgatcaccaaccagatcaagatgtagaacatttccagcatcccagaaggctccctagtgcactcagtcaataccttcctcgctccccttctccctccaggtaaccactcttctgacttatattgccattgattagtttccctgttcttggtgcttcatgtaaatggaaacatataccatctactctttgtgtgtggctccttttatgcagtataatacctgtgagactcatccatgtttccatgtagcagtagtttgttctgattgttgtagaaagcatttcgttgtacagaacatatcactaattattcattcttcgattgaacaatggattgtttgtaaatttgagctattgtgcataaagcctctaggaacctttattttattttattttattttattttattttattttattttattttattttatttttgagatggaatcttgcttagttgcccaggctggagtgcggtggtgcgatctaggctcactgcaacctccgtttcctgggtttaagcaattctcctacctcagcctcctgagtggctgggattacaggtgcccaccaccacacccagctgatttttgcatttttagtaaagatggggtttcaccatgttggccaggctggtctcgaactcctgacctcaggcaatctgcctgccttggcctcccaaagtgctgggattacaggtgtgagccacctcaccctgtctggaatgttcttctacaggtgttttgaggccataagtacttatctcttgagtatattcctgggagtgggattgttggatcataagggacacaaatctttaccttagtaaatattgccacatagtcttgcaaagaggttgtacccattttcatacccaccagcaatgtgtgagggtttcaattgttccatgccctcacctatgcttggaattatccatctttttagttgtaaccattctagggcatgtgtgtatcgtagtagtagttgtcattgtcgttgtagtgtcacacttggtgtttattttcatttcctgggtgagtaatgatgtttggatatcttttgagaaataccagtaccatcttttggccatgttttcattgcaaatgtatcctttttataaaggtgattatgaacatcaaaagtcatcatggaaagaaaaatgcagatagagaggctgcatgtggcagcagtatcagctggttagtgataaagaacataggctttgctgcccgacagcaggagttcaagtcccaaccttgctacccactagtatggtattaattcactttctaatcttatttcctaaaccgtaaaatggggataataacagtgtctatctcaccagtgtgctgggaggattcaatgagacatgcatccttaaaatacctctctgtgaagcaacttgggccacatgaacagagcattaacaacacacaaacacaaaatgtagtctaaatgccctggtggtctttcttgagccatgcaggcaccttcctctgcctccctatattcagaagtgataaggccatgagctaccctcatgatttggtttcctaaatctgtaaagtctgctttattagctagggtgcaagttagtatttggaacgttttttgaagccatgagtgtgctcttgatagtcattattattataagcagcagcttggctcctttcctgcagagcagaattatcttcaatcaaatgacctttctgtatactttctactttaaaggattaattgcgtcttccttcctgtctccctcttcacttctccagaacgctcagcccaaaaccaaactggagttgcctttgtccctaagtggtgtcgtggtaccaccacacccaaagcctggctcagaatgaattcagcacccattccttgctttttaaacctcaaaagttcccgactcagtgaaaggcttccattttgctatcctcttctctgtctgcattttactctgtaatttattgacatagaagaggcctcgtgcaggctttcattgcattagtccacttggaagtcttttctccaatccatttgacctcaagctgcttttttgctgctgctgcatgtaagctagactgatccagctcaccttatgctgcttttgaaggctgaaaagccctgtgaccaaatgtttagcaggctgttcagacagtggactgatggtttgatctaagtccgtttcctgccttacacacacctccccatcccccaaggcaaaggtggaaaacccagcaagttacataagttgttggagcagtccagatggctggctgctagcccaggcaaactcgctttggagcacttggggatgcctgcactggcaatgaaacatgggctcattttttaatgagaacaatcattttgttcagctgtatgaatcccagtagtggagtgagatcagggctgtgatcccctaaacatggctgctggcttccctctggggcaggacagggggtgtcttgtagtgggagggtgtcttgtcctactgtttggactttactaaacaggaaggagcgggcagggctgcagaacaggaattataccattgtacagcctggcagtcctgtggaattggctgaatagcggaaggaaggaatctgaaaaggaagggaaggatctcaccacccagtgtgagccaattccagcctcgctattttatctgcccagtgactgatcttagccttttgttgtatacctttcttcttgagaggttttgaaatggtatgcattccttagctttgaggcaccatgtggctgcagttagtcagactagctccaaatcacaagcttggattgttgaacctgttttttctggagtgggaggaagatggaccagaaattgatgtgaggccctgggatcttcagtccaggtggccatgggtatggcttacaggatggtcatctctaggtctgactttccctgtgtgttgtcctgatgtgaccaggaagcagctgtccaagttgcctgtccacctctgatagcacatgcagccttgcatctggggttggtggttatttcgtgcaggtgacctgagagctgcctgggattgctgtgcttgcccagcccgccacaaggggttgccctttgttggctggtggtgtggaggaggacaggtcccctgactgccggctactccagtgcatctgaaatggagacacctgtatgtctgtgatctctgagccttatcttcccttgctaccccacggtgaattagacctaaagatgctatgctggttcgttgtttttttttgagatggagtctcactctgtcacctgactggagtacagtggcgcaatctctgctcattgcaacctccacctcccgggttcaagcgaccctcctgcctcagccttgtgagtatctggaactacaggcatgtgccaccacacctggctaattttgtattattagtagagacaggtttacaccatgttggccaggctggtcttgaactcctgacctcaagtgatctgccctcctcggcctctcaaagtgctgggattacaggcgtgagcctccacgaccagcctggtcctttgtttctattgttttcaaaatggtctgagaaataggaaaaatcccaaagtctatagaacatagatataaaggtacagaaaagagaatgcagattttcatgcatttttacatcgaaaaaataaactatattttttgactgaaagaataacatagagtaacaaacagtagaaaatgtggaaaataactaaaaagatgaagaggaaaatgaatatcactcatcttagaaaacagtggttaatttatgatatttgtgttttcaactcttttctatcattatgtgtttatatatatctagacacacatctattcatatataaacaaaacatgcatccctttccaggtattgtactttaagtaggattttcatttaattttttatattttctcatgtctgtcagtttagcagtgagttttgctgcaaacaattgaaaatccaacaaacaatggcttaaagtaagttttaggcattaatatatatgataggccacatgggacaaatagggtggctctgtgaagccattaaagacccagcttcattgtgtctttttactcctccttagagtgaggaggatcctttaggatgtaggcttttgtcttccttgtaggctgctgcacctcctggcctcacatctgtggttcaggcagggagaaggaaggcaggaagaggaaggagtggtgtctatgtcagcaaaacaaaggtttgccagaaatcgcctgtatatatccacttatgtctcattgaccagaactgtgtcatattcctaagaggagtgtgtgttttcagctgggtaaaatcttgctcccacatatcaagggtctgattaaggaagaaaaggaaacagacattgtacagtccattagcagtagctgtcacacttgtttctaaatactattctacaaccagaagtgttgagtgacttagaaactcctttgatgaaagaagaaataatattaagaaaattgtgaacactttcctcagagaagtatataatttgtaacattttgtatataagaaacagatctgtgcattcatctctcagtgggctgctatacatgattcttttcttagcgtaatgcatagaagtagatttgcttgatgaacatatacagtcacacaccatataaagatgtttcagtcaatgacagaccacacataccactgtggtcccataagattataatggagctaaaaaattcctatctcttagtgctgttgtagccgtcatattactgcaacacatcattcatgtgtttgtggtgatgctggtgtaaacaaacctaccatgctctcagtcatacaaaagtagagcacatgcaatacttgataataaatgactgtgttactagtttatgtatttactacagtctgctttttattgttattttaaagtgtaccccttctacttattaaaaaaaaaagcggtcagacagccttaaacaagaccttcaggcggtattccagaagaatgcattgttatcatagacgacagctctatgtgtgttactgctcctgaagaccttacagtgggacaagatgtggaggtggaagacagtgatgtggatgatcctgaccctgtgtaggcctaggctaatgtttgtgtttgcgtcttggttttttaacaaaaatagcttaaaaaggaaaataataataataaatacaaaaaaaacttgttgaataaggaaaaaatacttttgtacagctgtacaatgtgtttgtgttttaagctaaatgttattacaagaatcaaaaagttaaaaaaaattaaaaaggttgtaaagttacagtaaactaaggttaatttattattgaagaagaacactttaaataactttagtgtagcctaagtgtacagtgtttataaagtctacagtattgtgcagtaatatcttaggccttcatgttcactcactaatcactcattgactctcccagagcaacttccagtcctgtaagctccattcatggtaagcactttatacaggaataccactttttatctttttttttttaatttaagttctagggtacatgtgcacaacgtgcaggtttgttacatatgtatacatgtgccatgttggtgtgctgcacccattaacttgtcatttacattaggtatatctcctaatgctatccctcccccctcccccccaccctacaacaggccctagtgtgtgatgttcctcaccctgtgtccaagtgttctcattgttcaattcccacctatgagtgagaacatgcagtgtttggttttctgtccttgcgatagtttgctgagaatgattgtttccagcttcatccatgtccctacaaaggacaccaactcatccttttttatggctgcatagtattccatggtgtatatgtgccacattttttaaatccagtctatcattgatgggcatttgggttggttccaagtctttgttattgtgaatagtgccgcaataaacatacgtgtgtatgtgtttttatagcagcatgatttataattcctttggtatatacccagtaatgggatggctgggtcaaatggtatttctagttctagatccttgaggaattgccacactgtcttccacaatagttgaactagtttacagtcccaccaacagcgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatattctttgcccactttttgatggggttgtttgatttttttcttgtaaatttgtttaagttctttgtagattctggatattagccctttgtcagatgggtagattgtaaaagttctctcccattctgtaggttgcctgctcactcttatgatagttctcttttgctgtgcagaagctctttaattagatcccatttgtcaattttggcttttgttgctattgcttttggtgttttagtcatgaaatccttgcccatgcctatgtcctgaatggtattggctaggttttcttctagggtttttatggatttaggtccaacatttaagtctttaatccatcttgaattaatgtttgtataaggtgtaaggaagggatccagtttcagctttctatatatggctagccagttttcccagcaccatttattaaatagggaatcctttccccattgcttgtttttctcaggtttgtcaaagatcagatggttgtagatgtgtggtattatttctgagggctctgttctgttcaattggtctgtatctctgttttggtaccagtaccatgctgtttggttactgtagctttgtggtatagtttgaaatcaggtagtgtgatgcctcaagctttgttcttttggcttaggattgttttggcaatgcggctcttttttggttccatatgaactttagggtagttttttccaattctgtgaagaaagtcattggtggggatggcattgaatctgtaaattaccttgggcggtatggccattttcacgatattgattcttcctatccatgagcatagaatgttcttccatttgtttgtgtcctcttttatttcgttgagcagtggtttgtagttctccttgaagaggtccttcacgtcccttgtaagttggattcctaggtattttattctctttgaagcaattgtgaatgggagttcactcatgatttggctctctgtttgcctgttattggtgtataggaatgcttgtgatttttgcacattgattttgtatcctgagactttgctgaagttgcttatcagcttaaggagattttgggctgagaggatggggttttctaaatatacaatcatgtcatctgcaaacagggacaatttgacttcctcttttcctaattcaataccttttatttctttctcctgcctgattgccctggccagaacttccaacactatgttgaatggagtggtgagagagggcatccctgtcttgtgccagttttcaaagggaatgcttccagtttttgcccattcagtatgatattggctgtgggtttgtcataaatagctcttattattttgagatatgtcccatcaatacctagtttattgagagtttttagcatgaagagctgttgaattttgtcaaaggctttttctgcatctattgagataatcatgtggtttttgtctttggttctgtttatatgctggattacatttattgatttgtgtgtattgaaccagccttgcatcccagggatgaagcccacttgatcgtggtagataagctttttgatgtgctgctggattcggtttgccagtattttattgaggattttagcattgatattcatcagggatattggcctaaaatacttttttgtatgtgtctctgccaggctttggtatcaggttgatgctggcctcataaaatgagttagggaggattccctctttttctattgattggaatggtttcagaaggaatggtaccacctcctctttgtacctctggtagaatttggctgtgaatccgtctgatcctggacgttttttggttggtaggctattattgcctcaatttcagagcctgttattggtctattcagggattcaacttcttcctggtttagtcttgggagggtgtatgtgtcgtggaatttatccatttcttctagattttctagtttatttgcatagaggtgtttatagtattctctgatggtagtttgtatttctgtgggattggtggtgatatcccctttatcattttttattgtgtctagtttattcttctctcttttcttctttattagtcttgctagtggtctatcaagtttgttgatcttttcaaaaaactagctgctggattcattgattttttgaagggttttttgtgtctctatttccttcagttctgctctgatcttagttatttcttgccttctgctagcttttgaatgtgtttgcttttgcttctctagttcttttaattatgatgttagggtgtcaattttagatctttccttctttctcttgtgggcgtttagtgctataagtttcactctacacacagctttaaatgtgtcccagagattctggtatgttgtgtctttgttctcattggtttcaaagaacatctttatttctgctttcatttcgttatgtacccagtagtcattcaggagcaggttgttcagtttccctgtagttgagcggttttgagtgagtttcttaatcctgagttctagtttgattgcattgtggtctgagagacagtttgttatcatttctgttcttttacatttgctgaggagtgctttacttccaactatgtggttaattttggaataagtgtcgtctggtgctgagaagaatgtatattctgttgatttggggtggagaattctgtaaatgtcttttaggtctgcttggtgcagagctgagttcaattcctggatatcctttttaactttctgcctcgttgatctgtctaatgttgacagtggtgtgttaaattctcccattattattgtgtgggagtgtaagtctctttgtaggtctctaaggacttgctttatgaatctgggtgctcctgtattgggtgcatatatatttaggataattagctcttcttgttgaattgatccctttaccattatgtaatggccttctttgtctcttttgatctttgttggtttaaagtctgttttatcagagactaggattgcaactcctgcttttttttgttttccatttgcttggtagatcttcctccatccctttattttgagcctatgtgatgggtctcctgaatacagcacactgatgggtcttgactcctttatccagtttgcaagtctgtgtcttttaattggagcatttagcccatttacatttaaggttaatattgttatgcatgaatttgatcctatcatgatgatgttagctggttattttgctcgttagttgatacagtttcttcctagcatcaatggtctttacaatttggcatgtttttgcagtggctggtattgttgcttccttcaggagctcttgtagggcaggcctggtggtgacaaaatctctcagcatttgcttgtctgtaaaagattttatttctccttcacttatgaagcttagtttggctggatatgaaattctgggttgaaaattcttttctttaagaatgttgaatattggcccccactcttctgacttgtagagtttctgccgagagatccgctgttagtctgacgggcttccctttgtggataacccgacctttctctctggctgcccttagcattttttccttcatttcagctttggtgaatctgacaattatgtgtcttggagtcgcttttctcgagcagtatctttgtggctttctctgtatttcctgaatttgaatgttggcctgcctttctaggttggggaagttctcctggataatatcctgcagagtgttttccagcttggttccattctccccatcactttcaggtacaccaatcagatgtagatttggtcttttcacatagtcccacatttcttggaggatttgttcgtttctttttactcttttttctctaaacttctcttctcgcttcatttcattcatttgatcttcaatcactgataccctttcttccacttgatcaaatcggctactgaagcttgtgattgcgtcatgtagttcttgtgccgtggttttcagctccatccggtcatttaaggtcttctctacacagtttattctagttagctatttgtctaatcttttttcaaggtttttagcttctttgtgatgggttcgagcatcctcctttaactcagagaagtttattcttaccgatcatctcaagccttcttctctcaacttgtcaaagtcattctccgtctagctttgttccactgctggtgaggagctgcattccttgggaggagaagagatgctctgatttttagaattttcagcttttctgctctggtttctccccatctttgtggttttatctacttttggtctttgatgatggtgacgtacagatggggttttggtgtggatgtcctttctgtttgttagttttccttctaacagttaggactctcagctgcaggtctgttggggttcgctggaggtccactccagaccctgtttgcctgagtatcaccagtggaggctgcagaacagcaaatattgcagaacagcaaatgttgcttcctgatccttcctctggaagcttcatctcagaggggcatctggctgtatcagttgtcagtcggcccctactgagtggtgtctcccagttaggctactcgggggtcagggacccacttgaggaggcagtctgtccattctcagatctcaaactccgtgttgggagaaccactactctcttcaaagctgtcagatagggatgtttaagtctgcagaagtttctgctgcctttttttcagctattccctgcccccagaggtggagtctacaaaggcaggcaggcatccttgtgctgcggtgggctccacccagttcgagcttcctggccgctttgtttacctactcaagcctcagcaaaggtggatgcccctcccccagccttgctgccaccttgcagttcgatctcagactgctgtgctagtggtgagcaaggctccgtgggcgtgggaccctctgagccaggtgcaggatataatctcctggtgtgccgtttgctaagacctttggaaaagcgcagtattagggtgggagtgtctcgattttccaggtaccatctgtcacagcttcccttggccaggaaagggaattccctgtccccttgcacttcccaggtaaggtgatgccttgccctgcttaggctcacactccatgggctgcacccactgtccaacaagccccactgagatgaacccactacctcagctggaaatgccgaaatcacctgtcttctgcgtcactcacactgggagctgtagactggagctgttcctatttggccatcttggaacctcccccactttttatctttataccatatttttactgtacgttttctatgtttagatatgtttagatacagaaatactattgtgtgtcagttgcctacagtattcagtatggtaacatgctgtataggtttatctcctaggaacaataggctacaccatatagcctagttgtgtagtaggctataccatctaggtttgtgtaagtgcactctatgatgtttgtagggcaacaaaattgcctaacaacgcatttctcagaacatatccctgtcattaagtgaggcatgactgtatatttatctttgaagcttgctcttcatgaagactgtgccaatttatacttccatgagttgcatatgggaatatccatttccctgagcctacatctatactagttgctaccaaagtttaagaaaattcttaactttttcaaaaagtaaaacatattatcattgttataattaggactttttttttgtttttgaatattccctatggttattgaattctttttctccttttgcagttagtttatcctttgtacattttttttcttttggtgtattcacctttgagtgttaattactctttctgtattaaggctgtgagatactttatgcatcctatctttgtttgaatggattcccataataagataaatatttacctgagatttgttttggcatcaagatgtaaggtgaagaccaaccttgattttattcctccaaatgatttttattatcttaacactattgaataattaactatttcacaactgattcgaaaggctccaagatgatttaagaagtgcagcagtgattttttatttatttattttattttattttttatttttttttttgagagggagtcttgccctgtcacctaggctggagtgcagtggcgtaatctctgctcactgcaacctcctgggttcacgtcattctcccgcctcagcctcccaagtagctgggactacaggtacccgccaccatgcccggctaattttttgtatatttagtagagaaggggtttcaccatgttagccaggatggtctcgatctcctgacctcgtgatccgcctgcctcgcctcccaaagtgctagcattacaggcatgagtcaccacgcctggccagtagtgattttttaaagcacatagggtatgcaaagatcagctgccatacagagaccatatgaattgtcatccaagacattgttattttcatagctgacactgctgggttctgtgcctcgcctgatgcggactgcttaaccttcttggggtgagcacaactgtaagtgagcaatttaatacttaaaatgctgctagacagatggcaatttactctttccatatttgaagagcttcctgagtcctaagttctttatttttatttttattttttttgagatggagtctcactctttcgcccaggctggagtgcagtggcgggatctcggctcactgcaacctccacctcccaggttcaagcaattctcctgcctcagcttcctgagtagctgggttacaggtgcccaccaccatgcccgggtaatttttgtgtggttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccaggatggtctcgatctcctgacctcatgatccacctgcctcggcctcccaaagtgctgggattgcaggtgtgagccaccacgcccggcccaatttttgtgtttttaataaagatggggtttcaccatgttggccaggctggtctcgaattcctgacctcaggtgatccacctaccttggcttcccaaagtgctgggattataggtgtgagccaccatgcccagccctaaattcatttttaattacaaactagattgttgattttttttcttttttttgagacagggcctcgctctgtcacccagactggagtgccatggcatcatgatcacagcacattgcagccccaacctcttggggtcaagctatcctactgcttcagccttcctcctaagtagctaggactacaggtgcatgccatcatgcccagctaatttctttttcttttcttttcttttctttttttaagtagaggctaggactccttatgttgcccagatcagtctcaaattcctgggcgcatgtgatcctcccacctcacttcccaaagtgctgggattataggcaagagccactttttgaagttaatgttaactgaatctaagatgtgcattgacaacattttagatggccttggttcctcatgtcattcaaccagtatttattaaatgcctgctatgtgcaaggccctctggtctaccaggataaatttgtcaccttgcatttcagagtgaaaaacatcagtgtgaggtgtgaacatagtgctattgaaatagaacagatgattttagactgagggagttgaaggcagcttcatagaggagcacgtataggtagggcattgaaggatgttcacgggcagagatgcatagaagggcttccttggcaagaaatatggcaacacagattcttagaaatcatgggacagatgaggaaacagctagtagttgcatgtagatggtcatgaggtttgggaagggaaagtagaaaagtaaggtaggaaatgttggggccagcttatcagaggcctcatgtagaaatctggacattatgctgttaaggggtgacgcaaccataaaggatttgagcagaagtgatttcagagctgtggccacatgaagggtatgcagtttttgggaaggcagagagtaaccattgtgaaggcattccaagcaggaggtgctgaactcccagatgggactgttgggactgaagagaaagatacaatcatgctggaagcagaatccagttattgtcacctgattagatatgggagtgaaaagacaggacttaggacagatcttaggtctagccactgagataaaagtgatgccattaaccaagataatgattattggctgctgtttactgagcatttactctgtgccatgcatagtgccagctgctctgctgctgctaccttctactttatgtggtatgctctccattttatagatggggtaatgaggcacagagaaatgtcacaatgagaaaataacagttgctagatgaaaataggtttgacaaaaacaaacaatgggggaaggattccctatttaataaatggtgttgggaaaactggctagccatatggagaaaactgaaacttacaccttatacaaaaattaactccagatggattaaagacttaaacgtaagacctaagacaataaaaaccctagaagaaaacctaggcaacaccattcaggacataggcatgggcaaagacttcatgactaaaacaccaaaaacaattgcaacaaaaagcaaaattggcaaatgggatctaattaaactaaagagctcctgcacagcaaaagaaactatcactagcgtgaacaggcaacctacagaaagggagaaaatgtttgcaatctatccatctgacaaagggctaatacctagaatctacaaggaacttaaacaaatttacaagaaaaaaacaaccccatcaaaaagtggatgaaggatatggacacttttcaaaagaagacaaaatttatgctgccaacaaacatatataaaaaaagctcatcatcactggtcattagagaaatgcaaatcaaaaccacagtgagataccatctcatgccagttagaatggcaatcattaaaaagtcaggaaataacagatgccggaaaggatgtggagaaataggaacgcttttacactgttggtgggagtgtaaattagttcaaccgttgtggaagacagtgtggtgattcttcaaggatctagaaccagaaataccatttgacccagcaatcccattactgggtgtatatccaaaggattacaaatcattctactataaagacacatgcacacatatgtttattgaggcactattcacaataacaaagacttggaaccaatccaaatgctcatcaatgatagactggatgaagaaaatatggcacatatacaccatggaatactatgcagccataaaaaagaatgcattcatgtcctttgtagggacatggttgaagctggaaactatcattctcagcaaagtaacacaggaacagaaaaccaaacactgcatgttctcacttataagttgtgttctcacaactcccactcccataagtgggagctgaacaatgagaacacatgggcacagggagggaacataacataccggggcctactggggggtggggagcaagtggagggatagcattaggagaaatacctaatgtaggtgacgggttgacgggtgcagcaaaccgacatggcacatgtatacctatgtaacaaacctgcactttctgcacatgtatcccagaacttaaagtataataaaaaatgaaaataggtttgtggctgggtgcagtggctcacacctgtaatcccagcactttgaaaggccgaggtgggcagatcacctgtcagaagtttgagaccagcctgattaacatggtgaaactctgtctctactaaaaatacacaaaaattagctgggtttggtggcatgtgcctgtaatcccagctacttaggaggctgaggcaggagaattgcttgaacctgggaggtggaggttgcagtgagccaagatcacgccactgcactccaacctgggtgacagagcaagactctgtcttgaaaattaaaaaaagaagaaaataggtttttgtgtgcatatgtgtgtatgtgtttctgttcaatggccttgctgtcacctaactaaaagcaagtactaatttagtggcttgttcacaggttttaaggtgttacccctcctattgtcttgagaaacccttcttggtggttgtaggaaggataggtgctagatttgaggttaggggaaattcctagatgaagatggccagcaaacagttagaaatggaggtctgctccaaagaaaactggagggaggttggggttgcagatttagaggtggggcaccatctgcatggaggcattgttgcagctatgggaatggatgaaatttctaattgtggcttatagaaagagagagagagagatgagtaaagaggtccaaggaggagcttagggaatttttagagtaggctatggaactctcataatgtactgctggtgggagtcttaattagtacaaccattcaaaacctagtaaagttgaatatatacatatcctacaacagactgttgaaactactgaactctattgtagcacaaaaacagctatggacaagtaagtgaatgagcatagctgttttccaaaaaactttatatatatgcatttacatatattcatatatgtatattgtatgtgcatgtatatatatatacacacacgtatatatcctcattattcatggattccatatttgtgaattcatctactcaccaaaatttatttgtaaccctaaagtcaatacttgcagagttttcacaatcatttgtaggcatgggtagagtggtgaaacattttgatcatccactgtgcatgttcactgatggtgttgcacaggccctactctaccttcttgtttcagctgtcatactgtaaacaaatatcattttcctttttcttttcttgaggggttggtggggacagggttttgctctgtcacccaggctggagggcagtggctccatcatagctcattgcagcctcgatcccttgggctcaagtgatcctcctgcctcagcctcccaggtagctgggactacaggtgcatgccacccatgcctggctgatttttttttttttttttttttagtagagacaaggtctcaccatgttgcccaggctggtctcaaactcctgatcccaagcagtcctcctgccttgcctcctgaagtgctgggattagaggtgggagatactgcacctagcccaataaatgcccttttcacactccatttagtgctactttttttttttttcattttgtggtttcttttggtgattttgctaaagtggtccccagatgtaatgctgatatcgtgtctaagtgaaagaagtttgtgatgtgccttgtggcataatatgaaaatacttgtgagatgaactttgttcaagcataaattataatgcagatggatatgagctcagtgaaaacaattcagcaacagaaattgaataaggtgatgtctttggacagaaatacacataaaataggattatatattgattggttgatgaaaatggaaccagaagcttgcaggaacctaactgtgtttctcctagaagcaatggtttagtgtttgctaactcagtgtttgttgctgtgttataaaatgtaactcctgcaaataacaaaaattgactctatatgtatgtgtgtatatatgcacttatatagatttcatatttatatttatgattgtatttgtatatttatatattccttttatgttaagattagtacagggcagaggaacctgtggagagctgtggagcagggctgagtagtagggccaaggagaggtggacatttaaaggacacaggtggtcagctatatcaagcacgataggaaaggacccagaagcagcctttggatttgtgcgttcatctgtcatgctctcaagacagacatgccctaatctctcccatcctccactctggggaggggaccctactgggcttagtccacttggttgccttggctgctggctgtgtttgtaaatgtatgttggttgctcaggtccggtgtgcttttgttctctctaaagaagaagcaagagaggcttggctaggcactgtgagcttttgatgtgaacatactaacaacctgtttcatccaggtcaactttaaaccacattgttcagtgagcattgttcagtgagctgtgatcgagccactgccctacagcctgggtgacagagcaagaccctgtttccccaccccctaaaaaaagaacaaaaaaaaagaaaaaggaaaagaacatttgtttacagtatgagaactgaaacaagaaggcagaatatggcctgtgcaacacgagacggtgagctagtctgatcagcagctttccaacctgctgtccctttcctttccagttcctactccctccaacatttgcaggaccttattcctagtcaactgtcagcagatcccaattttgctgtttgctggtaagatttgagatgttaccatcctaatgtatatatgaaattattaaagtgcatagagagcccttcaggacctaaaggggttcattcatgatggtgaaatattaaaaattatagggactaagagtatggcatttcaaagctggtttgtttcaggccccccttttgatgccttaggaaattaagatacagagagacgaagaggtttgatccgggtcccacagtaaggcagtgactgattagggccactatacttgttagctcccagggctccctgcccattcaaatcatagcttatagatggccatgtagttaggtgagtcccctgaaaattagcctcgagcatatagatctttacaatgctcagcacacttacctgcttgtccttttagctgagggggtaggaggcagatctcagttttattaatatagtgagggttcccaaaggatatatgaatcaattttataatatgagaactgttttgggggaaggagaaagaggagagtgaggcgggttaaggctactttttcctaaatttgtatttaaaaccagtgagtttcaaatctaggttatgactcagaagcacctctaaataatgtttataaactaggctaactagggggattaattcaaggtgaatttttctttctggctgctgtgggggttaaaaaaatatcaaggtaggttataaacataaaatctaaaactataaagccttcagaagaaaacataggacaaaatctatgcgatctgggattggcaaaagttatgtaataggacatagaaagtgatagccctacaaaaacatgaaaaaaaattgacttgatttaaattaaaagctagtgcttatcaaaagacaccattaagaaatcaactggcaagctgtagaataagaggacatattcgcaaaccatatatctgacaaaggacatatccagaatgtatagagaacccataaaactcagtaataaaaagaagaacctaactaaaagacagaaaaaagacttgaagaaacgccggacaaaagatggcccaatacatacatgaaaaagtatacatcatggatcatcagaaaaatgcagtttgagactataataagatactactacgcatacccattagaacagctaaaagtagaagattgacaacacaatgaaaagattggcaagtgctggtgaggatgtgaagcaacccaaactctcatacattattggtgggggtgtaagtaaaatggcacaactactgtcgacaaaggcttggaagttttctgtttaataacaaaaaactctactgtagaatccagcagttccactcctaggtatttacctaagagaagtgaaaacacatgtcttcaaaaagatttgtacaaaaacctttggaccagctttatgatagctacagacagggaaccacctaggtgtccatcaacagaggaattgataaaactatggtatattcaaacattaaatttcaactcagaagtaaaaaggactaaaggtattggttcacaccacaacatggatgaatattaaaaattttatgctgagtgcaatcccattactgggtatataccaaaaggattataaatcatataaatcattctataaagacacatgtacacgtatgtttattgcagcactatttacaatagcaaagacttggaaccaattcaaatgcccatcaatgataggctggataaagaaaatggggcacatatacaccatggaatactatgcagccataaaaaagaatgaggtcatgtcctttgcagggacatggataaagctggaagccatcattctcagcagactaacataggaacaaaaaaccaaatactacatgttctcactcataagtgggagttgaacagtgagaacacatggacacagggaggggaacatcacacaccagggcctgttgggggatgggaggcaaggggagggagagcattaggacaaatacctaatgcatgcagggcttaaaatctagatgacgggtggataggtgcagcaaactaacatggcacatgtatacctatgtaacaaacctgcacgttctgcacatgtatcccagaacttaaaaaaaaaaatttatgctgagtgaaacagagtagctataaaagaatatatatgatgtaagtctgtttgtatagtgatctagaataagcaaaactaattgggggtgcaaaacagaacagtggttgccagtgcatggggtgtgtgaggggtgggagtaagatggaaggaggtctgagggaactatctgagctgatgtttctatcttgatagaggtttagcttacatgggtatatgaaattgtcacaattcatgattggcatgcttaagaattatgtattttattgtatgtacattttacatttaaaaatggacaaatattgaactttagatgatatgtgttctgaaatgtttaaaagtgctgatatctgcaactcctcttaaaatttattaaaaagcaagatggactgatggatgatagaaagatggctagatatgtgataaggcaaatatagcaaaatatgaacaactgtagaatggaggtgatgggtatatgcatgtttactgtctcttctttcatcttttctgtatgtttgagaatttttataagggtatgtggattgggagtaaatgtgctgttctggctggcctaagtcacactattcctggagtcggaagtggagtggattctgcctgtgatggaggtgggggacccacacagagtgcagaattctagaatctacagttccattttagaaacctcattctgctccttgggagttgtgggagaatactgagattctccatgtgatcacagtgctggggataccctttactgccagctcaaagcaacagaataaaagagtgaatattctcagaatctcttgttgcatgcatacgagttggcatcaagattatttttggatttggggtaggaaactcagcttcgagtcatagatctagaaatgcagtcctctgaactgacagctgtttgtggcaagggaagaagtcacctttccctgtgtctgtgttggataacataacattcaccttctgcctctccaaggggcattgtggggatgaaggcgatcatgaacgtgctttgagtttgtctgactgcatcagcctcgagttgcaatgaagacagctatgcatgccactgcccggaacctcctggaagaagggactggaggttgaaaggagctgcatagtgctgtgactcactctctgcccgttgtttctcctgggctgggacccacttgggcagcagaagagccttatgagctcctactttggtgtgctgcataccatcccgaggaatttctcatatgcagttttctaaagcacaaaagagcaaggttctctcttctgctaacagagctgtataactatttccaaaaacactgggttgggggttgggggttgggggttggggaggggagcacataaagacattctctgtttagtatttcagtttcttttgggaggatgggaggtggtctctcctctcaccatgaaaacggcatgctgacagatgagtgggttcacatccactttttaatgttgcatcagcctgaagccaggaagtgctagagccgtaagactcctcacactgtgacctggccacatcctacatacatgtcagcttgcacgccatctacttaactgtcatgcacttgatagcaaatgagcttttgccctttctgctgcctttaaaaatttcctgaaacacttttctgacttgtacattacttagatttctttcttcctcttttgcatccagtttttgtttatgttggctgtgactccaatcttcggttgaaagctagggaagttgcttataaaggttttcaggattgctgaatatgaaatgcaaggaaattgcataacattgcagcatttcctcctcttgttgcttgcttgttacccaaaatacagtagttccttctagaagcttgaagaaatttggcagatcctaccctctgatggtctattgtggtctagagagtcagtgttatcctgatttgaggttgaatttttcttaaggtcaaacaacaaagcttcctgaattataactatggcaacagtgtttatgtaacacacaaatcaaagtcacggggtagcggaggagaagcacccacaacaatcagtgttaataatcccagaacagttagcctgtgcctaattcaccagaaccaaaaacaagttaaaataaatggcctactccttcactggttattggggtgtgacctaccacctacatgctccaggaggagctgtttcaccttttctcttgaaactatatcagcttaatttgaaatttctcacagagaactgcggtaagtgccagtgacactcaaaatgtgaaagcattgccataaggataatttgctcatcaaggtcatcatgacctgcctctgacctgcagagaaagacccagacgaaggaatgcgcatccttaagccccttgtcctttaatgaggaataatttcttggacactgaatatatgcaaacatttagatgccgcatagatcacttcccctaaaccctgccccatagaaatgtaaaattaaccttgattggagattggaaatgataagaatgaaaaattttatttggaagtattaaattctgtagaatatagactgtaggagcagtaagagatcaaagaaacgagagattaaggttgtctgcagccatcaagtaagttaggaaatatttgtggagtaaggaaaagggaaataacgtttttgagcacctccagtccctgtgataactattttaaattctgttaatactctcataagtattattacttagctctactttgcaatgagaaagcagactcggaaatgttgaatgattatctaagggcgcatagttcaaaagtggtagaaccaggtgacaaaataaaaacttcatccagattaaatttaaaggagtttaattgagctatgaacaatttgcgaattgggcagcccccagaatcaccacagattcagagagactccagggatgcctcgtggtcagaacaaatttatagacaaaaaaaaaaaaaaaaggaaagtgacgtacggaaatcagaagtaaggtacaaaaacaactggattggttacagcttggtgtttgccttatttgaacatagtttgaacactcatcagtgtataagtggttgaggtatggctgctgggattggccaagactcagctgttgttataggtaaattttcctaagttaggttttcaaccttgtctacctattaagttaggttacagttagtccacaaggactcagatataggagcatggagtccttctcaggccatatttagtttgctttaacacagaccttaatgccaagtttccaaagccacagcatgctccatccaccacttgactcaacttcatccaaatccatttctccctgttttggaatctgtccagggcctataccagtgaaagggttaggctgacaatgattaaaccccaaatgcagcgaaattaatcagcccaggaatgcccgggatgccttctagacagaagggggcttaggtctgtgtgtaagaggatgctgggtcagcctcctgctttagtggaccatgaagagctcctgtcagttatttatgttcagctgaaatctgccttcctggggactccaccctgaccttcatctctgttcagcacaataagatttcccctttgtcacatcactgccctttgagaatctgaagactggtattgtgatgttttgaagccttctcttctccaaccaacactgtggtttagggaaacacatcttgcagagcaagtgagcagagccagagggtggagccaacaagaaccaggatatagccaatgtcaaggtctaggtgagaaggcaaaaacaatctgaccttgggcaatagaagaagaagtggggatgaggaataggttcaagacatatgaaagtaatagaagtgatacaactaggaactgattggatatgtgaggtagaaggaatgggaaattcaaggatgacagcacagtttctcgttcaactttgttgcacatttttctccttcactctagagttccctataaagcacaagtaggcttttctgtcatgcacttaaaaaaaaaattaccacaacccttgtctgtgagcaacagaaacacaactaaaaaataaaaagtatgttattgatatactatagaaagagcagggatgagcttctgatatgttaagataaaagggctcaaatgataccatcagaatcccatgtcccttcattcatggccctgcatttctttgtttgaccttttctgctcaaggctttgcctgtgtggtagccgaagttggcctcaaaagcttcaggtatgcatcctgttttcctagcaacacaaggcctcatttcccatagttgtaataaaaaatgagtgagtgtcatcggctgagtttggcttgggccaatcatatgtgcagtaggatgcatagtctggatcacatgcaacaaacctgaagatggagttgggatcagccccacccaaaccatatgaacttgccttggcagggaggtggctccccaaggaaaatgagggtggtatccctggaaaaagaggggcatggatgttgaacagtagtattcacgggtgtccagagcacttttttcccccaatgttactgaggaataatactaagagataagttgcttatatccacaaggtacaaagcaacaggcaatgcttgaactaatggaaaagaaagtttatttttctattcatcatcattgttgtaatcatgttttgaacagcaagcagcagtttttattcaccagcaagaacgcttccggggctgttaaaagactctgtcttttggatggctgtaggagcacagccatttggtcactttttattgggccattttctaagagactgcctagtcttgagatgcctctgattgtgtaggggaagggactcggcaccaacaggtacagaacccctttcttagcccttatttcagaactccccagtggtaccataggcttcaaaactattagaagcattcgttgtcacctggtggatgtagagctaacacacaggggtggaacatagaaaataaatggctatgtgagggattttgatagccttgagttaagccaaataagataaatctgtatcctgttttctcttaggaaggcctgaattgtctgtttccactcccttgtaagaaagattcatagagaatttgccaggtgttggggagaacaaagcggtcacctggacacctgagcacacatctagctttccttttctgtctggccaatgcattgtcctcaccaactccacctttagtgttttttctgttttttttttttttttttttaattgcagtttctctcttatgctctctatttatccaatcagtactttctgagtggctggctatgtgctagttactgaaccccctttatgtataattctacagggtaagagcaaggtcttgacattggttcaggaatcggtctttgggaagtgccatcaactatatttttattggtttcacatttgagggagcctccctaagacagcaagtacaacagtggtagcagtggaaagggaaagcctggcagagtattgtcagctgagaaacagaaaagtagcaacagccatcttatttttgctccactgagcacatttcaccactcagaccatggtgatgagagtcacatttctgatgggaggaggaggaagaaccaatagctggctccctggctctgaccccttgagttgagacacatccttatttactccaggctattcatgcttcagattcaaacaattccttcccaaaagcttttccaagtgtggcctgtggcccatgggtgaaaagagaagtcctgatctagaaaaatcatgtccattcatgggtggcattccacagactaagggtgtcttacagtaacttctcaggggtgttattaaaagttcctaagcctgggcacagtggctcatgcctgtaatcctagcactttgggaggccgaggcgggtggattgcctgagctcaggagttcggtgaaaccccatctctactaaaatacaaaaaattagccaggtgtggcctgtagtcccagctgctcaggagacaggtgaatcgcttgaacccaggaggcagaagttgcagtgagccgagatcgcaccactgcactccagcctggttgacagcaagactctgtctccgaaaaaaaaaaaaaaaaaaaaagttcctaaatttagcctgtattagtgtttgccgagcattctaatgtgctcaactgagaaatctgccacagagtctttggcaaccctggccagttctctctgtatgtgctgataggttttaggagggttgttttttgggcatcctaaaatgtctcaagctggttgtggtttttaattactgccacacttgtattaattggaagtttgtagaattcctgttatgcttaaattgggtggaaattttgttattacataatggttgcattgttgccattttaattactgcttagcctcttttgagttctttgttaattggcaggctgtttttcctctggaaagcaggactgggtggagaagttgtatgaagttgtggctgagtacagactctactgtgctctgcctaaatcgaatcctggctctgtaatttgctagtatgtaacctttggaaagttaattaacccatatgatgctatgaaatagaggcaggtgtagtaccccataggcttgaggatgaaataaaatcattcgtttaaacgcttagtatggtgtttggcacataattgatagtgaaaaagtggttggtggcaggtggctatttttatgtttgattgctgttttaaaaaagattaagaaccattgatttaaacgttgaccttagattgtctcctttcctttcccttcatctcttaattagtttcagttggttatattacattgccaacaagaccaatgccacagggtccctcaaatgacatttcccatccttagccatttatcccataggggatacatttccatcaccagaagaggctttttgttttgtttttttaaacacaaagtgggaagagaaggaaggaggaaaatgacagtgatgaagatgaaagttaatccttatagaatgttcaataggccatagaatttacattcagtgctgtgttgaatattgtatatctatgattccatttaattattacaacaatcctaagtggtggagagtgttactatccccctttttcagatggcaagactgaggtctagggatgataactgatgtgcatgttagccaataaacagtaaagttggactttgaacctaagcagtagattactacaaatctgtcgccactgacagacacaattcaaaagagcaagctgttttgattctagtgatggtggacccattttgtcatgcagaggagatgagatgatattcgatggtgtagaaccagcctgttgttttaagatgttgacacattgccttattcagtgtgtctccacattggtacatcaggggaacagccaggtgggaggagacttggagaaaacctcaggggatcatagagtttggatgtgcatttgggtaaagatggtgcagtttagagaggagcatcagttttaaacaaatttccttatgaacctatttccccagcatctttattttgtccagattttgatccaaagtgtggtatggctaagctctaatgcagctgtgtgtgaaagggaaaagttagattgttttgtcaaatttttgctttacttatgtctttaatatctacatttgaaaaacaagcctctctgttttctcagtatggcttggataatggtaataaaggtactcatagaaaaattctgggaatccagatgactctgtgtattctctgttaattctgtagggacatgtaaactgaactggctcagcagtgaacagaatttattgcaaaatcacatcttggtgcagaggaagcatatgaaggctttcctcgccctcctttgatttattaaattgtactttcattgcagcttctgggtaaggactcagaattgcagtgccctgtgatttgtatcaaagagctactctccccccctggtgtttatcgtcaggatcgaaccctgtggttcagagagaatatgaagtgttacttctatactagatgccagctggttgcatgggttggtggtaaatactccaggctagaatcagaaggctgttcccagtttcattttctttctgactcagggcaagttcttccttccggtgattcacctgcccagctgcccacaacatctcacctttatcatcgtcagcatcatcatcgtcgtcattgtcatcatcgtcatcacaatgacttattgatcatgtggttagtggttaagtgcttgggctctggagacagaccgtgggagttcctgtctggactctgcccatttccagctgtctgaccttggccatgtgacctaacttctctaatgcctcagttttctcatctctgtgaaaggaataattaggctggtatgagaaccgaataagacaatgcacacagaatgcttggcatgatgtctggcacatggcaggggttttgtcatcatcatcattattaatttctatctgtcataattattctttaatgattcttagatggaccgtgataagataaagtaaacacatgtaatttctcttcttcagaagcatatacttgaaaatagatacttgttggcacggatctttaacaaatcttcatatacaatggtcagtagaaactagactatacctacatcaaagtatagaaacccaaaggagataatgttcccaagttttagagtactcagatagagcttagcttcagttgggttgttgaaggtgcattaactgtttcagtcttctgaggagccacagatcaggcatttagtgccccttgtccgcttgggttgctcctggagagttgagttctattgtattaaggtagatgctctcaagaggcttacctgaaagcatataaatttgagattgctaatcataagacaaagctatggtcaaagtgatctttcaggacattgctcttgcctctgaacctcagtctgatgctagtgggcaactgtgagatctgtagaagaaggatagcccagagcagactgaccatttctaaagggtgaattgcatgctctttgcttctgtcagtatagaaggtatttatgaaccataataccaaccactggagtgacttggtagtgatatacatttgccactgcctagaaaggtaaaagggtattggaacatccttttagaggcaagatagaatagtacaccactgaccagctctgtgtccttagacaaactgtgtaaccactctgggtctcaggttccatatctctaaaatgtgaataatactagacctcatccatatggtggttgcaaggattagatgttgccatgtgtggtgcttggtaagtgctaggtaaacaaaaccattcctgcttagtgctgtgactgagccaccatctggttgcttccccaccctgggccttctttgttgggccctgtagtcacaaagtcctggtaagcaggatttgttagcttcatttcaaaactcattctctttggctcattaacccaaaccagacagagattaacagcctggcctcagaggagcaggtgagtacatgtttctggtgcctttgactcattgattatccttctccaattcagggaatgcttgggtgttccaggaaggggtctcccgagacccaggaaaccttgaaagagagtaatttggcacaaattcatctcctaatgaaggagggctggaagtcctgcattttactattccttctggattttgccagctataaatagaagcaaggttcccttggatagaatgtttgaatttactaggagaaatgcagggatcaaggatggctgaagaaaaatacttgccaaagtgtggtcttctcttctgcacttcccttgcccaactttccaaggttagtgaatgccggtcagcatggattgctggtcctagctattacactgtgacccatttcactcacaggtcacaaggctctgcaggatcggattgctgcccctctgccctatccttatctcctacccctctctgcattgcactgattgctaatcacactggccttcttccttcaaatgcaatgacttttcaccttccaaggacctgtactttctgttggcactagcccccacgtcttcccaaggaggtacccctcatcattcaggcctggcgcaaacgtcatctcttccgagaggcatttcctcgcctaaagtccacaataaacccccgctttttttttttttttttttttttactttctccaatgtacttatcaatatttgaagtaatcataaatgtgcatctgtttatttctgttttcttcagtaattggaaagttttatgagagcagagattacagatgtctagttcatctgtatccccagcacctggaacgttgcctgaccattataagcacacagtaaatatttgttaaatacatggataagtaaacgaattgcaagcaacatgggaaattattatttaggaggtcttcaaacttttcaaagccgctatgcccttcttcaatagccacatgagtaaaatggataaaagccaagggaggggtcatttggtcttagcttctctccaacccctttgtttgtgcaggtgctgtgtggctcaatttggaaaccatgatctagctcaagttcatttatatagatgataaagatgctgctgagggagagtgggccactgtgtttcctcttttaagtagaaattacacaacctctatgtcagcctccacctagacttcgtggtgacttttgccctcccctcaaattccatgaatgttaagcatttcttttctcagtagtagagtccaaagcgcttgcattgtgttgtgctgtttcagtatatttctttggcacagtctcatttgatgttcacatcagctctggctgagttagtcagaaaaacctatcatcgcccacattttatagatgaagaaattaaagttcagcaagatgaagttaccaatggggaagcccaggccaggatcaaaatcttttgactccttatctctagagcgtttaggtatatgcattgatgccttttcattcattagacaatcctctttaagtacagaaacctgttctctttatactcatctttctgacctttaataagtggcctggtagctttagttttctttagaaaattaataataaaatgggatgatttgttatatttagagcttgataattcaaagaccttcttgggcgactccttcagtttatggatgaggcaatagatgcccagagaggctaagagacccagtgacacaaagcagctgaagggccaagtgggacctcttgaccagccattctccgtcatatttcttaagtgaaaaatccctttctggatttaatggttcttttcagaggtagttgccttggtttctttaggggttaaataagtggttctcaactgagagtagccattagagtcactggagggatatatttatatatatacatacatatatatatatatatatatatattatgatcaggttcaccttatgcctttctatacctacagaaccttaatgaccaaagaagggcttgggttctatgattttttttcatttatttatttaagacggagtcttgctctgttgcccaggctgaagtgcagtggcgtgatctcggctcactgcaagctcgacctcctgggttcatgccattctcctgcctcagcctcccaagtagctgggactacaggcgcccgccaccatgcctggctaattttttgtgttttttagtagagacggagtttcaccatgttagccaggatggtctcgatctcctgacctcatgatccacccgcctgggcctcccaaagtgctgggattccaggcatgagccactgtgcccggccgatttttttcttttctaaagtagaggtttcatcttgtttaattatgacagcatatcagagatgggcaaactgtgatccaaagactgaatccagcccaccaccttcttttgtagagcccataagccaagcatcatatttacaaacaaatatctataattgactttataaggaatactaactttgagtaccaattaagctaaatatcaacctctcttaaaaaaaacttattcttctgattagtaggcttgcatttcagaaaatcatactcaaatattattagtttttaaattttgtcaaaaaatgtatgaaaatttactttctatcttgttgtagaagtacctacataatgtcattgattttgcctcttggcccacaaagcataaaatgttaatgtctgacccgttgcaggaaaaacttgctgacccttgcaatatgtcattgtctcttttatattgggcattttctttttctttattggggtactttccctttttgtgatttacattatttaaggggtttctatggaaaatatatattctccttataacattcaaatttctagaagtatgtagagtaaaaagtaacagttcccactccccggtattaacagtcaacagtttttgatgtaaaggtcctgactttgccactaactagctgtgagacattagttaacccctctaggcttcatattctccatctgtgaaacagtgataataacagctcctgcccaacagaattgtcatgttgatgatttcagatcattcatgtgaaatgcttagcacattgcctggtgcgcagttcatgcttaatgatttgtaactaattttaatttttttctcttttctatttatgtacgcatatacatttacttgctttcttaaaaagagggaatttttttttacacaataaagttgcacagatgattctgatgcacacacacttaagaacagctaaagtaaatactgagaagtagataattattgaatgggttcatgtttgggagccagaaattaccttccacttcatggtgcaaactagggaaaatgaggaagataatggttttctacagtgaacctatagggtggcataaaatgcacataagtgaatttttatttttattttccaggtctacaactcgaacaaagacagccagagtgaagggagtaagtacgatgcttgggtaaccttctacagccagggttgggagtaggctttgagaagttgctactccaggtgtgaaccaccaggcggtgctgtgggcgtgttgggttggctccagttcccgagtgcagtgggacatgcctccaccccaactttccgccagtgactccagagggacggtaagtgagcctggctggcaaggctgtagtgtagtgacaccttgcattgaaataatgggtcacactttacaaagcattctcgtgtacattatctcctttaatcgtaggtcttaagactatagctcgtcaccacttaaaagttacttaatacaacaatactcaactcctggagagccttatcctgtgggaaagccaaagttgctgttgcctccagcacggtctcgctcaaaggactggagaggcaataactatgttaggtgatttcttagtaactgttttctttgtggtctcttgtgggaggaaagaatggagatgaattctatggtaatattcctctctaatggaagtgtccctgggcagcctctgtagactgtagtgcatttgccctgctgctgcctgtaagcactctggttaatcatgatttccaagggtacctgtaaccttgtaaaggcaatgggattaaaatgaacctgcaactggtagaatgtttgggctgattatctccttggtgtataggagaaaaaacaaaatccttccaggttgctgcaagagtacaaaggaaatcctgtcaccttgctttgtaaaatccacttgagaaaaaatttaaaggttgccctactgtgaattccagttgtgttaggaaaatcagtagaacagtgcctctccatgtggaccaaaggatgaagttgtttttttgtgaaagccattacaggacagagatttttccccccctttctttctcttcaaaatataattttttacccaggagttttgtatgaaatattaaataatttggaatgcctgctgtgggtaggttgagaggcctttatgagatgaaaaaaaaatgttcccctccacctccaaaaaaaataaaatgagcaagggaaaaatttcaagtaaatatgcaaggaaacaaagaagtaattccaccctaccccacccttaattaggtaagattgttttagaacacttgaagtcaactctgactaactgaggcaaaaacaacagtaacaataatgaaggaatatgtaaggctgtatggtagctcatagtaaggtcagaggagctgaaaagctaggcttgagaatagacgagttctggagacctaggaacccggtgagaaagggtcttctggataatacgacaaagctctaaactgtttgtagtccttgcctcacctttctgaacattgagatttccaggcaacaagttggtctaatttgggtccacccagggaaaaactgtacattttgattgagagtttcaagactgctgcaaaaaatgggaacagagtagtttcccagagggaaatcagggaagccatcaggaccagaggggatggatgccaagcaggctacactaacagatactcacacctggccctgcctgggacacattgcctccataataaaggacccaagagtggtggggtgggggaggagaggcacgtgaatggagacctccccctacaccagccagaagtttacttttaacttgtgaccttatgaacctacatctctctacttgggataaatcccaatagatttgaaggacaaccatggttctagtggtgggcatcccaactggttctgacatttcttaaggcatttcgaggatatgctttggaatccttaaaaaagtgaccaccctctaactccccaatggcttatcctaaagaaatcattagagtgcaaagatagtttgtacaacaaataaatttgttggggcgttggtgataatagcaaagaatgagagacaatctaaataccaaatagggagttggctaaataaattaaggagtaatacacagcctttagaaagaaccagagagggctggatctatttgcagaaattgtgctgatagtttgttaatgattgaaattttaaaaaaattaggctatagaacaacatacataataacatgcattacttgacctccctcaagaaaagaataagacaaacagttttattttggaaaatataagcagttgtgacattttgctttttgcacctcattattcacagagcaaagagagttgcttgccttgggtgtctaatgattcttcagtcattaccctttcatctagcacacaggaggtaaaaagatgggttaaaaaaattggtcacttttgccagcacggtggctcacgcctgtaatcccagcactttgggaggccgaggcgggcggatcacaaggtcaggagttagagaccagcctggccaacatggtgaaaccctgtctctgctaaaaatacaaaaattagccaggcatggtggcacacgcctgtaatgccagctactcaggaagctgaggcaggagaatcgcttgaacctgagaggcagaggttgcagtgagccaagatcgtgctattgcactccatcctgggcaatagactgagactctgtctcaaaaaaaaaaaaaaaaaaaattggccactttttcaggagtcatttaaataggaattgtttttttagggtattgattgatttctaagctggcaaaccagtgtgatggtctggtttagtgcttcctcacccttttttgagtttggaccctttcccacatggtacaggttcttagcttcccctccttggtggggttgttttactgtatctcttgattgcagtaatttacaatttaatgcaaaccccccataaggctcatctaccacaggtggcgctaatgctctgggtcttgattgttctgcaacactccttctgtttatgacacaatctaaactcttttaaagatatgaagccaatctgatatgaatttaagagtgagacactgctcttcttaaccagattccaaatgtctagagtccaaattccaaatgtccggcattttcttttctaggaaatgttttggtgggaatttcaatgcaaacattttatcagagagccagaatgttctgaaggagcagttaacaaaagggaatttctgaattcgtttgctttcatctcgaagtttctctcagggcatacggtgcctgtggagtataagacagggccataagtaatgtctgtcagctgctggtattttccaaatgacccagttgccagggagaggatggcagctgataaatatatgtacatttctttgcagagccttttcttctcctcttctctatgctctgtttggatctcaggtttagagagatgaattcatcacactcccctgttcatggcacattatcagcacaggtttcttgattcattcattctttcgtttcattttatttattcatccattcccttttagttcttttttctaaaatgtgtgtcttttatcttcctgtgttcttgataaatggtgtgtgttaataaatggttctgggtcttgttttatttcttactttgtgccctcatcattgtgtcaggagccattcgtattcctctgtgtccttttatgctgtggcttctgattactgcataatttgtggtacacagcactttgtatctgtttttgtagagatgtactccatcttctcatgcctccaactcctcatcagtactcacaccaccacaatggacatctttgtacatatcttcctgtgtgagaattcctctgggatacacccacccaaagcattgctggccaaaggctatgcatatacttagtttaagcactctcttgtattgttctccagagtggtcgatccgcagtcccaccaaccctacatgcaaatttctccattcctgccaactctcaccagtattcagctctctaattttttgccagtctgataggtgtaaaatgatagttcattgttgttttaatttgcatttctctggtaattaatgaatttgagcatctattcataggcctgttagtttactgggtttcctcttctgttaattgcctattcatgtcctttgcccatttttctatttcagttaccatcttttctttttgatatgtaaaaagttcctactgattctagatactaatcccttgttagatttagccagtttaaatatgttctcatcttgtcatctgtctgttaatacgtggtatccttctttgactataaatccttcaaagcccttttatatattcaaatcatctcttttttgctttctggtttatgattttcaagttgtgttttggagaaggcctttatgacccatgtcacaaagatgtgtacctatgttttcttttattggctttatgagtgtgtcttgcacatttaagtttctaatctagctgatttccaccactgtatgagatgttccatgaagatccattcttatttttatccttgggaagagttagttttcctatcaacatctactaagctatccattcttccctcgattgatttgtagtgccagtgttcttgcattttaggtttgcatattttagttctgtctctgagccctttattcaggttttttgtgtagctgtttttgtcccaatacctctctgtttttaataataactttgaggcaactcttaatatctagttatataagtctcctctatttattctcccttttgaggtttgacttgggtatttatgagtctttatccttctgtataaattctataataagtttaagaagtttcccctaaaataaaattttcctttgcgagtgcattgaatcatacaggttatttggagaaagttgacacctttgtaatattaagtcatgtcttccaagggttttgaatgtctttccatttattcagaccaccagtgttttttattaggattttatttttctgcctagagatcgtgtgtgctcctggtcaagttaatccctaaatactaaatttaaaaaccaatattttattttgccagccctgctacccatggggacccttcctggatttgcttctagaatgtcaggaatctatatcagtgacaccagattctctaatttgtcaaactcttacctagtagagaagggaaggggaaaaagggagtattggtaataaagaagaagaaagtatgatattgtttcttcttaagcttttttttttgaggaagtggtcactgccagtgtcagtcacctagttatctgatacttgtcattgattcgtccctttcattattacaaagaacaagacttccctgggcaagaaccatttctcccatctcacccgctgcagccccgtttgctgtatctctcgatgtctttttgtctttttgctgttccctacctttgggtacaaggtagggaatatctttagggagttataaaatttactccccaaagactatgagaattggttcatttttctttgtaatgagtccaggttggaagcaggatgagaggcctgttctcagctcaggctgctattgtcctgccgtcccacctgagggaaggttagaaagccgagaacttgtcagagagaacacaccagtccagtgcaagggagtaagagaagggcaggctcttacagtgtgagttggtcttttccaagtttgacgttttaaataacaaatgtcactgcctacttaactctaaaaagattagcttgtttacaagaatgctgccctcccactgtttctccagctgcttgaaggctgaagtctgacagattgaggcagagagggctcagtctcctaatcttgactttatagtgccactttcctcaatgtgggtattaactcagattccataggttaatcgggttatgttgaaaggaatatgctgaagttgctgcaggcatgccttctcatgcatgtcaggacctggcttaacactggccatctggcttttcagaatgccattttgtagttcactccacttctcactcttgttcaacattttcctgttactcccacctggatcttgtgccggatgaaactgcaggagtccaggcttcctgtagctcttccttcagtgaatgcctctagaagttcttggactcctggcctcacgtgatccttccatcttggcctcccaaagtgctgggattataggcatgagccaccacgcccagccttctgggagttcttaagggcaggtggcactgagatatatgagtaccgagaggtaaggacactcataactagaacacacatctgtctctacctttaaagctcatgtgatctgctgtggaggttcagaccacaggggaacaatagacagatggcccaattacatcgtgtgggtgtatgtcatattcaaaccatctacagaagtacccagggtgcagactacatgcccagagctcatggatttgagagtgagctacacttgaaaaatggaaatttcctcccttctctcctccccagaagaagaaaaaatataacacttcctcctctttgcatccaagtcctagtcctttctttccttgtggtttgtttttaatctagtgctctagtgctttttttttttttttttttttttgagatggagtcttgctctgttgcccaggctggagtgcagtggcatgatctccgctcactgcaagctccccctcccgggttcacgccattctcctgcctcagcctcccaagtagctgggactacaggcacccgccctcacgcccggctaatttttttgtagtttttagtagagacggggtttcaccgtgttagccaggatggtctcgatctgctgacctcatgatccgcccatctcggcctcccaaagtgctgggattacaggcgtgagccactgcacctggcctaatctagtgcttttataagaatcctttatatttgaataaaaatgctgaagaacccactgcagtttgccaatttgtcattcacactgggaggtggggagaagagcagtgattgaagaaggaaatatgaactcattgtagaatattacagaaatacagcaaaatgattttgaaacattcagtcaaaaatcattggtaatattattcccagagatacttccttcttgccttttttaaatgatgtcttgtatgtattttgtcaatgtcagtatgaattttaatttaactggcattatgttgaatatgcttgttgtattctgctttaaaaattacagacattttctgatgtcatgaaatgtttagaagtatcacctgtcatggttgtttaatattctgtcattggactatatcttaatttgttgaatcatttatcattgttagactaatgctctttccaggtttttggtattacaaataacattggcctatgttattcataatagcttcaaaagttattaatttcatcagttattggccttgtacatcagcctttgtacgtatctcagatcattctctttgggtagattccgccacgtggattagagagagggtttgcatggaggagtaatgtgtggctggtgtagaatagcatcctgggtgtagaactttggacaggtggtgcgcctctctaagcttccatttcctcttctgtaaaatggggataataatacccctgcttcataaactcattgtaagaatgaaagttcagcacattagtatctgcacattagttggtaagtgcctaattactcttggttattactcttatcatctggccaggccagttactcccacaacaaaaggaaaaacccactggaaaggaaaagccagctggattggtaacactgctcttgaagggaggaagacaacctgctactgtttctcagtcttggtgctttatgagtgttcattcatttaatcctcgttactgtatttctcaaagtggggtgtgcacaccactggtggtacactaggtcatttgagagagtatattttaaattaccatctagacttctgtatttattttgatgtgtattgtgggggaacataagttctctgaaatcccctgattttattttgttttatttcatttattttttttgagacccctgtcacccaggctggagtgcagtggtgtgatcacggctcactgcaacctccgcctcctgggctcaggtgattctcctgcctcaacctccctagtagctgggattacaggtgcctgctaccacacctggctaattttttttatttttagtagagatggggtttcaccgtgttggccaggctggtctcggactcctgacctcaggtgatccgcctgcctcggcctcccaaagtgttgggattacaggcatgagccactgcgcctggccaatcccctgattttacaaatgttattgcttagcacaggggtccactttttttagtaaagggccagatagtaaatatttttatttttataggagtattcaactccgctatggtagtgtgaaagcagtcacagacaatatggaaatgagcaggtgtgggtgttttccagtaaaactttgttttacaaaacaggcaatggtgaatttggcccagggactgtagtttattaacccttggcttaacacaaggctaagtttttaaaattagtctaaatgggatggcatgaggttttgagagggagcgtgaaagtgtcacacgatgggctgccatttgtacaaatgctgttcacagcaactgagtttccaaaggagctcacaggcttaaagaggtcaagggagcacagttgagaagtagtgaagctcatactcaaaccctagcctgcctcattgccagggtcatttttttcctgcaacacttcatatgcttgaaatctttgatccattctgccatcctgttcatatgtggtccacccatgggggctggaaggaatttcatcatcagactccaacatctaacccctctagttctttgtggctgaggggccatcccatattccttcttagtgcaccacctcattagagccctcagtggttcctcaaacacctgtgcacagtgctgggtgcacaagggtcacgcatttcactgactggcttccccagggtcagacccttagcgtggcccaccactctcccacagggatttggcaacacaacataatgctttatatgttgtttctgtacatccactcatccttctttaggccgtcattcagagcaaactccctgatggcgttttattcaggtttgccttgttttatgaggacaagattgaggaccaggagaggagatggggagggacatcattaccattgctctgtttcctattgttgtgcctctgactgtacatttccttcatctctgttcctcagcctcccttgatctgtaaaacagaaaaggagatttaggcttgaaaactgtagggaaagccttgatgggatcgcctgggccactatttttaaaagacatctaaagccttcagccgttaccaaaaatccaccgtctcatgaaagcagcagagggcagaaaagaggatttttttttcttttgcttctagtcacctttggccttttgctgttagaacacccacagttgagaggcaggaggaggcagccaccggtaaccaggatccttttgggatcagagccatccagaggctgccaggcctctgctggtcggtggcttataaatagaacatttccccttttaaacctgagaagggtggaaggcattaatgggcacagtggcctggccgcctatgcactggcccacgaggcagtcagctgagtgcagcatcccctccagctttctctccaggcctgccaggtctgagctgatagaggacagacactctccctccctcccttgcctgcgttccttcctgccctcctccccacaccctttttctttcccctttctcctctctcctgtgcatgcagtttccgtggccaccactttcatcttctgagccgcagtcaggcgaggtggtataattctagctctccctaggtgctgactttctacacctcacttttcattatgagttgcctgtgcaacacagttgctgtggtgcattgagcttgaattacatttagttgagctgtaataccccagctctagaatagccctggctcggagggcagggggctggagagagaagaaggggcaggaacagcttgtttttgcagatattttattatttgagttcccagctattttgtttgatgagaccctggcccccaaagctatgactggtggtggtactccttggacttgcatggataatcagaagcctttctgcttgtcctaaaagacacttgacaaatctaccctctctctcagctagctttagactggcagatgcagccagtgtatgcctctgccatggcctaatattcccctttccctcagtgatgtgggctctgtactgacagcaggctgcagcctgagcaggtgtgagccacccgttgccatcccagtttgggcttcagccaagagacagtgagcaggtccctggctacatctttaacccctaaagcccagtgcaaggggttattgagacagagactaaaatatttcccccactgccaccgagtacaggcttccagttattgtggttaatgtttattgagtacatactggggagtgggcaacatgttcactgcttgatatacgttatgtcatttgatcctcctaagaaccctatgagctagatactattattgaccccatttacagatgtgaaaactgagacttcattctgagggcaaacttggtcactccctgcactgatcagagttgtcagagcctgcagctcacaatcggcatgtaagattgagcagagggtagagtagtgcttagaagtgttagctctggagtattccacacgtggtttgaaatcccagcctcaagaattactgagtgtgtgattttgagaaattaatttctccaagcctcagtttctttgtctgaaggtgggaatagttttaataattaaatctttggtttttttggaagaataaatgagattaggatggacatcctttgctcaatggtgcctggtattatcggcaatgattaaatgttgcgctttattcttattaccaataatgtcatcattatccaaagccagagcccgtttatataaaaacgtggcactgtacagtctctttaaagttcctccgggcattgccttatttgattttcacaacacctgcatcttatatgtgaggggaatgggtcagagaggtgaagtatgcccagcttacacaagcagtttgtggagacaccagggctcaaatcttaggcctttgattctgaatgccctctctttccctgcccttcgctgcctcagagtttgttgtgaccaacaaattgttcttaaagcatttcgaggtaagaagacagataggtaaaggcaggaaagtgaccttgatgggcagaggcagttggttctctgtttgaaacacttccaccctcagaaagctgatgatgatctctttcggttgagaaatcagtgcaaaaccaccgggccttaaggcagaagggaattgaggccactgtgtaattcattctcagaatgtccagatccccatgtaggagacaaatggtcctgattaagctggtcagtgttactgcagtgtgcattaagccttgctcttttgctgctattctgatttggaattttaaggtggactaggagattgcagaagtagaaacccacaaagaaacactccttccatcccaggcagatgtatagtcctcagcctgtgctgtgcaagaacctacgtgctgtcaccctggatgcctgtcttttgccaagaattggaacactctttagaacctcccctgactgtggctgagagctggtaggtttattcccatccaggcagatttttgtttctgttcctgctacctattttactttactctatgtctctttcagcttatttttctgtgtgtttgttttcaagaaacaatgaaaaaaaaatagatgcctttgtatctggtaggctagggaagaaaagtctgactagcagtattcttgctttgaggtcagggtatgaatgagatctctgtcaaacctgtttgtctcatgcttcccactgcaggggcctgaactctagaaggtaccaatatatgcagccacctgtcactattcaaggctcctggaatgtggagacttttggcctgtcggctccttgtgttttcagctggtgaaaacatggattgtatttattctttcaggacatatttattgagattagtcatgaacagggcagattgtctctgctctcatggagcatatacaatgaaaagaaattgacaacaaagagtaagcaagtagataaaggtataatttctggtagagatgagtattctgcaaaaataagggctggtggatagaggataagggagaagggagtgattttagatacctggagcaggaaaggtctctctaaagaggtgacatttgagaagaaatctgaacaaagggagggagggaagcgtgtcaggagtgggtagatgagtgttattgatggagtgaccaacatgtgcagaggccctgaggtgacgtgagctacttgtgttctaggaatatcaggaagaacagtggtgcccggatgggaggaggccctgggggtgagtggtcaggtaggctggggctagaccatgtggggccaggagataagactgcattcttagtgtgaagagaagtcactggagagttgtgatcaggtgcatgacatgagctgatgtatgtttttaaaagatgactctggctgctggtggggaataaaccgtagtggggtgggtgggggtggggggtgggggcaaaattgaagcagctgggagactgctgcaggcagtccaggcaaaggatgatggcagcttggatcaaggtattagcaatggatatggtgaagagtagttagattctggatacggttttaagttattagtgacaggattggttaatggattggatgtggtgtgtgaattggatatagggtgtgagagaaagcaaagatcaaggatgatgttactggaacagaatatcttacaggtagaatatggtcctctcccatctcattctttcagccaggttgaacatagtgcatgtttggggacacattaggacttgagctccccaatttattatttctgtcaccttcatgattttttgtgttttttttttttgagatggagtcttaccctgtcacccaggctagaatgcagtggtacaatcttggctcactgctacctttaccttcctggttcaagtgattatcgtgcctcagcctcccaagtagctggtattacaggcacctgccaccatgcctagctaatttttttttctttttttttttttttagtagagacaggatttcatcatgttggccaggttggtctcgaattcctgacctcaagtgatccacctgcctcggcctcccaaagtgctgggattctgggtatgagccactgcacctggctgactttttaaatatatacatatactacttttattattaatttgcttactggttttaaaccaattcatccattttttacctcagtttatttaaaaaagaaatatattttgctatgtgtgataaatcagtagatttctaatattcattaaaataaaagtataactgagaaatgtttgtgaacctcttggaatcatcccatatgccaaagtggaacaatccagcattccatattaagatgcatagcactggcaaatagttgttgtccagcagggaatgtggtatagatactggcaattgactaaattaagtcatttttgtttgtttttggtggtaataatcttaattgcttagtatatagtacagtgtttttccaagtggggttctcgcatgtactgatgcataattgccgggagagggcccagaatctgcatttctacaagtgcactcttgttcactggagttgagagccgctactggaatagaaatggtaggatccacagaacctgatccacagcccccagttcctttctgactgtctctagcagaaagcaaagagtagaagaggatgagcccaagagtcagactgagttaaataaaatcttggttccactactcactgatgctataatcttacagaaattccttaacctgactgagcgtaggtttcctatctacaaaatacggatgatgatgatgatgatgatgatgataagaaaatgatgcacctaactgtgtagctcagagcaatgtagtctgtgctcagtaagtgttagccatggttatcattgctgttgttaccacttaacgtgagtctggctttcctcatcataaaaacttagcagagatattgggaaaatcaaataaactatagtttattaatttattttataaactgtaatgtattatccctcattacactcattagtgtgaaaacacagtagttatgagtaagaagagtagcaagacttaccctatggggttatcataaagataacatgaacttgaatatgaaaagtatttcatcaactggaagatttcattcaaatattaggatatagtaacattctaatattggtaatactaggtaatattggtcatgatcatgtattgaataccaagtaaatcccagttgctatacatttcatttgaccctcgtagcatcctgttgagttatccccattatacaagcgaggaaggtgagcctcaaaaaggtgaagctaaggtcatatccagccagaggtagctgaggcagggttctaatccaggtctgtctggctttatagctcattcagtttccactacctacaattctgtctgtgtgactttagttaatattaaagttagttcacattccctgaacataccagccagggggcagagaatagtctggtgtagggatggtgcatgggggtccctggagtgctgatctgggattaaaaattggctgtgggtaacctccacaatagagaatgcacacccagataattaagaaccagttggccacctttcctgggccccactgaagcttctgagagctgctatcatgaggacagctttccaggggccacagcccagggagccctggcaaccctggggcttcacatgattaggggaaaacaggcaagcccttctagtcttccctctgtgtgtgtgaaaattggaaattattcttcaggtggaatttatgttcatttcaatgtgggtggttttctcaatggcttttaagggtgttgaaattgattaaattcagaatgagggaggccaaccaggctctataaagagcaaatcacattggaaaattgcataaatttctgtggtgagaacatgcccctgaagtggcctgctcacagcaactcgacaatttcctgtatccatccatccatccatgttagaaatcctttacttctcagttttttttttttttttttttttttgaggcaggctctcactctgttgctcaggctgcagtgcagtggcatgatcatagcccattgtaacctcaacctcgtgggctcaagccatcatcctgcctcagcttcttgagtagctagggccacaggttcacaccaccatgcccagcaaatttttttttaacctttttgtagagatgaggtttcaccatgttgcccaggttggtctcaaacccctggcttcaggcgatcttctcgcctcatcctcccaaagtgctgagattacagttgagagccagggtgctcaacctcaatcctcttgtttttatgcataacctacagtgcttccagcaaattccatttctcccacaaaaaaggtttggtttgtttttttctttttaatcaaaggagaattgactaaatttcctggggaaaaaattcagactaggaaaaacttgttgaataccagctttagggacagtaaccctttctagttcatgttgaggctaattcagtagattagctcctctcctttggatgaggatttccctccccagggtttggttagaattccagggatgcaggcatggggtcgtttgggggcatgtcctagtgtgctgtttttatagactatatatatgtgtccatcagtcaacttatagtatggaaagttttcttctattcaaattgggcgatttggccacttcttgccaaatttcttggttttctgaatactgaaggttggagttgagcaactgcaggtcagtgattttcagaagaggggctcttgagcctgaggaatcaggtctcacgggtagcatgatggtctagcggagaatacttgtgttttccaggggctctcttgaccctcaggcctcaggcccctcttgaccctcatttagatggccgagttagtgtaatatggagaagccctcctctcagccccagcttcacaccacatgcagctcaatgatgataatgccttgatggacaaaatgcaggaggtctaaaagtgtccaggaaaacctaaatttgcttttgtctcctatgtttcatggcttagcttgtgccacttttgttcttcctttttcttgggcccattcttgggcttcgctgctaggtggcatgcctgtattgatacaggaaggaaggaagtggttagatcagcctattcatttctttatttaacctttatatcatcacaaaaaaaatgagaaagtggaggaccaaaaggttaaaagaactcatctactctcagagggtttatatcagttgaaattgaaaggtcattttgacacactgcccctcggcaactctctctaccattcattcactaatttacctattcatgtatccaaaatgaaaaatgacacgtgcatgcacacacttccaattcatatccattgctatagttgatggtgaaagatagagctgtagtagccagtgaagtaaatatacctggaccattgccctcatgaataagtattctagtttggtagacatttttcacagaatcacacatatcagtgtaaacttgcagtggtgcatcatagtctgaaagaaaggttgatggtcctgtatctgagtgcacaatgggggctttaacctaggtgggaacgtctgagtgagtttcttgaggaaaggacacttgagggtaatgtgagttgggagccaaaggctcccgtgcgaaatccacagtctgtgctggggagaaagcatggttagttgaatgttcttgaaagacagccagtgtggctaggtgctcagagctggcacagtggcccctgaagaagctggagggccaggcagggccccgtcacacacagctttgtgagcaagtaaggattggggttattctcccaagggcagcaaggtgctgcagggaggtgatatgctctgattttgtcaagaccataggggctgcaatgcagagggcagacaggaacaagaagaataagaagaccagccaggaggttaatgcagtcatcctggcaacagatgattgaggtagggaccaggatggtgatgatgatgatgaagaaattggacaaaattgagaggcattagaagagacaattgagggacttggtgataatttggaatgggaggtaagaagtggtgccaagggtgatacttgtgattttgttataattttccgaccacctacacacctcttttttttttttttttaatagctgggaggagccagtgaaaagtatctcagatgaggtcccagaagcttcaggacatggcgttgaccttatggttgtatagcagtggcagttatgctaaaatccatgtctgtctccctggcccaccaacctcctccttttatttatttttattttttgagacagtcttgcccaggctggagtgcagtggtgcagtctcggcttactgcagtctctgcctcttgggttcaagcgattcaagcctcctccttttagataagaaaatcatttgattgtaccttagagttgttcttttaatccttttgcagtaagacagctagtctctggatgtaacctgcctccagcctcccggggttcatatcctaggcatgatagcccaaggcatcctcttcccacgtctgtggttttccctaagattcttcaaggttactgagcataaacccacctctcctgtgttcacgtgttctctagagaactttgagaaaatcgactttgctaccctagcatgctgctttctctgaaaggagacaaagcaacaaggcttcaaaagttgaaatgaaagttaagaggatggcacatttctaacctgggaggccaacctggatatttggtgcaagctctgccagcattcatgatgagacaactgtttgggctgcctcgtgtgtacactgagcagagctgaacctgaggctgagggagggaagtaaaccagccgaagcctcaactgcaggatggtggatgttggccctgggagacacaggtcctgcgacaactcatcacaagtcaaattaagggactaatgcaagcctagtagatatttaatgagagattattgctggagattatagggatacagaaattgctaataaatccctgaccttttctgagccttggctcagtgaaagagctgaatcacctgcttgaggggattaaggacagccgcctccatctggcgagccactcagactttttctgtcgttagcaaacgcagcttggtggtgatagtgttctaaaccttttagtgggaatttgcttttcagactaggagatctcaattaacttagattatatccctactgggcagagattaggactaatgatctggttatgtgtgcactgtagtccctatcacattatggtacttggtccatgataaataataaaaccgttgttaattattagtaatctaatcagcaggaaactcaagttgatgagagtggaaatcaagctctttgtgtgtgtgcatgcatgcacatgtgtgtgtgtgaaaaagaagagacaaagagagatgggggtccccaggcagtgggcaatgtgataatttacactagttccagtttagaggtttagagcagtggttgataacctgtatttcttgaattccttgttggagaaacagttgtttgaaagagattccatttcttaacacagtgttatctgtttataggctgtaaataattatcatcaatatgcaattttaatacattagaggctaacagagttatcttgagctcataatgtttgactttgcaatatgtaaatatcgtatccatttgaacttagacaactaagataaactgagaaatactggattacacatgtcatatgtaagacctttatgtgtaacatctgtgtaagacttaattccaagaaaaggagtttgctggtttcaaacaaattggagaatctctaacgctgggaaaaccaaaggaggaacatttactcagattgaatgtggaggttttgctttgccatttaccaaaagaagtaattgtagtagtgggtaaaattttgattattttctggatgtatttggaagcgtccattttattcttttccagtaaatattacttacctagaaaaggatgcacttcctacagtgccacacacacaaaaaaaggttcaatgactgatttgcctctagagggttatgtccactaattgggctgatggctttacatgcatgtatcttctgaccactggggtcatcactgtcagatgctaggttcttttcaatttttcaaaacttttatcgatgttcagagggtaaagaaatagcctttgtctagggcagaagttcgtcaatgcctagaataagaccatgttcacaagcctactcttaaaacatcctagttcagaatcaatgtctgcagctccccatagcactgtgtaaaatggcaattttttctctcccagacttctttgattctcattgctatgaaaagatgatcttaagcacctctcaaaagaagaactaaaaggcttcacctgactattgaatcgtagttataaacattttgggaaactcctttagcacaaaacgtaattccccgtctgacaaatgctttccagtaggctctattgtgactactgtataaaggaatgaaaatcctccctgcacatgaaaagattcccaacattattagtcattagggaaatacaagtcaaaaccacaatgagatacctcttgacacccactaggatggctataataaaaaagacaataacaaatgttggcaaggattaggagaaattggaaccctcatacattgcgggtaggaatgaaaactggtgcagctgcttagaaaacagtttggcaattcctcaaaaagttaagcacggagtcattctgtgacccagcgatgccactcctaggtggatactcaaaagaaatgaaaataccagttcacacagagacttgtacacagatgttcatagtaacattattcacaacagccaaaaagtggaaatggcccaaatatctatcagccgatgaatggataaataaaatgtgatatatctggaccgtggaatattatttaaccataaaaataagtgaagtactgatgctacaacatggctagggcttgaaaacattatgttaagtaaaaggagctagacataaaagaccgcatcgtgtatgattcccatttatgtgaggtgttcacaataggcaaatccatagaaaaggaattcttcccacagctgggagaagggaagacatggctaatgtgtatgggtttttggggtagggaggagggcaaaaatgttctggagttagataatagtgattaatacacagctttgtaaatactctagaaattgctgaattgtatagttaaaatgggtaaacttatggtatatgaagtatataccaagaaagctgttatttaaaaaaaaaaaattcctcccctggattccaacaggtatttggcctctgtattataggttgttattaaatttgaaaaatgcctgccgcatgagttgagttttatttggaagaattattttaattgggctttcagcctgtaatcagaatcttgagatgccataatttgcagagcaaatactttatttatactgggaaaaacaagggattgggttaataggctccttaccattttaagggaataaaaagaatggtttgtatagcaagtaatctccagggagaaaaacattgtttttctgtttcttttctggtactttacttactatcctagaggctgagtgtgtttgtaataagcatcactaagcaataagtatgcatgtaagtataggaactattaatatttcagtttgggaagagttgttttaggaattagcattcctttttagtttgattttgggaattcttggtgattaaaaaatgttttaaaatcttcagcacaattcacaattgcagaaacgtggaaccagcccaaatgcctatcagtcaacaagtggataaagaaactttggtgtatatatatgatggattactactgagctataaaaaggaatgattaatggcatttgctgctacctggatgagactggagactattattctaagtgaagtaactcaggaatggaaaaccaaacattgtatgttctcactcataagtgggagctaagctatgaggatgcgaaggcacaagaatgacacaatggactttggggacatgggggaaaggatgggaagggggtgagggataaaagcctacaaatagggtgctgtgtatactgcttgggtgataggtgcatgaaaatctcacaagtcaccactaaggaacttatccatgtaggccaggtgcggtggctcacgcctgtaatcccagcattttgggaggccgaggcgggtagatcacctgaggtcaggagttgaagaccagcctggccaacatggtgaaactctgtctctactaaaaatacaaaacttagccagatgtggtggtgggtgcctgtaatcccagctactagagaagctgaggcaggagactcgcttgaacccaggaggcgaaggttgcagtgagccaagatcatgccactgcactccagcttgagcgacagagtaagaccttgtctcaaaaaaaaaaaaaaaaaaaaaagaagaacttacccatgtaaccaaacaccacctgttctccaataacctatggaaataaaaaaataaaatgttcattttatctaagtttacccatatacgctaagaattaaagaaagattcagtttggattagatccaaggtgagttcaggttctgctcacttctcaaatattacaagtttattactttccctgagatgaccgcaaatcatctataaatacttgcttttctactttctgccattttcttttccactctgaccattaagtggtagaatgccttgtccactgtcctaagaaggtcaaagatgaacccattcttaaagattatcaccgggtaaccaaaacatgggggtgaattttagggaatttccagccttgttgtcaggttagaagtttccagccttgtgtggttctctgctgtggaagaagttgctgctgttgatcatttattttctgggtgagaatcctgtcaccacttgctcatttccccctagaggatggccccactgccttcatgctgcttcctttggtagtgtctttgttcttggctgttttaattttcctctgaatcatttttcttcttttattctttgttctatttttcctttcttctagtcacctgagcaggattatacttaactcagggacacgtttaaggcagtttgatggtatgggctctagagcaagtctccatgtattggctctgcatctttggtcaagatacttagttttaccaagcctcagtttcttcatctgtaatatgggctagtgataatgtcaacctggaggacttactgagatcaagtgagaaaatctattttaagcacttacccaacatttatagaccacttaatttgtgctttttgaaggagaccgcaattagttctacagcttctgttaatagcagagcaatgtaaaggtacctgtcaccttatgctgcagtttcttcacctgtaaattgaagataattttacaggttactacagcttgaggttactatgagaactaaatgagatactacatgcaaagcacttaaaaccatacctagcatatggaaagctctcaatcaatgccagctattattattattattatgttattcctgtactgttattgggaaaaactaaaaggatatgtgaccacagcatgcgattgattcatcctggtttggttaagccctatcctgaggttgatttccatggctagcaacttgactgcccttctcttgctctttcagctgcgcagttggacagcattggcttcagcataatcaggaaatgcatccatgctgtggaaaccagaggtaaagtagtttaacagatggcattgttctcatagaaggtcacgcatctggtgaggagtcagacctgctacctgctgtttcctgactttaagtgactcattagctccccaagtgccattgtcagtggatttccacaagtcttgttggtctcaagcaggaggtcctaactgattttgtgtcaccaacttctttggctgatcagaagaatgtgttaaatatctaaaatacatatgattatagaaaccagttactgaaattcgatttttaaaatattaaaaaacacagggtatcatgatatatgtgtttctttgttaacactttataagtgatagtggtgggtctgataactgacataatttgggagcagtgatatttcaagatatccataataattgtaatgtgttatgaaaatatctgtgatttctgaccaagttgcaggtaccgctaatgctcctgtaatttgttgcttacatccataaaggaaggaaatgcttaatgtcagttataggttagtgaagataaagatgtaattgttttcctgtctaagttcacagacaccctaaattttctctggcagacatcttggggtctgtgaacccaagatgctctggggagctagtccctggggaccacccaggtagagaaaaggggtcaggcccatgttcacactgatctttcccaggtctgtgggagcaggacattaagatcaaggaggctggttcatcctgatggtctccatcccttcttcagagacagccacaaaggagattcctcagtcccagcagtttgaagctttgagtttgctggtctgttgtaccgctgagaaaagctattaaccatctttccactggatttgatttgaaccgttgtcagagatgtgaatcttatttactcacagcctctcagcctaccagccctttttaagtagtggaaagaaattctctcttttaaagcaggattcataacttgccagttgagaaatatacactttttttttcataaggactgtgaggcattaagtagagggaagagagagaatttaaaaacctacccttatgtatactgtcaaaagatattttttccaaaacagttgtaatgtatggaaacatttttttaaatgttcagttatttcccctgtacctctcttaaataaagaattaaggcatcttgtaaaggtatgtaagatatatccagagaatataaagtagaagtaggtgacatttctgggaattggtcttgaggaaataaggatatgggccagattgagccataaggatgtttacaccgtggtgatgttaaggtacaaaatcagaaacgggccaaatgtctcaaaaatgggttaaatcaacagtggtacatctgtgtagtaaaaaactgtgaatcactgacaatgcaatggaaatacattttttgacatacggcctttttttttttttttttttttttttgagacagagtctctttctgtccccaggctggagtgcagtaatgcaatcttggttcactgcaaactccaactccctggttcaagggattcttctgcctcagcctcctgagtagctgggattacgggcacacaccaccacgtccagctaatttttgtatttttaatagagacggggtttcaccatgttggccaggatggtctcgatctcctgatcttgtgatccacccacctcggtctcccaaagtgctgggattacagacatatggcattttaaaaattatttataatacgtgaaaaatgcaagttacaaagcagctgctcagtatgagcccgttctgggagcagtggggagaggagtggtcatattgcacaggtttcattgtgttctcagtggctgtctgctgatttttactgtttccctttgactcatctatttaccttaactgtagtttctaagtttttttgaagtgttcattactaaggtaatttttcttttttctttttctttggaggggacagagtcttgctctgttgcttaggctggagtgcagtggctcaatctctactcactgcaaccttggcctcacaggttcaagcgattctcctacctcagcctcctgagtaactggcattacaggcgcctgccaccatgcccagctaatttttgtacttttagtagagatggttttaccacattggccaggctggtcttcaactcctgacctcaagtgatctgcccaccttggcctccccaaagtgctgggattacaggcatgagccactgtgcacggtctaactttcaacaggagttttaatttttttttttaaatttaaaagaaaagaccgagaataaaatgtacagagtttaaaggtagaggcacaaaaatggagccaaaagcgagtctaaaaaaaaaaaatctctttccccagtaaagttcatatacttgcttgagctgggccacctattcgtctctcagtcttcagcagccaaaatcaagagagaaacctaatcatttaaaactgttcacagagtctgtagtaaatgcaaactggtagctcaggaggacaactttttctgatgtaaaactacaaaataaatacaataagtaggagaagaagaggtgtacaagttcctcttccccctctaaaatgaaaatggaaatgatgtattttaacttctacgaaagtcttcattgagcacaaagaagaaataaggacagtatgagttaggtgccattttagcgtaaatagttgaaaaaagtgggtatctcccgattgcagtgtgtgtatgtgcatacgtatttatggtgatcagagatgaacagacttcccatactctctgggatttgacaattgtccagtgggaggtgggattgtgtaaagtcccgggaaagcacaaggatagaagaagtagagacacttaagacttttcaagcccacaagctgacatgttactgaatcaagtttctgccactgagtaacttgggacccatcacttagtttttgaagtttttgaccagggactcctagtccgtgaatcatgcagaatgatgtacatgattttacaggtcctttttagctgtaaaattctatcattccagaccacttctttttattcattagttccatgtctacataggtcttgttgaaagtactgcagaattggtcctttcctgagtttcttttggaagattgtgttttggcccccaagtattttatactggccttgatggagtataatctcgtgttttgtttattatcatgtaccatatactgatccagggactgaggatgtaatggtgaacaggacacaattactgtttacattctattgagaatgtaacagaaaaaacaagtaaataatcaaataacaaacataatttcagatattgttaactgctataaagaaagaaaacagggtaagggaatgaccagtaatgttgattgtggattgcattagattgaagcggttgcatttaagctgagatctgaatgatgaaaagctctgggagaagagcagtccaggtagaggaaacagctggagcaaaggctatgaggtggggccatgagcttggcatgttgaggtgacaggaaggccagtgtgtggagcagaatgcatgtggtcaatgatgcaatcagaggtagtcagtgctcgatagtataggccttataggccattgtaagtagttttgattatggtctaagtgcaatgggaagctattggagggttttaagagaagaggtgatatgaactaatttgcactttagacagttcactttggctactggttgaagaatggacatcagaggaataaaataggaagctggagctctattacttgagaggggtcagatatgatgggcctggaactaataggagaaaaatcatttcaagtcacctggtctaaattgccttcttttgtaaatggtacagtggtgatctaatccatgtatttaaatgaacagaaacactgcagtggattagtttttgattttttgtttagatgtttaatttaaaagtaaacccttactagtctaattgtacagttccttgggttgaaataaaggtggtcttttttgataaagaatatttgtattataaatgaatggatcttctaatttctcagtcttggctaacattccttaaaattaaaaacattcttacacctccgtattttcattttttgtgtaaaaatagattataaagtgtctttttctgttgtatgaatttttaatgtcatttttggcattttaattttaaaaattggttaaatatgacatatttaaaagtgtacattttgcatcttttagaactcttcagatgctgcctttggcaagagaaaggaaagcttctttcgccgctgatgactgaactaacatgagggctgaagtgtgcagcacatccgtgaaatcctagacagctgtaccaaatcccactcgtttgctaagagctgagctgagtgacaggggactttaattagagcagcttttaggaggactgagaaaatgaaaaaaaaaaaaaaaaaaaagtgcatttggctggattggcctgacttgtgttctgacgtgcctctaattaaatcatcactgtttctttcctcagggatcaacgagcaagggctgtatcgaattgtgggggtcaactccagagtgcagaagttgctgagtgtcctgatgggtgagtgccgcagtggctctgctaggcaggtccctggatggggggcccactctgaaaagtcaccaggtctgtgagtagatacagcctgtggcaaaggaatcggggtgtccgtgagctgtcacctagaagtcatctgccccatcggtcagttgtcatggcttcagacactgctgggaaaggttctgagtaggactggacaaaataaaaaatgccagggcccagacaccacaccctctctgtctgtaggctcagtgctctggtccaagtggcactcagtcactcatgtgaccaccacaccctactctgtctttaatagcttatgactccctccgttctcttttgggacaggtatttagtgggacacacccaatgcccaaggaaaggcatcattctgggctccagaggacctcagagttcatgttcctgatactgagcaggtgtcatgtaactctcagataaaatatatataaccagagaaatcttctgatcctctttgcttctagatttcaaccgaatacctgtcacttgagcagcagaacctcctttgccactggctgatataaatacaaagcagtgtctccaaatgtgcagtatttgaatcaaaagcccatgagtccatgagccaaatttgcttaggctgcagatttcctgtatttttagatatgagtgcagccagcctccatgaatcacatggacctaaatggcaaacagatcaggtttcacagaggctgttattcctccccatggaagccctggcttgtagagagggactatcacttggggtacgcagctcagtgttttggacagggacagttcttgtgttagtatttgtaatttcttttgccatcccactttctgaaaatagctttcttgtgtaaagaaatctcttctctcatgttggccagaatgactgtcttcacctctttttgagagagtcattcacttcttgtagccaaaaccctattgtattgctagttagagtgagatctgttgtttaaaactatgattatttgcgaggtactctagcaacgagtatctgggttttttttggttaagatttgaaatatggttagtttttgtaaaaattaaacttttcattttgagataattgtagatttacattcggttgtaagaaataatatagagatcctgtgtaccacttactcagtctcctctaaaggtaacatcttgcaaaacacaattttaatatcacaaccaaaatattggcattaatttagtcaagatgcagaacacttccatcactaaaaggattccttgtgatgttgtacaagcacatacctcacttcccaccttgcaccctgtgcctaacccctggcgatcagcaatctgttctctatttctataattttgtcatttcaagattattatttaaatggaattatacaatacagaaccttttgggattggcattgtttttcaatcagtgtaattttctcaagatttatttttgctgttccatgtattaatagttcttttttattgctgagtaatattccattgtatggatgtactgcactttgtcgaaccattcatttattgaagggcacctgagttgtttccagtttggggcaattatgataaagcttctataaattttcatacatagtttctgtgtgagcatatatttgttcctctgggataaatgtccgagtgtgcaaattgctgggttgtatggcgatagggtcaatttttgagaatttctaatataaggaagaattaagagtctaataggtgtcaatccttagtttttcatttctgaccagagctgcaaacatttgtggggtgtctgctgcttagaacagatgtcaggtgctagagattaaattttagaaagagctgttccttttctgtaaggagtcctgatagggtgaaatatgtgtgtatatgaaagctgtaatgtaaagtatgatattcatgcttaatctgtgctgggtctagaagattgagtagtgtagtgaaggagagagtagaagaataattccaattcatgaagtattctgaacaaagggtctatggtggctacagcaaagggtattgattctatgattattattttaatatttctgaaagacttaacttgaggctgggacaggagagttttaaagctgaatagctaaggtggtcttttttgttgaggaacttgaatactgagccaaggtgtttggggttttttctataggaagtaagaaactattaaaagttctcaatagtgggattatatccattataatgcttttgcacacaaaagtgtcaagaagacaattcagaatagtttacaaggaaaaaaaaagcatctatttgctcatataactggtaaatccaagacagaagcatggcagagtcagggatgccaatgatgtctttacttttgctagatcctttgccccttccttcttctggcttctcatgttctctgacctcttctgggcttggtgtggctttgttctctgtgggagtgtcccagacaggttcagcctctgcagtccttggagcctgtggtcactgagaagaaagtgcctttcttgaccatgttggcagaaggctctagcgaggactttgcttggtcagtatggggccattcacatgattcgtttctcaatctcagaccagtcacatggcccatggcagatggcctggatcctgtgcgtatgttgggggatgtgggggatggggtggacagttggggtggggacggggttagtccctgaaacccagtggactgagcaggattattgataggaagatggagaagtgctttcctgaaataatggctgctgttagcttttttaaaaaagtatatctaatacagatgtaacaatatcagattctagcattaggagcataatgttggctccaatttggagcatgtgtttgattatggaaagacatggaggaggaagttggttgtaatagatcaggcaaggcaaaccctatcaaagactgaactaaataggtgctctgaagtcaggaaaaaaggacacactcatagtgagtatacagagagaatcaacaggacttttaaccaacttgatatgggggaacagaaggggcagagagatttcaaagatgacagattattatgtaagatgacactaatgaaaagaaatatgacattttagactggtttgctaatctaaaaaagaagcactttagctcagttgtgttaagcaaaagagtggttatgaaaggatcttgtttttatcacttttcttagtggccttcacacaagatatttgtcttgttctcttccttgattttcctggggatagagaaaataatcatgaacatttgagaaatgtcatgaaaaagtaataactagcagctgaaagtcacgagggcagctgcctctgccaggaggacattacagacagactggaatctaatctgagatccaaccagagctgcaagatgaccacagtgtaacatctaattgaaagttgagaatgatatccatgattctccctacgagttaaataagtttgaatctctcaattacggaatcaccagggctctagacccctttgaagggggagcttcatcttctcttttgtgaacatgcccacaacttcatcaattcttggtactggtagtgtctgggctagccaagagtataaaataaacatggcacctgtgctccaaaaccttcccctgagatggctgggccgagtgaacctttcattaactatttctttattatacattcattggatgcttattatgtgccaggtactgtgtaagatttggtttatctgtccaaggctctcaaaagtggagtagtatgttttggttatggaaaatatggctggtcaggcgcggtggctcatgcctataatcccagccctttgggaggccgaggcaggtggatcacctgaggtcaggaggtcgagagcagccaggctaacatggtgaaaccccatctctactgaaaatacaaaaattaggctgggtgtggtggctcacacctgtaatcccagcactttgggaggtcaaggtgagcgatcacctgaagtcaggagttcgagaccagcctcgccaaatagtgaaaccctttctctactaaaaatacaaaaaaattagtcaggtgtggtggtgcacacctgtaatcccagctacttgggaggctgaggcaggagaactgcttgaacccgggaggcggaggttgcagtgagccaggactgcgtcattgcactccagcctgggcaacaagaacgaaactccatccccaaaaataaaaaatacaaaaattagccgggtgtggtggtgtgcacctatagccctgctactcaggaggctgaggcaggagaatcccttgaacccaggaagcggaggttgcagtgagccaagatcacaccactgaactccagcctgaatgacagagcaagactcagtctcaaaaaaaaaggctgagaattaagcaaaaccagagactttttttgaattacttcgagtttatttttttgtactcttaatacattggaggactttgggttggaagaggaatatgagagccagtgctttgagaatgtcttctttgtactgatcaggattccttaagaaagcttgctaaaattcctcatagcaagtgcagtgtggctttgtactagtgtcctaccaagagctacccttgatcccttcctcctagcaacagaagtcattagtctttagagagtgaaaaggactctcaaagacttgcagattcctagaaatagaatgccttctgtgtgtctgggggttttcccccctgaatattaagtaaagataaatctttccaaattttagcccaacttttttatctatactatttaatatgtaaatcagctatatacttgttcagtgtatgtctatctctcttcctgtctctccgtacatattttaaataaattttttcctgatgaaaagttatgagtggtcattgtgaaaatttggaggaatacaaaaagtagaagaaaataacagttctatatactagagttaacctttattaactgttttgtcatatgacatcaaaatgttatattattacctgttaaatttagtatagtatagtatactaaaacagtatgtttacaaaattgaactcactgtgcagatattacaggttttattcatgtaacactatagagtgtctattgtcacatgtcattcaagttcttctagagtgtgattttctcaggcacatattgcacagatgctctataactttttaatcagtcccctgttcttggatacatgggctaattgcaattcttcatcattctagaaagcactcaggtaaatatccccatagaggcaggacagagggtaaacatccccattgaggcagcagagactaagagcatgcattttgagattagacaagttacagttccaccgcttatttctttcacttagacaaatgattcacactggtctagtcatctatttctgcatctgtaataatggctcctgcctccatagtaatgtgaggatggaatgaaaagatgcttgtgggttgctgagtccagagccttcacatgttaaatataaaatgttagctgttataatttttatatgcatctctaattatttcctcaggacttattttaagatgttgaattgctgggtcaaggtatgtacgtgttttcaaggctcttaaatgatattcccaagtgtgtagttagcaaagtctgagggagactatgctacaccccacatctttgccatgctgtgtattactgttttgcatataaattattaacatttttaaatgtatctttttaaatttaattttgcatttctgtaattttgggtgaggttagactgtttacatatttattgctgatttatactacttttgttgaattgcctatttgtattcttagcctatttttctattggtatgttcttctttttcttaaaaaaattttttttgttttatttttattattattattattccgctctgttgcccaggctggagtgcagtggctaagtgttggctcactgcagtggctaagtgttgcagtgaggtaggaacctcctacctcccaggttccagtgattctcatgcttcagcctcctgagtagctgggattataggtgcatgcccccacaccaggctaacttttgtatctttttagtagagtcaaggtttcaccatgttggccaggctagtcttggactcctgacctcaagtgatccacccaccttggcctcccaaagtgctgggattataaggcgtgagccaccgcacctggcagtgtgttcctcttttgattacaagacctttttagatctatagactatattttcaatatgttttgtaagattattatttgtcttaaactttatggtgcatttgtttttgttgtcttatgactattttattgagatggggtctcactctttcacccacgctggaatgcagtggcattatattggctcactgcaacctccacctcctaggttcaagtgatttttgtgcctcagctacctgagtagttgggactacaggtgtgcaccaccatgcccagctaatttttgtatttttagtagagacggggtttcatcatgttgcccaggctggtctcaaactcttaagctcaagagatctgcccaccttggcctcccaaagtgctggaattacaggtgtgagccaccatgactggcctattttaaatttttatgatgtccagtctgttatcttttttctaaacgaattatgccatagaagaccttccccaggccaggtgcagtggctcacacctgtaatcccagcactttgggaggccgaggagggcggatcacaaggtcaggagttcgagaccagcttggccaacatggtgaaaccccatctctactaaaaatacaaaaattagccaggcgtggtggtgcacatctgtagtcccagctactcaggaggctgaggcaggagaatcgcttgaacgtgggaggtggaggttgcagtgagctgagtcgtgccattgcactccagcctgggtaacagaatgagactccatctcaaaaaagaaaaaaaaaaaaaaaaaaccttacccaatctagaatgacaaaaaccttaattttccttaaaatctgtcatgcaaagtggaaactcttctttttcctctaatacttatccacttgaccagtatccatataatgagtcatcttacccctttccactacttttatatatcaccatgtaatcattcttttatacatattgggggccactgaaggagtttttatacatatttttctaaagacaaacaaatctctttactgtatgtttttctgtaattctcaatcttttaaacacaccaacatttttcacctttttaatgcttaatttttctcctgattctttatattctagcaaaaattctcaaacttgtcctccatctcagtattactcatttaaaattgttgggttgattgtgattattattttgctgtttataatgcagattttaactttttgtaatggattttccaatgtctttattatctttacttatttaaatccttttatttctacttttcaggtataatctttattatttcagtctgctacttgttttattttgttgtcttggttcctggcatccatatttttaggattttacttatatgacagagctggtgttttctgaattatttttcagagtgctttggtctctgtattttttgccaacaaatattttataggattttttatcttctgtttaatcaaacctttgcttttaagctcactgtggatagattctccttgttctgctattttcctgattcctgttagaatcattatcttacctgatgattggaggggtattgtacataatttgagccaactttctggtattcttaaagctttcatttagtgaacctataagcctgcattgatttttcctggttttggtatttggtcatggtcctgggagaagccggatttactcctggataatctgaagcatgctgtggttcttcccttatgactctcatgtttcttctacggctctccttctgattcacttgccttgatataagaggacccccctccacttctgctctgtagtctgatttcattgcctggattataatctcatgacagctctgggtgccccagaaagtagcccccaaaagtgtgtttgctggagtggggttggggggttgcagcatggcctttcccccacacccctgggtggcttgggctatgttgttggtgggcagagggccaccacctatcacattgtttccccagctggattttcctcaggccttcatctaagctttgcctagtggatatcctggtggcaggagaatgttgactgagagcctaattttctgtgctgttaaacatttgtgtcccttttttgtgtgtttttaccatgatgataaaggactgcaaattcagcatcactgtttttctcgtcctgtaaccttttttgttcttcttcttctttttttttttttaaaccacatttaaagcaaacttagtaaaacagagaacacaatgaaggtattatacagcagtgctgtaaagcacggaattatagtagcatgcttcacccacttaccgccgatccagccatgaactatccttccttactctgggaccttgaatgtctgcatttctttttttatgccccttatttcccataccttttcacagagtggcataaataaaagcaatcaatgacttctttctgaagaaatcaaaatgctttatgatgatttctaagacctaaaggcttacataggattaagtggaaacagcccagactttgaagactggagcctactggagtaggggaaccatgagaagagcaaatgtccaattttgtctaccagtgaagggtagcagacaaaagatgacaggaccagaagatgatagactacttggatagaggattgatcattctgggagctagcaatacggctactaatcacaatcctgagtccccaaagaagaaacacagagatggaagctcacctcctctgctccagccaccatcacctttgcctgttgggatgcttcaggcaggctctcctaagactgggtcttgagccagtaagagcttttggatctcaaaacagaagggactgttagagataggaaatgcacataaaaagctggcattagcagttgcctctaccttttcatgtatatctgtttttttttctttgaattcttaacatgtgcgtgtattactttctcacttaaagagagaaaaagattaatttgcatacactataatgtgttattaggaaattcaagagtacataggtaactttcctaataatttcctccaaaatatccttcattttgtctgcaacacagtaatagactagatggcccttgggactgatccaagtgtgacatttctaagacgttctccgcttataaccactgcttccagtctgtgtcttctgattttctgaattcatgtgatagtaggttcaggaggaaataacattcattctgctttccccacatgatgccttttgtacattggattgctcctctagtttagatctgttttactaagcagcagtggtcaagggacatggtggagagaagtgtactgagttctaaagaagagtgtaaatgacgtctctgtggcatattcagatgccatcaggaagcttttgtaagtgaggggagcatcaggagggaggtgtggaaatcagcagcactttctgaaaatggtgtagcttgggaggctgtattcaacttagcttggattttaaatgaattaaaatggatgtgctcaagttatgagccttgcctcatcagtgctataaaaagccctttagccgggctgtaatttgactctcctctctaatgttacgcaatattcctatggttacagagcccgaataagtggaagctaatcattagtttgctaaatgtggttcatgcaacagttcacaactcccagacttgccaactgctgcttgttcagtttcatgttcactcttcttgggtagaagttggtttcttctttagaaaaatgtacagtaacatttgtctcacatccaggaaccatgcaggatggcagctctccatgtgtcttaggatggggagggaaagaggtcatgcaaagcagaggtttttgatacatactcttctgcaggaaaaagccattcagggagtgcaagatggcaaagacacaaattaaagtggcagacattttggatactgggaaaatcacattttgtgaacttttcagaaatttgctgtgatagaactctatggaatttactgttctgtagccccagaaataaaattatgctcttgggccaggcgcggtggctcatgcctgtaatcccagcactttaggaggccgaggcgggcggatctcgaggtcaggagttcaagaccagcctggccaatatggtgaaaccccatttctactaaaaatacaaaaattagctgggcatggtggcacatgcctgtaatcccagctacttgggaggctgaggcaggagaatcgcttgaacccaggaggtggaggttgcagtgagccaagactgcgccactgcactccagcctggtgacagagtgagactctgtctgaaaaaaaaaaagaaaaaaaaattatgctctttaggtttttccttgtttgtttcatgtgacaggaaagacttcattttattgctcagtgtcacctgcaaacatcatacaggtactgtgcctttgagagccacatgtttctgagctggggaccctttcctctctcataacccagtatgtgtcaggggaacacacggagagcagtagataccagctggatttgtgcccctacctggtgatgataggctaaatcctgaagccattcatgagtatttggcctctttctatttggatgaaagtggtttctttcccaggaaatagaaaatgtcttctgcccacctctgacttattttttttccagctgaaaggctgttggtcctgcaggaggaacagctttcttcattgatgtcccagaattattcttggagactcttcagaaagatgcagtctggtggctgcctccctttacctggtgcatcatttagatctctttgcattgtaaaaagacggaaatcctgacctcacctggcttaaggggaaaaaggaatttactggctcatatgataagaaggagaggcaaatacaagggttcaggatccaccatttctgcttatcttgtctctgggttgtcggactttcaggctctgtgtggtggcacctggcagttacataacctcctagtgcaagcccagcaaacagcaaatatctgttcgtgagtcctggagagttactctgattgggcaggcttaggtcttgggccatccctcatccaggcactgagtccagagagttgatatacttttggccagtctgtcctgaatctcattctccacccctggaaaaagtaagaaaagggttgctctccaactcaaaatgaggtgctatgcagaaaaaaaaaggactgggagctggtggcaaagaactagtctttagccagtatgagggagctggattctccctcctgtgcactgaaaaagactctgtgaccctcccaccagtatgtgtatgacctggcctgcctcaccagggacaggatggggatctgtgaagcaattacactccccaacctctgcctcttcttctcacctccttgtgtgctactcaggaagattataagaattatctctcctgttcttttatcatacatgcttgtttaaaatatactgatttgtttaaaagtccatgcaagaagagacaaaagaaattgtcagagctgatatggtggttctcattgcacatttgagcttaaagcaatttttttaaaaatacaaaagtaatggaataaaatcataccacagtccaccactttaacccaaccactaatttagagtatttcctttcagccttgttcatataaaaagttcatagaaaaagtttctcatagacatatcttgtttttttttatttgacattatataatgcaggcattttccatgttgctttacagtcatcgttgtcatataaatcggcgaggtaatattccatcaggtagacatacggtaattcacttaatcattcttctatcgttggacatttaggttgtctcctttttttgttgttttttctgcttttgcaaagaagagtgtgtgctgaacgtttctggggtctgtaacttttctcgtgccttatcttattttctgaggatagactgtgagaaatgagattactggttcaaagggtataaacgtttttaagactttgatacatattaccaaattgcttctcaaaactcttgcatttgtctctcctgctgccagcaggataggagaggatcagtttcactgcattcttgccagcaagagatattggaatttttagacattttcctaatttaataggtaaaaaaaatacttgtcatttttgttttactttgcatttctctagttactagcaagattggatgcctttatgtgtgcttatttattagttccattttatgctgtgctttatgtattgtcttttcttcattttagaccccaagactgcttctgagacagaaacagatatctgtgctgaatgggagataaagaccatcactagtgctctgaagacctacctaaggtagggactttccatttgcaaggcagagtgccagctagttatcatgcaatcaggaagaaagcagttttattttcagactccggagagctgtcgggtgggtgtttgagatgtggaaacagcttctgtgtgggtgcgtttagctcagctggtcaaaccaatcgtaaatcatccatagttgatgggttgcctttgtgcagtgacaccctgagtgatttaggaaactttgttctatatgagaagtattgtgataattagccatgaacagaacctaaaatggggtcttccccgaagtccctgaataatctgttaagaacacaaggaatcatgaatcatattctgttaagaatgcatgattacatacctcatgtattttgatagtttcatactttacacagagtacattgctgacaatggttcttaaaaatgagaacttaatggaactcctttttgactccttcccttacactggacaatattatttctctgcagagactattttccttgtatcatttatatatgatactactgtaccctctctatgcctcctttcattattaaaggttgggttattgaccagctgcctgcatcttagtttcatgaatagaccaaaatatttatgctggacttgaaggacaggaataccatagttcttaccaaaaaaggtgggacctagtcttaaaaggagaggggaatggtcatcagaaatagcataagtctctgtgcagattttttgaagatggaattggctggaaagcaaaggaaggaggccacagaaaaggaattgctgatgtagattttattggctattgggtaattagagtcaagagtaagatataatgtaagtgttaactaaaactaggagtcgaattaagggacccaatgagaataaaatctgagccaagaataatgtatagtcctattgagaagtttcttatttgaactatcaggaaaaaaccctcaagtttatggttaaacatactcataccccagcaggtaaaatttgtttatatcatacctaatgttaggggttctagcattctggagcaatactccatagtgaattcaccaccacaacacctacaaaaatcttttatagtgtttctagatgaattgattctaacaacaagccgctgggaagatcaagacttgcaaatatgtagttagttgcctgtttctcagacacatcttaaaatgctgttgttgatagatgagtcactgactgaaaaggaaatctcttagtttgtgttagactcttgcattagcactattttagtgttgacaatgaaacatagttgtatctattcatttaagaaagagagagaataaacattttgggtgaaatctcagaacgcttgcaatagggaaactacattgttattgtttccctgtgatctttgtcttcgagaaatgtattacagtttgtcagtctctaggctgctatttagagagaatatgattattcttattattaagctgactagcctatctccttttcctccagaatgcttccaggaccactcatgatgtaccagtttcaaagaagtttcatcaaagcagcaagtaagtcttttttgtctcagttttaaggggaagagaatagatttttctatttcaaagaagagtcagtatcccaaaataaatattacctaacccttcatattctgcacataaactggccacataacatactcatgagattctaacacggaataaaaaggaaacaaatagggattgctaagggcctttctaccacattgaatttacagcagaggacagaaacttcagaagtctttttttttttttttttttttttttgaggggaggaggatgttggagggatagagaaaaacaagtttgcctttctagttttgattattggagttctaacttcttaggttttttccagcctttgagtagcattttgcagaatgaatcagacattgcacattacctaaattgagcattggaaatgtttccctgaatatgacaccatttatataacttcacagtcctcttttccattatgtcttccatttacagcttctgatcattcttcaactatatcatccaggtcctggtgtcatattactggtattaaaatacatagggattaggtgcaagctactctaagtatactggaatctctggctacatgggtcaggcctcttgtaaaggggcagaaagattctctatcagatttaaatccagcatgaatcttcacagtattattatgtcgataacttgtgtctctcccgggttcctttcagcctttagaatttatttactctggtagctactactggcctaatttagtagtacctaatgttctggtgtccttatctactcatagttgtccccttaaaacaggaaggagaaagccaggagcgaagatggtgtttatgtcatttctttctagagaaattacaaacccatagcaaccattctctacttaaacctcacatcagttctataaataggtgtgatgagtaccatcagtctatttgccagagtaacaaagccacttaccttggttcaaccaagagaatgtgacaagccatgatttaggttacaagttggcagaaagacttgaatattttatctgccatttctttctttctagcaggctggttgtcatatgtgacttgaggatactggacatttcctttgatatctttgatgctgtctcaaggtgttattttgatatttgaaacccttgcaatgttgttcatgtaagatttgtttatcactttacaagtgcataaagttccttacttccttgaaatgaagtcttccctctagggagccagctactcctgagtttgttctcaggagcagctctgggtgtgcagttgactggctccatttcatcacatcatcatcttggctttgattttttgatgacaatttttttggcaaccctgttccagaaagcaccattaaaaggacttccagatctagtcatgctggccacgcagtatgcacacaagacaggattgtaaatctttgagaaatccttgggctgttagtgctcatcctttggtttcccttaatttttcaaccttaaagttgtttagctgtgacactgataagatattacctccctccttcctttgcagaactggagaaccaggagtctcgggtctctgaaatccacagccttgttcatcggctcccagagaaaaatcggcagatgttacagctgctcatgaaccacttggcaaagtaggtttaagaccaattactagcctttttcttacccctgaaagttcttatcttagcagtgaagctggtctcagttctgcttttgtttctctctcccactattgcatcaggtatgctggaggcttaggaaagaaatgtgtgaaatgttcattgcagtggagaacagcagcaaatgccagatggccttcccagaggatgctggggaagtgctcatgcaaccaggccaccaagcagagttttcagggggattttacctatggtgatcaagggcaaattggagtgtgttgtccatgataccaggtcaccacacagaattttgtgggattatatgttcttatgctcatcaagaacaaacaaaaatatgttgtgggtttacagaatttgggtttttagtaaagaggactggattctagagctgactctgttattaacctgctgcttaaccagccctgaacaaactgctgaactttctattccttagtttccccatctgtctaatatggataatagactcccctttttctacaaggatcattgatttttgaagttacatgcattaaagcctttgaagaagtataaagaataaaggaattatttttggcaaatactcacttgtcctctgagataatcaaagcattcagtagggacctgattttcttggaatggttttgaatatttgtgtatttactgttccttgaccctttcacaaatggcattgctgacttcccgtgctgcattcatcactacttgtgtgtgtgttctaaccttccgttgactttgatggtatgttcttgattgcagactggagcacaagaaaagaatgagagcataacagttaacctaaattattaaaccctacattctattgaactgatgtgttataaatttggcccttatagtccatactttactatgccattagggtatttcttggggataagttgatattcttctgagggagattgtaatggttagttttcatctttctgtcaagcacttgatattgcctttgggaaaaagagtgatatatatcatgaagatttccaccatttcctcatttccatcaagaagccaagagtgtcttgtgtgttattgggaaggaattcggcaaagccacagttgctccattattgaccaactttttttcttggctttccatatcagagctgcttgttcaggagtacttaggaagaatagcagataacatgcaagtttacaggagaatgccctaaaggtgtcaaagaatcccgatgaagcatgtttaaaataatgggaactgggctttaaaaagtaactccagatgctctgagatgacagttgagtaccagttccacacaacctagagtcaggcgtttgttaagcagagaagctggtttagatcttagttgcaaaactttgcacacttgaaggacaaacaccaagacatagaaggttccaggtgcaccctccagcctagtatgtgtggggatgctcatgactgcttcatggccatcgggtctgaaagaggccttcaggcctgcagagagcagctggagaagggttaggaaccatctgaaagccatgggccttttcaagctgtgcagttggaaggagagcttaactgaactgagagagaccaaaagtgaagggtgacccagcagagccagtgttgcgtttttcctacttttaaatttcctttaggattgttaggattctttaaagaagaagaaaaaaggatttaaaaaacaaaaccaaacccttaaggtagatcttgaacagttgaacttgttcatctcctggttggatgactcactttctcctccttttcccaccctttccccctccagtcccattacattcagtccatccttgttactaacctaagagttgtaaactggaatttgcaaatcacagttgtgaccttgacacatttttgtttttttggccttctaaccaatttaaggcaattttatttttggagttgtttacttcatagcatttcttgatcattgtcttatctgtgaaacttgagaatgattttctgtggttttatggcatgttttgatcatttaattatcaagaaatctacctgtagacaagctctcatgctgtaatgtgagttggttagagctagtattagactatagcagactcaaattcttagcgtgctgtgttcttgtctctcgagcctctatatttaaaatgtccctgtggagaaggatatgaatgagcagtgttgaatccagtaaagagtatttatttaggtctgaaaaaattctttggcatccagaggagttctaagattccacttaaactttatattctcatttacagcactgtccttattttaaaatcaagcagtaagggaaagttaacttgggacaagaggtttgtctgattccagttttctcaggtttagacttaccctaggctatgcctgagctattgttcctctgggctacttacttaatggtcagcttccttcctaagttttggtttcagggctgattctgctggaaaactggtgtttacttctcttattacttactgtttgccttgtgcatctcagaattctggttcaaaggcaagcattttgtattgtatattttttaaagtactcttttgaaacattttccaaaactgatttcccttagccacagagggagatttaaggcattttatatttaatcccagctaaaaattcattcagaggggaaaaaaagtattgggtggggggaaggataaaaactccaaacctctaaagcaaatgattaccagggtacatccaaatcacagagatgttggatttgtttcagacctcagagggaacataaaaattataggcaaccatgcacatatttttgtagtttcagcttaaatctactatgataattagatgttttctgtttggatcttggaatctagtatacagtctggagtcatgtgcctcaaagcatggttagaataacccggggcgcttgtttacattgacatttctgggctctgtgggtctactcagtcaggctcgctgcctgggaatctgcatttctgatttattttgcaggtaattattatgtgaacagtgatctaagaaccactggcccagagaatgggccatatgcaaggattttctaggacagagaaaaatgatattgagaggaatatggattgggatgtaggcgaatattagaattagaaagaagaagctcaaagcagtgagttcaaaagggagattttattgtcgtgattaaattagcttttaaaaatccagttttgactttccaagtctttgcaatttgactttgtgttgagttttcaacaaatgtttttgttttaaaatcatgcaaaaggcatttttacttttgcgtgatttagttttgcatgatttacttttgcaagaaaaaaatcattcccagatagctgtggatccttgtgccaatttttctacctctttgagcctcagttttctttctcttccaattgtataattctgttatttttatcaggtggagcaggacacgagaaaagtatcccactcttataatcatagaggaaataagagtagatgagtaataaagactaatttcatggtaatttcctaatgtttacatattatgactccaagtatgttgtatatccccacacataccattcgtagtggctcattgtagatttattaccgtgtatgcagtgaggaaggatttcaaagaactcttcatacatcaggagtagatattaaaaataccttttcacagctggttttcccaaaatacttattgagaaacaaacctgagtctttttccttttttggagcaactgttcctttgttgcaggggcattggagaggcagagcactgtcttgcttccccagagagatatggtatcatttaggatgctttgagctgcaagaaacagaaaatccaattgaaaatggcttaaacaataaggagatctgttgtgtcatgacacagaatctgtcctgagagttggttagtttctcagctcatgaaggactcaggttattttcatgttcctgctcagccagcgtcttgtgttggctagctcctcgcagagtcccagcatactttattgtgtccttgcatgttagtgcttgtccagaagcagaaaaggcattatttcttctctgagtccctttttaagggctaggatgatacttttcccagacatcttccagcacactttatgtcacatctcattggtccagagcagtcattgaggaccaccatgattattttccacccaacaagatttatctgagccacttgtgggaggattggatatcagaataaaggcagagctttgacagaataaagacagcccacggtgtctacagcaagtagtcttggtaaatcacattcaacagagagtattaagtctattgcatggtgtgctaacacaatcaagatatataggacaaaaaagaccaatttttgtaggagagatgagtacatctgcagtgtgggcacataggcactaaattacaagattttagctggtgggaggtaagagagggtaatgaagagggcaaaattgactttactccattgcctcttgctgattccctatgtgttcttttcattacccaattgtctaatgtttattttgatcatctgttatatgttgtgactttccaaaatggacaaaattctgtagatcactgggattataaaggaatattgtggggaaaatgcttggcatacaagtgagaccttatcaaaatatgtagactctgttggcagaattatcaagaattaagcatgttgtagcttgggtttttttttttttttttttggttcctgtgacttgagtctgagtacttccaggcatctctgcaaatcaaaaagggatgtattcatatttctttaatgatctagaaacagtgaattgggttcatatacaaatgcttgtggttataaaaaaaagtcttgccaggcattggcaccaaggaggatgagccctagtggttcagtagcattccttgaagttcttaagaagggttcaaaataaaagaaagtgaacattaatacttaacataagcacattttagatactctaatattccctctttttccatcccaaatctagaagataagatttaacttaccaatgagctgttaaacatgagaagtgctagttattcatttgccatcaagactagtccaaataaaatagccgtagaattttacaaaacacatttaaagaaaacagtatgttgtgatgatggcttagatggaaagctcctgtgagtttctctggctgccttccctcagccatacaccctggctccggaacctttgttctctctagtaaccactgaacaccgcagtgctgccagtgcaggattgcttggccgctgggccactggtggtatggcctgatacccccacgcagccacattgaccccattctccagtcctatcgggcttttccctcactgactcccaccgggaactcagagttctagtgattttaacccttttctatctcttgaatctgtctacttttctctgtctccatcagtactcctgtagtccaagctgccattgtgtctttcccacgctgcttgcgaaggcctcctccctattgctctggctggtggagctctggctcctctccagtccacagagtgcatgttgtgcttccagggaactttgaaaactgcaaatctcagcatgtgattcccctgcttaaaaaaacttcaaaggcagcttccccattgctcttaagataaaaccctggaaatggcctccaaagccctgtctggaccagacgtttttggaatttgcagtttcatcttgtgtctgtttctcatgatcaccatcctgttcctactgcatggcacacaatagacgctcatgaatatttgttgggcaaatgcatgaagagtctcttgaccgcttctcaaatacccacctccctgctccatccttttaccttttgcaattcattttctcctgtctggaatggcccctccccagcctctgcctgccaaaggctacctcattcttctagcttcagctcaaatgtcaatgtcactgccaacaagaatccttcctgccacaagtgccctcttgctttcctgagctcccacagcctttgcttgttcgtctcttttagcatgtatcacattccacctggtgggacagtttgcccaggtatgtatctctccctcctgtgacatcttaagctctcaggggatgggcagtctgtctcccttgtctttgtttcttacctagaagttacaaacgaagcccatggccagagcagcccacacatgtgtttggtggtggtggtatcctacacattactgttttgaaactttgaacaggtttccaacatctttaaagggggcgattttacttgaaaaattcgtatctcaccactgacaattggctggagctgagtagaagccacaccctatcccccagggtgtgccttctccagtttgccttagttcctaacagtccctgttgtctcttgctcccggcctacttcattcaggtctcctacctgcctggccgtgttgtaggcatttgggttttcaatccttgcctacctattggcttatgccaaaagaggagctcgatgtttggtgaatcacataaatgagcaagcagaaatgggctaagggagttacttccttgactggctctttttttttttttttctcctggaagatttattatttctgatagatgggaggtccatgaaagaagtgagtgataccgcttcctggcctatttatgggtatggggcaggaagaagagtgcattttttttaagactaagaatgggattctcaaaggaccttctccagctatttttggcagagtcaaaggaaaatctatttaaagggacattgcacagagcacaacgacatattttaaagcaaacagacaacttagcactttaaattaatggaaatggaaaggaagaaatcagagctcaacattatttagcctcaccgccagacctttgcttactttcaacccaagaatttgtctgttctgtggctttgtagcctttagagataggagagagaaagatatcagttcagtttaaattttttgccttaaaaaacccaacaacatttctgaattcaaggaactaaatctttcacatcacatgtaacgcccattctgaaaggggaaatgcttgacttcaagctgttaatgttcagcagtcttagagctcctttgatttgggtctcttgtttgttttgagttgttccacttatgtttggatttattttctcaataaatttcctgttttctgattcatctcttccttttctgagtccatggaatcccctcccaaattaagggaggagtgggaggaagacactctgtttttcttacttggtgccgcctttaattttgggagtattataaaagtgagagagtatcagcaaacatgaacatgactcagtttcttccttgctaatcctagcagagcttagatttcttatacattggccttgggagcgtgttcttcatgaaatgcctctctttttggctgagtggtggtggataaattgattcgctcacactgttttgggcactggagtcctctcttgctgcatcctctttgaattgcatcatgagtgttatctgcgatacttatgttcttacattgactggttactcaccagctcttcagaacaattgtggctgaaacgtggcagctggcagacttctacgtatatgaagttaatccatggggcataagagcacagtggtgaagagagaacattctgtagccaaactgcctgattttgatctcatctcttatgtaaccttgcatgtgaattatttctctctgcctgagtttcctaatctgaaaaagatgataataattgtatcagaaagttttaacttcgcacatcaggttttcttggcttctcctgtttgtattgcagccaccactgagatgaccacttctgtgtgggctccgctgcccttcctgcaagtgcagcctggtagcctggagcctcatgcctgcgtttcttacctcccaccctagggaggcatgacacaaaatggcattcacacacggatacgctgggacaaggggaagttaaaaaactctgaggggaaaacctttggccagtgggagaagggagctgagtatctcagaagcaattgttcaacagcctctttgaagatggtctcaagagattgagcaattgtgttagtgcttgaaccaggtggggtctagcttctcttctccgcctcattcccccaagaatcccctggtaaagtagtgtcaggtaagcctttatgtacagtcatgcgccacataacaacgtgtctatcaacgatgaaccacatatatgacagtggtcccttaagattatatcatgtttttactctatagtttctatgtttagctatgtttagatgcacaagtacttcccattgtgtcacagttgcctacagtgttcagtacaaacatgctgtgtgggtttgtagccgaggagcaataggctataccacagagcctaggtgtgcagcaggctcgaccatctatctgggtttgtgcaaatgcactctatgatgttcacacagcaatgaaattgcctaatgacatatttctcagcatatctccattgttaagcgatgcgtgactatacttcaagtctcttctttctggaaaacctaaagtaatacagtaatagtgcccacccttttagagttgtgcagattaaattaatctacacaaagttcttagaagagtgcctggcacataatacaccttccataaatgttaatttctacaatctgttggagaaatccgggaacgggagaaagaagatgatagagctggttttagggtatgggaaattggggcagttgttgaaaccaaaataagtcattcttgctgactagatggggctttcttcatagttttgttattggcaagcaaaaccctgagggctggatgctgaaaacatagcacacacagctcttgtccacttgggagatttctgtgtgtgcatgtgtttatttttgccttgcttgtgtttgcttagcagtttgtgtgcatttggcccaaagggctgagcatctctcccttcctagcagaagatgagccagcacaggggcagctgggagaaagagctgttcatatctggtttcaggtcctaccttattgcaagtctcacacttccctgtgaatatcagggctcttcgtgattcaaatgctctgtggggtggtgcacctgtttgaaggaacaagccacgtagggctgatttccatggaggttacctccccctccccctcctctgcccctccccctcccgcttctgcttcttggtgtcgcaaggctgatttcatctccgatgcagctgtctttgctagagtttaataactcttaatttcctggagggggatggcgcgttatatcatgaagactcatctttgtctgcgtggtctggaaatttccactcatctttgtgatctttgagatgtttccctttgtgggggagtctgactttccttctgttttactcagtttgactgccctctcagatgtcattcccagattaaacatgaccatccactgtgaaaacggccctcttgaccttccagtttccccctgggagcagtcttcacatggatttcctttcccgagttactgaaatctgtattgaagtattaatctatactctaaagaaggtcatgcctatattcagcttcattctgttttggtagatattttttcacttttgcagtttcagtccaagaaagggcttgaacaaaagttcagggggtttgaattttggtatcagtcttttctgcttccacacatacacaggaaagtttttcttccagcagtttagcatcctgatttatttcgtgtttccaatttggtattataagtcactattcttgattctcttcagtaggcggtaaaggaacacaaaatgttgggtcttgttggtgtattgcaagcaggtcttgctatgtacttggagatgcctagaattgggtagaatagggtcactattttattaaagtcagatattccatgagaaaatggggcaccctaggcctcaaaaatcagtttgtatattagttctttggctgtaagcaacagatgtcaactgtggttaatttaaaacataaaaacagggtccaagagcagtggctcatgcctgtaattccagcacttggggaggccaaagcaggcagatcacttgaggccgggagttcgagaccagcctggccaacatggtgaaaccccatctctactaaaaatacaaaaattacctgggtgtggtggcatttgcctgtagtcccagctacttgggaggctgaggtacgagaatcgcttgagcccagggaggcagaggttgcagtgagccaagaccatgccactacacttcagcctgggtgagagagcaacaccttgtctcaagaaataaaataaaaaataaaaggaataaaatttattgaaaggctcctgggtcaatcacgtaatggaaagtagaattgaaccatcagacatcgcaaagcaacctcaagggcgcttgtggtacctggcatcctactacatttctctaggccatttcttctcttctagatgatcatctcagatgttgcttttcattccacagagaaaatagatacaatcagaagagaacttctgcaagctaccaccacaatatccacacctgtgcctatgtttctgccatctctcctgtgcgacaggggaacccagtgctcctacctaaaggcattccctttcctgggacactagagccgattgactccccgttggatctgtaaggacttgggtgcttgagtagtttctccctctttcttctacgccattaacttttctgtctctactaaatctttcccatcagcacataagcatgttgtaatttatgcaatcctttgaaacatgagaaaggaaaaagcaacaactacaaagaatctttctcaatcccatatccccttttaggtactatcccatttttctgtgcttttcccagaagaactcaaatagttgtctgtgcttgctgttcccaaatcctctcttcccactcattctttcttgaacctcaggctttttatgcacactagtccactgaaatgcctcattatcagtattgctgatgacctcatgttgctgaatcaatttcagtgttcccttccttaattgctctgaaggatttaacacagattcccactctctcctccttgataagctttcttcacttggcttccaggacaccatactctcctggttttcctcctgcctccttgacttctgcttctcagtcctgtttgctatgccccaggactctgtccttcaggcctcagacctcatctcccctcctgccatcctctctccttcccaatgaggtcttcctcgattgttttaagattgcagtctccagctccttcactccctacctactagaattgcttaattttttcccataaccatgtcagtatctaatatactatatatttgatttgtttactcgttgttttcttctccccgaaatgtaagctccacgaggttggcaattgctgtctgctctacactactgtatccttagcaactagatcagtgcctgcactgctcaataaatatttgttgaataagtgaatgagtggaaaatatccaggtaactcatgggtagcccttttcaagcactacctttatgatgtctcagttccaactacctttgtccccttgtgaatctgctgcaggttaacattcctagtaaaaagagttataatggtctctcctgggtaaggtccccacatctgtactaaggcggtagttggggactcacctgtctttcttgataggaccacatgtaatgggagaaagacatccaactggaaattttccaaggaaaaattggatgccatcattcaaaagatgccaaacaagtaaaaatgtcagctgtttataggagttgtgcttgctgaaattcagttttttgccttagagaattcctgttttatattagaagtttcaggtcttgttacaaattttaactctgtgatggatcttgtaagtgcctcaatagccctattatgcatcattatgtggaagataagaccatcatcataataaatacaaaacagcaaacagcattcagatattttcctaatacttggttacacagcttggttccccagaagcctgattctgtttttttgggagctagcacttcccaaaggcctgggctcccttcacagcatgtcttcagatgtcccctgggcccagaattgtctccagtggtgtttggtggagtgccgatggtagcttcttggttcaccagtcctcagaatccagcacatttaaacctgttttttttaagtcaccaggcaaatgtgggggggttcccatgtcaaatatgtctctcaggctaggtggttagtcaggttttcttgttctctgtattaaaagataatcttgccattttgctactttaagaactacatttcccttcataatagaactgccacttaaactgctttgcatgctacctagttatgagcttcccttccaaatgttgtctgtcctacaaggtcattctccccagccctaaccagattgttaatgaagcaaagaacactggcaaacatgtagattatcccttctttgttatgttattaatatatagtgactcttgacataaataggcacatacctacgcataaatttaactaagacgattgaaaacttctacaagagaaactacaaaacactgatgacagaaattgaagagaatacaaacaaatggaaagacaccccatgctcatggatcagaaaaatttatattgttaacaggacagcactacccaaagcaatctacagattcagtgcaatccctatcgaaataccaaggacaggccaggtgaaggggcttatgcctataatcccagcactttgggaggccgagatggatggatcacctgaggtcaggagttccagaccggcctggctaatatggtgaagctccatttctactaaaaatacaaaaattagccgggcatggtggtgtgcacctgtagtcccagctactcttgggaggctgaggcaggagaatcacttaaactggggacgcggaggttgcagtgagccaagattgtgccactgcactccagcctgggtgacagatcttgacactatcgcagaaaaaaaaacaacaaaaaaacagggacattcttcacaaacatagaaataaaaagtcctaaaacttatatgggaccacaaaagaccgtgaatagcaaaagcagtcctaagaaagaacaaagctagtggtatcacactacccaacctcaaaatatactacaaagctgtagtaaccaaagcggcatggtactggcataaaagcaggcctatagaccaatggaacagaatagagaacccctaaattaatctgaatagcaaaagcagtcctgagaaagaacaaagctagaggtatcacactacctgacctcaaaatatactacgaagctgtagtaaccaaagcagcatggtactggcataaaagcaggcccatagaccaatggaacagaatagagaatccataaatgaatctacacatctccagccagtttatttttgacaaaggtgccaagaatacttactggggaaaggataatctcttcaataaatggtactgggaaaactggataatccacatgcagaagaatgaaggtagaccaccacctctcactctgtacaaaaatcaactcaaaatggatcaaagtcctcaatgtaggacccaaaacaatgaaactactagaagaaaacacaggggaaatgcttcaggacatttttctgggaaaagattttatgaataagaccttaaaagcacagtcagtagaagcaaaaataaatgtggcccaggagtggtggctcatgcctgtaatcccagcactttgggaggctgaggcgggcagattgcctgaggtcagaggttcgagaccagtctggccaacatggtgaaaccccatctctactacaaaaaaattagccaggcgtggtggcatgcgcctgtaatccccagccacttgggaggctgaggcaggggaattgcttgaaccagggagggggaggttgcagtgagctgagattgctccactgcactccagcctgggcaacagaacgagactccatctcaaaaaacaaacaaacaaacaaaaatttgatgtcaaagtcccattgttaaaagtcttttacacaacaaagaaaacaatagaatgaaaagaacacctacagaatgggagaaaatgtttgcaaactacttatctgatctattatatacaaggaactcaaacatctcaacaggaaaaaaaaaaatcccaatacaaaatgggcaagtgatctgaacaggtatttctcaaaagaagacagatggcctgcaaatatatgaaaacatgttcaatgtcactaatcatcagggaaatgaaaattaaaaccacagtgaggtatcatctctaggatgactattatcagaaaggcaaaaaaataaatgctggagagaatggggagaaaagggaggtcttatacactattggtgggaatgttttccatagtacagccactgtggaaagcagtatggaggtttctttaaaaactgaaaatacaacaacatgatccagcagtcccactactggaaactattccaaaggaaaggaaatcattacattgaagagacatctgcacactaatgtttcttgcaccactattcatgataaccaaaatatggtaccaacctatgtgtccagcagcagatgaatggataatatgtggcatgtgtatatacacaatggaatactattcagccataagaaagaatgaaatcctgtcatttgcagcaacatggatggaactgaagaacattatactaagtgaagaaacaaagttaaatactgcatattctcactcatgtggaaactaaaaaaggtcgatctcatagaagtaaaaagtagaagagaatacatagaagtaaaaagtgaaaaaagaagttactagagactggtaagagtaggggaaagggaggatagggaaggatttgttaaagatacaaaattacagctagataggagaaatatagtctagtattttatactactctaggatgactataaatagtttcaaacagccagtaggaggatgttgaacattaacaatgaatgtttgaggtgatgcatttgctgattaccctggtctgatcaccatacattatgtgtagcagaacatcactatgtaccccatgaatatgtacaattataatttgtccattaaaaaaataaaatttaaagaagaaattgttttagtaatagttaaatctgatcttagctgaaacttaaggcaaaccttttacaaatatcttggtgctttttgctccttctaatttagttcctccttaggtgatgaggggaatccaactgaattcctaataaactaatccataaaggacccagaatagtgcctcattttttaaaaaagtttaaaggtaagttccaaagcaaaaattgtaagttacatgccagtaactttggcatgtaaggaggctgtccttgtatccctgtgttctttgggatttgacagcttgttgaaaactatactctctagtgttattgataaagttgggagcatctctgattaagctggctcagactgagccagactgaggtaaaggaatgggtcagcccagctggcatcattcattttgccatgtattaatatattaagtaattgctatggaaaaggcactgacttatctatgaggctaattatttatttccctattggcggtaggggagagcattggcccagcaggcaagaggttctaatcctggtttttactaactctttttatgtatgatcttaggctaatgtaccaggccttcagtttcttcatctacaaaatgaaagggattacttttgtatttaaaaagtatgtacacacactgcagtcaaggaaaactgtctagaagggtagccatcagtatcttaacttgggttttcttctcctggcttctttatttttgaatttttatgaaataactgtgtgtgctatttaaaaagttgtaattattttttaatgagaggagcagactctgtgactctgagctcccgttaacttcgaagacatctatgattttatacagcaggactgggtaggacaggacagtcaatccttggttattcggaaacagaatcccttttgtctgcttttgctccctgacttttgtctgctttttgctcatttgcatttttactggagagtaggcagcagagagaaagaatacattttagcaatgtagaaatggtggtaaaactttttatcttaaaaaggtttttgtggattttttttcattttaactagtattgctaatgacttttaagtacaccaattttttttctgacttccttagacattaattagttaattagtgacctttcctgttatatagaactggtttaaaataaaagaaaaataataataacaaactgtattattttgtgtgtgtgtttctgcattgtttttgtcctacttacaggtactgtaaggatccactgacttttcgtccattatagaactttctcttctcttttacttctccttcatctatttcagtctgtctggtatcctggcctttttccattaatctctctgcccaggtctgctagagaaggggttggaacactccattgctggttcttgtatgacctataagctaataatttttcttaacattttaaaataattgagaaaaaaatgaaaagaagagtaatacttcatgacacatgaacattatatgaaagtcagatctcagtgttcataaagttttattggaacagagccatgctcatttatttatgtgttacctatggcagccttcgagctaggatggcaggttgagaagttgcaagagaaccacatggcctgtaaaagctaaatatttactctctggtcctttagagaaggtctgccagaactcctatacttgagattccttttccattggatgtctcagacctaagacatgtttggacttgctaactcattcagcagctgttatatcacatgcctacagcatgccagacacactgctagacacaggtatccaaagatggacatgacaccttctctgttaggagggaggagctcacagcctagagggtagcatgggcctgtccacaggtgaactacactccagctctgtgtgctggtgccaaggtgtgagataggtgctggggaaactcaggaggaggactgtgactgcctgggaggtgggaagagaagtgggttatcattagataatggatagcaaaggctagatagcctaaagctgcatgttttctgtgctggttactttttaattataactctagaattgttccattaaagttaattgttacctagaacaagagttgtcataattttaacaagtgtgcctttaacatttcaattgcacattaaaaatattcctctattatagggtcaacattttacagagctatgtaagtaaatattatgtatagtgattttagtttcttatcaaaatataaatataaatatatataaatataattttattaaaaatatgtataaatttattttaacagttgctattggcaaaggggaatagacttttaggtcaaaatagcaattttcatttgcttttaagtttttgagtttttaaaaaaatgtttctcagaacatttaacaaaggcttaactatataccatagtagggacgtttggtttttgtataaaaaggagatcactgggcctcactcaagatttcctgaattataatggtggggataggcatgacatgcagggatttctatttttaataaactcccaagtgatttctatttacactaaagtttgggaactactgctaaggacaatattgattaaatgtgcatttttaaaattgttattaactttttaatagttatgtttttgtttttgaggcaaggccttgctctgtcacccaggctggagtgcagtggcgtgatctgagctaactacaacctctgcctcccgggctccagagatcctcccacctcagccttccaagtagctgggactacaggagcacgccaccaggcccagctaatttttgtattttttgtagagatggggttttaccatgttgcccaggctagttttgaactcctgggctcaaacagtccacccacctcatccttccagagtgctgggattataggcatgagccactgtgcctggccttgtttttgtttttgttttgaaacaagctctcactctgtcacccaggctggaatacagtggcacaattacaggttgctgcagcctggacctcctgggctaaggtgatccttaccctcccaagtaactaggactacaggtgtgcgccaccagacctggctaatttttttttttttttttttttgaaaagccagtctcattatgttgcccaggctggtctcgaactcctggcctcaaactatcctcccacctcagcctctcaaaatgctgggactacaagaatgagcccccatgctcaagcttttctgtcatctctgtcagcccctgaagtatactgcactttttaaaattctctaagacaatgtaaaggaatcctgattgtccaaaatgtgcacagtctccctcttctccctttttttattttgaaatagagcaaaatgcacaaaaaataatttggagcatacatacttgtatgttttgctataatctttcatgtatatatttatatgtgtgggcatatttatataacagctaacatttgtcagtttgttccttatccccaaatgttaacattggcatcctcttttggcacaccctgttcagttccctttgctctccagtggaaagcattaacatgaattttagcatatacccttttgaactatgttttgatactttaaaagggattattttgtgtgtccaaatatagacgtctggtatttgtatatgtgttgtaattttcataaatgctatcagggtatactctaatttttcagcttggggttttcattcaattttatttttttgaggtaaaaactagttcatctctttaaatgctgtgtaaatatgccacacgttatttatccctttcctcgtattcctaagtgcactgataggtgcttagagttgtttctaaagtttttaacattataagcaatgctgcagtgaacatccttgcaaacatccttttgcacatgtgtgagttttagtaagatgcatacctacctaggaatggaattgcatagtttttctagatagtgccacattattctctgtcatgactgaattggcttatatgcctgatagacttttcattttggatcgatggctagatatggatacagaatacttcagatggcacttaatgtgtcccaggcggtgctctaagttctgtgaatgcctcaggtatgtgggcgccagtatttcccatttaccatgaactgtaaaagagtggagcaggttagctaagctacaggtcttggagtggaggctggtggaattgtgttccaggccaagaattggaacagcttggctgaagacctggaatatcagggaagaaaaagaacccaggaactgaaggattaaatatcttcataggattacagatgggctgatgttgaaccacccagagagatctgacatagaaaaccccagcaccggttcttctcattgtcctcactggggctttggcaggtcctgcttatgataaaatgcaaaggctcttaaccctctgccacaagcctccctaaaaagggctctaccacctcagaagccaagcagcagcagacagaactcataaaaggctcaccgtagatgactaggactagggctcctggcttaagcaggtcaccgtggctatggggtgccaccatttctggcttgcacagatgacagggcgctgccagcgtctttgtggaaagtctctcttgaggatgggtctgaaatgtctgactgttgtgagcaatttctaaaagtaaactgtgcaatcaaagagaagtctgtctttctgaccttgggtctgcatagctattcggaccacctagagggttcgaaggccaagagtagggtggggctgtagctgttggtgcctaggctcttcttttctgggatgcagactgagcatatctcccctcccccaaccctggtttccaggaatctccttaagcccctgattgcctctcacctttgctgccagcctctaaaggccagttcatctctgcatgccctctcctatattctaccaccattgaaatgaacaaactattgtattttctcaccttctgtgagtggacaggaagaagggagggaggaagctagcaggctagtcaaccaagaaagaaaaaccttaacaaagtttaggttcctgcattacccagccaatcatgttacgctaactcaataaaaaatgaagtttcattgcagggaaagtaagtcaggacaccaaaatgatgtgttagcagggctgggcctagggcgaggcagaagagacacctgggtgcaaaattgaaggaggcaataacctgcaaccatcccgagagtgagtgagggcctctttaaatgtggcctgggtgtgtctcctgtctaactctagtcctgcccctgctggatttcaattccgattttggttttttattttggtcagtatccagacctgagtgtgtccgttttattccctcggctgtggacactgatggaccgtgctagagaagagattgattcagtctgcttttagtttgccatctcagactacatctggaattttatagcagttgggcggggtgggggaggttttcagataatagtattttgtttcagagaaaacttttcaggaatgtgtcttgctggtaagcagagacaattgacaattgcttctctcctattaacatcaataatttaaacctgtcctagaacttaaattataattgaggcaagaggcagatattcagacatattcattgaaagctggcctgtgtccaactgtggtgaaataagacaggtgggtttgattggcctaagaggtggaaaaatcaactttagagactttcttagcatctgagctctttgggttcttaaatactttcttgatggctgactggtgaaaccggtggttatggtagcatcactaaacatacatggcatttttatttcaagaaaccaaacttccagacatgcacctgatatcttgattgtgctctgcaaatgcagagtaatttccagctggatcagtaaaggataatattggctgtgggaaaagtgctaggattattactttatcttatcatgtgtttaacttttcctttgttttcacataactagtctgcagaaggcctgtctctccctcctttaacttgtgctctcttgggagtgcttacaagctttgtcatgtctgagtgcaaagtcagtttggaaatggtagagggatgggagggcacaaaggatctatagagttgggcaaccaaacaagttaggtggaggaagcctatgaaacattttttttctcagacatctactgtgaagtaagcgctttctcctttggagactgctagagcagaaacctccccatttttctccttctctgtttccagcgtcctctatgtgtctataaacacctttgctaccaggctacgattctttggtctttgtagtcggcacgggagaaaggcaggcagggagatcacccaggaagctccctttgccttttcagagttaacggtgctgtgcagctgatttgattattacatttaactgaaaaaacctgcagggtgtgccagacacgggacaaccagcctggtattgtcggccccatacaaacccttctcactgtcagaccggattaaacgaacatgtttttaaatatatttaccttgttcaggtcttggagcaagcacttgcttcatctcaatgactccttgggatattgttatgtgtacattggacctattttacctgtggactcgtttccctatagccttagcatggtaacattggtggaaattgatccagtggtgcagcgtgcctagggaaagtgagcttgtttgacagaagctttgcagggcctagggagaatctagagatagatgagatgcaggattctcctggtgcccaaagcctaggctcatgttgcctcacatggtcttctccctctttaaaagaccaagccagctgtcacatagctccagagcatctggatggggaggatatactggggagcctcaggagtatgacctacctctggatagtgggggaccttacactattcaaacacaagttcagatggccattctagtaggtgagtcctggtcactcttttgcctataagatgggagctgacctttatatgtaggactgctaggagcctttcacttattcattcttcaaatatggggatgcctattatataccaagtgctattctaggcatggggatatagcagtgcccaagacagagtccctgctgtcttagagcttaaagttaaattgaggcaagatgcagatatttgcacatattcattgagtacctactccggatttacgacctgtgaatacagtggtaaatttttttaaaaaatagaagtatagactaaatccattataaagataatttcaggtggtggtaagtgccctcaggtaagagtaagcccaagtattgaggatggacaaggagctgtgttaggccaagtggtcagggaaggctctctgaggaggtagcatttaagccatgacctgaatgaagtgagagagcaaagccctgtgaagaggtagaggaaggttcctccaggaagagggaacagcaagtgcaaaaaccctgggaaaggcacctgcttggtgtggaaacaccctgggcgtggtcacggaacagtaagatctgtgtggtacaagctgagtttgcagagctaagcaggggccagatgaagtggtagcttggggacctcaggaagaagtttgaattctgttctaattgtaatggggagccactggagggttctgagggtgtgaatggcacaatctgtggtgagggtgtttcttttcccaaggacacccagttgctctatggcaaatgagctgaacaggagctagtgtggtgttggggaggctgaagcagtagtgcagatgaaagacactggggcctggactagggtagtagtggtggaaatgctgaacagtgggcacatttgggatatatttttaaagataaggccaacaggattaaccaatgagctagatgtgatatgtgtagggaagggggataaaggatgactcctgggtttttggccttcactgggggagaaacggaggtcttgtcttgttttattgttgtggtggagtgggtgggtgttggggtaaagacaccaaaagttctactgagagctctcagcatacagattattctttcttgtatatcaaccacaggactgatgagatcactgagggcaggtctgtggatagaggaggagaggagccaggacagagtcctggggctctacagcatttagaagtgggaagaggagggtctggcagtgaagatgggaaggaacagcctgggatcagagcagagcctttggctgtattctagtcaggactcacaccatagagaataaaataaaatcaaactctggaagactaagcacgctgtttggggaatatattacttggttgctttaagacaatgacctatgttttccattgatgtaattggaaatggcacagttttgaagagtggaagtcctggagtcaaacagacctgagttcaaattccatttatagcacttaccagctgggggacctccagaaaattacctaccatccgaagacggtgaaaacagaggtgtccttgtttataaaatgggaagaataataggatccatctcagagtcagtgttgtcaagattgagttgatgcatgcaaagtgcatatccagtttctggcatggagtaagggcttaaaaatggtagcttttgctgggagcagtggctcacgcctgtaatcccagcactctgggaggccgaggccggcggatcacaaggtcaggagttcgagaccatcctgccgaacacagtgaaaccccgtctctactaaaaatacaaaaaaattagccgggcgtggtggtgggtgtagtcccagctactcgggaggctgaggcaggagaatggcatgaacccgggaggtggagcttgcagtgagccgagatcgcgccactgcgctccagcctgggtaacagagggagactccatctcaaaaaaaaaaaaaaaaaaaaaaaaatggtagcttttgtctgagtaactctttctctggatctgttgctggggacgtttgagagtttggaatactgtattttctactttgcatttttgggtcttgctttgctatttataacttctgtttagtatctgttgctggctcttagcatagtgataatgccgtgattgcttcagccttgacacttgtcccaccccccaagacaataattatgtcaccctggaggtgttaggaaaaattcttctaggatgaatgaattgagcattctctctggactgtcacaaaaatatggagttgtgtttactgttcccatccagaaagaaatgctctcatcactatctgtccctgctcagaagtcatgaggaataacaatttatgcccaagaatttatgaggaacataaaaaataataaaattagtttgaatttgttgaaaacctgttatatgtcaggtgctttagatatctggtatctactatcattgcagaagtccccaaaagcaaaaattgggatttttaatttacagaggagaacactgagattcaaagttacataccttgcccaaagtcacactgctaccaagtttcaaagtcaagaattgtattcatgtttctggctgagtcttgagcctattttgttctcactatactgtagccgcacataagcgtaattacagatctgaaaccaagaagatgggagttgtatatagctcactttagacatacctctccttctaaagtattttatttctctttgaatttcataaaataagattattcattttcaaatcacaaaagcctaactgatgttttcccatggcttctgtttaaaagagttttccttttctacagaacgtcacgggtttttgagtttaaaaatgaagggaagaggttgatgtagctcatttttattttggtattcatagctaaatatcatattctttaagcaaagattgtcactgtagagtgacattttgcattttgctggaccatatcgatgagttagagctaccaagaatctcagccgagtataatacagcagtcgaaggcagtctctatgtatcttggggaagctagagctggagactttttcttcgtcttcttcctttttctttttcccattagtcacaggtgtcattgtttcctagctatgagctagtttacattattaggccacggatcacttcctctggaaactggtttaccatgcagatatgatcctaaaattccggctgtatttctgctcaagcatacatcgcagtaaccggcctaatgatcagttttactcctgccaaatttatctttgtctcgttttctccccctttgctccactcaggcataccttgtgagatgagagagcaagtcttatgtctcttaatatctccagcatccattctgttgaccacatcataagagcacagtaaatattttttgagtggagaagaatttcctgtttaagcttttttacttctttttgttgttgtttggagacagagtttcgctctttttgcccaggctgaagtgcagggacacaatcttggctcaatgcaatctccgcctcctgggttcaagcgatgctcctgcctcagccttccaagtagctgtgattacaggcacctgccactacacccggctaatttttgcatttttagtagagatagggtttcaccatgttgcccaggctggtctcaaactcctgaactcaggtgatccatccacctctgcctcccaaaatgctgggattataggcatgagccactgcacccagctgcttttttatttcttaactccgattcaatatatctttctcccatcttatatctcagacttatccctctaataagaaaaccttgagatacttcatttgcaaaggttgagtttcaagtcattatattacgtgtcataaaaattaaggcatgattttagagcaaacagtgttcttcaagataagaggagacactctttagttctttccactttaaagcatctgcaggctctcgccgtccacgtcattgacttttatatgatgccaccagctcatccggatgcattcaaagtgtggtcaaaactataattgagtgggaatttaacaaccttcaaaagactctgccttaatgacccgactgtaggggacagattaattttcagtaagatttgggatcataactgtggtcacagtattccctgccattaaaacttaatcctagtttaaaaaattaaaaaataagtttttcactatatgctattaaaatagaaaaaagagaacaagaaccagacagatttagctgtctgtgcccagccatgagctctagattctcatcactctgtgctgattgattggcaatggctcatagaaatgaatttggaatgcatggaaaagctgctcaccctctttttgttcccttgagcggaatgcatggggtgcttatgggaaatctggcagaagagcaggggaaggtttatggcctgagtttccacagatttggagggaggcgtgtttttaaccaaaagggagccctgccctttttactgccctacttacagggaactctgccctctccagcgtggcatacaaagacatcttgtgatctggacactgcttcctctccagcctcgcctgtctccactccatgccaaaggctcgctgctttgggaataaccagctgcttgtagggcacacagtcacacctctttgcctttgcttatgccaacatctccgttagaaatactttctccgctgggcgcggtggctcatgcctataatccccacactttggtgaggccgaggtggaaagatcacgtggtcaggagatggagaccatcctggccaacgtggtgaaactccgtctctactaaaaatacaaaaattagctgggcgtggtggcgcgtgcctgtaatcccagctactcaggatgctgaggcaggaaaattgcttgaaccagggagacggaggttacagtgagccgagatcgcgccactgcactccagcctgggcaacagagcaagactccatctcaaaaaaaaaaaaaaaaaaaaaaagaaacgctttctgcacgggtagagtttcctctccctcaccccatgcgttgtgcgaattgtggtcccggccccggaaactcttgattcgcttgtttttcttcctctctgttagaggacaagcttcttgatgataggccccagtgtctatcacatcatttgtcccactcggcctggcctgcagtaggtgcttcatagaacatcctctggtggcagatagtaggggagacattcaccagttagtctcatatacatatgtgatgaaaaacagaggcagagcatagggtctctaatttggggataggggaggtgggtaatgtaaagaaattgagaaattagttgagaaaaaagagggggacaagagggaagagagttccagttaatggcatgtgtgaaggcaagcagtgtcacaggagtacagagaggaaaaggtcaaggtacagattagcttaggagaacgcgacagaggcaataatgtaactgcatatgatgatgaatttttaagccagataattagtctgagttttataactaggcaggcaacactgaaagtcagagctgactctattcatgctgtccctgtcccagactttgaggatagcggcagcagatgcagagcgctccacagcattggttcagttaaaccaagtgtttatccatctggttggatttgagtgagtgccaaaagttagctgaggattcccagccctgaagtggctgtgggtacgaggaaggaaacaaacctccttaaccgaaagaatgtcctgaatttcaaactcattggaaaccatcttggttgctcagattgtcttactttttaaaaaatggtttcttataatatttaaatagttttagctacattttccctattatgcaaggaaaggtttgacttcctaaggctgatagatttcccattaataatttttttcacaaagaaacaaggcaaaacccttgtttttatcctagtctttgactgtcagagctggcctttcagggttccttatggtatctgctaatggtggcttctatcacctgtaaaagaacaggagttgatcagatcttgtcatcagatatgatgataagaaaaatgttggaagaatgtttttctctccagagtatctggaaaaagaattattccagatggctatattaagttgcatatagccattcaaggaactagaaaacttccagtcccctctggcattactaaaatgacacaaacccattgttgatcatttttctagaattttgactgtgggggaaataaacttgggcctccatctttatttttagagtcttatacaagcaacttttgccagcacacttggttgggttcctgaagagatgagaaagtaagaagttgcttcaacgagccataaattgggaaataaacttgggactccatctttatttttagtgtatcatgtaagcaagttttgccagcatacttgtttgggtccctgaatagatgagaaagtaagaaatgacttcaaggagccataaattctaatcctgggttcctttcaccttggacattctagtctgaagagtgaaatgctcactgctctagggtttattagctggagattgagccagtctgccttgtattagtcaagatgttttctgtctttcttagcacttaaggctgctggtgagatgctttggctataaattttcttgtccagcctaagtccacatcttgagtcttccctctcgctcaggggtcttattactacagaactaactttagttgatatggaggggggccactggacatgactggttcttccagcactcagatatccatgaatgtctgcagccacattaaagttttggatcctccccgcctaccccctacctccactgtctcaaatatttattgatatcgcccatttggtgcagctcccgcaattcagtctgctgagttttacgagcttgctagatcatgttccaaaaagattcccaagcactaaagtgtttgccagggtccttgacattgtgactcatgtgtgttatcaggggcctcaaatatactatgccttaagatttgtgcagaattcagagtgtagtcactacctctttagagtccagacttctctgctaatgaggacctgctgaggcatcaagacattaaatatgattccttacatgcattcaaattaaggtgttgtaagcctcccctgttttctcacactgtgggaagccagagctgttgccacttgtgctataagaacttggttctttcattggaattaaaggaatttgcccttcagcaactataaaaggatgagtatctaactgttgtgtttgtttggaaagcagtttagtgccagacaggcatgcctaatagagttcaggagactgcagtccctcctaacccttttgtttactcatggccaaatttagtatatgccagcccctaacatctggcactgtgctccccataccctctccattgcagccatagtagccttcgagttcttcagacatgctctcctcctctgaccctagggcttttgtctgttacctatgccagaatactcctcctcatctaattaaccctggcccattctttttttttttttttttttttttttttttgagacggagttttgctcttgttgcccaggctggagtgcaatggtgcgatctcggctcaccgtccacaacctccgcctcccaggttcaagtgattcttctgcctcagcctcccgagtagctgggattacaggcatgtgccaccacgcctggctaattttgtatttttagtagagacggggtttctccatgttggtcaggctggtctcgaactcctgacctcaggtgatacacccgcctcggcctcccaaagtgctgggattacaggcatgagccaccacgcctggcctatcctggcccattctttagaagagtgagtccttctcaaacatgaatcacctgggaagcttgttaaaatgcaggttcttcattagggctggaagggtcctgggatgtggcacttctaaaaggtctcacataaagctggtgctactgttcctcacggaatccttccctagtcttcagttaagtcaaaagttccccattttatgtgcttctgagattatatatctgtccttcatagggcattcttcacaattgcatatttccttttacttgtgccattttctgattaatgttcatcatttacactaaactgtaagccctatgtgtgcagtgaccacctgtgatctttgctcacgcttttgttttcagaacttgttatagtgggacatatacggttgtactatatatgtactaggatatacaggtgagtagatgatggttgtattggctgttgacagaatggttaaatatgttgttctgagatgccatgatgatcataaaactcaggggtttggaccaaattgttaaaaaaaaaaagtggttatgtctttattattttcaaggtaaggacctcctataacatttaaatttcatgtgaagcagaaagaacccaagataatctgagactgaaaaaaactcatgataatgctgtaaataaagtttcggtgccgcaaaaggaatagcactcgaatataaaattttctttataattctcagcaaggcaagttacttctatagaaggctgcgaccttacagatggagcagcggtgagcgcacactttggcaagggaggggaaggggtttttatccctgacatatgtgatccctgccgctgtgtcgttcccctattggctagggttagactgtacaagctaaacaaattccgattggctaatttaaagagagtgacggggtgagtggtttggcgggaaaaatggttatgacagagcagataatcggaatgagtcagggggtagcaggtaatgggaatgagtcagggtggagcaggtaattggaatgagttagggtggagtaggtaatcggaatgagtcagggtggagcaggtaattgaaaaaggttgctttacgaggaagttaagtttaaaagtagaaggcaaataattgaacatactgacgtactgattctttgaaaataaatttaaaacttatatctaacaatccctcctcttgcatttccttacagctttctttttaaactttttaacgtgtcttggcttagttgttttgctggattttccaaaagaagaagcttctctggataaggtggaggatagttaagggaggttttagtaagtgccatttttatgagcctctgcaccaacccacggatgcatagtgtgacacagcacccgacaagaataagtacacccattatggctgcgagggaagtaagaattgaggctattattcttttccatttaccgaactactttctattcatgctgtaaaggggtcatttacccctgagttgttggctaactcattggacagagcagtcagaccttgtaatgcctttgttatacttccatcaggggtggtggtgttttgggatgaaggtacaacactgagttttaatcacgatacaaactcttcctctttttgctactatcatgtctaaggctatcctgttttcccaagccatctggctagtggcccctaattgcttagctattcctttaacaacatctctagtgtagttagtaaatcactgttggttgtaatagatctagtttatccaatctacatttttattaattttcactcaccaaaatattgactcaaattctgcagctattttatttcgggcttgaaattgttctggtattccccatgggactctaattgtgtctaaatagacgtaagagttgaaagacccataagggccttctctcgcttcacgatgtcttatttttttctttttctggttgatgaaatgccagggtgaaagggatagccaattggactaaagcataagtgccactccagttattcggcagagtgtccagtaaaggtccaccacaataccaccacacatccgtttggggatgaacaagggctgactgattgatgagctcttgaaaattcttaagctcactgcatcctttcaggtctccaaggaacactaagtttcctccctgtcgtgaacttagtgttgggagacggaagctggatggcccttgggggctgacccgcagggtgccggacttcgggatatagcagagagagagcgtggcatgacttgttactccaggctgtagaatcctgggaaagagctaccatgcagcccatgcccggttgactggaggaccaccctagtggaaaggggacagtctgggcctctggcctgctgtgcgcacaagcataacaattgcttttgtttaacgtgtgaatagaatatttgatccattccaaccaggcatttgcatcttggtatcctgtcttaattgccaaagtttgttttaagtctttaacttctacgatagctatctcagtcgtgtcattagatggagaaggagcaattgttcccttgtgagaagttttggaagaaggcttagaggaaggtgcaggtggcgggggatcaaagaaacgcatttcaaataatctaatagggtctgtccctgaaacctcagcccccatagaagaagggaactggcttagaaaagggggagaacttgagggtttgagataataacctgtgtagaattacactgggttagctgatgggggagggctgtccctctagtaaaatgaatgtatggttttaggaaattgcaaaaacctgttggcaattcattcttgctcttcagtggtccgcagaacattggaccaactacatcataaaagctttacattggggagcaagactcctggttgatactggggtctttatcgaaatctccccagattaaatggtcccaattcactaatgcccagtcttaggagactcaggagggacagaggtacttttctgaagtagagagctgtctttgacttggtcagtccccacagggtataacaagacaagcattaaatgcaatagtttgaggcaaaattgacttggttatgttaataactagatggtcagcaatagagcgagtaaagaaaaaagagtaatagaatagatgaatgaaagttaaatttcttagctttagtttggtagggttttcccctgggactatggcccacgactctggagggggcggcgctttcttgactcgggtgtgatgagtccatccgctttccgctgtatgaacagcagtctcagtggttagcagcacaaggtagggtccttcccaggctggcttgagttttccttctttccaccctttgatgagaacatgatcctcaggctggtgctatttaccagaaattctagggttggtacctgtgctaaaagacttagttttgcgggaaaggaaagtggaagataaaccaagtatataatttctaagaaactgatcttttgttttaaatgtggggacatcagcagtggactttatagtccttggtacctttttactgagaaatttcctttagcacctatttttattagtttctagaccaaagaaagccaaacaccattttatatttgacagtgcttcctgtatgacttttataccagataaactaaatttcacctttatattaatgtgttattaatgttaaactcaattttaattaaaccttgttgacatagttatccaattttaacatctgaccataaggtaagatttttatagactctttttaaccttttataatttttgttaaagagcaggttagtgctttaagaaagacctgttgtgcttttattttaatatccagttcacggaaaaactggataccactttaactttagccaatatgtttacacacggaatttcctttacaatgaatgtttcaaaacttgcttaaacctttaaaacaaaatatatatttttaaccttttaatgtaggtagaaatccacattcttatgcctccttataatccttttaccaaagttttattttactttccttatacaccttgcacataaactgtttcttcaatagttttacattcaggaggcctaattacttttaaattatacaatatttcttgcataaattcccttttataactttttttcatgacttttacagacaattcttcgacatgcctcaactttctgacttgttgcaaacatccctttgtttttttttttgttttttttttttttgagacggagtctccctctcgcccaggctggagtgcagtggcacgatctcggctcactgcaagctccgcctcccaggttcacgccattctcctgcctcggcctcctgagcagctgggactacaggcacccgctaccatgcctggctaattttattgtatttttagtagagacagggtttcaccatgttagccaggatggtctcgatctcctgacctcgtgatccgcccacctcggcctcccaaagtgctgggattacaggcgtgagccactgcacccggccacatcccgttctttaaacaaccagttaatttattttaggataagaattcaccatataacattcctttttacataaattctcccccccccacctttttttttctcaaaaatgataaccatgcttttccaaagtgaacttccttcacgtaggtggactagactgtctaaggccacaagattagaagttaggataatacatgttacactgttaacttttagcaaactttacttttgttgaaaaccttttaagtttgggatttcaattattctttgctattaataagacctcgttcagtccatattaacttagaattggtatagatggctctttcctgattcagtaagcactttaaggcttgactgagtgcaaacagctcccacgtctgagcagaccaattattaggcaattttcctaactctgcttcttcaagagtttccttatcacttactgaatacccactgtgtctttttccctcaatcaccggggaggaaccatctatcgtcctgtcctgaagggagttcctcctaggtctgctcggacctttgtatggtaattaagatttagatcccctgttaggaaacctgctgggttaagggaatttttagtggttaatgttaaatcatctttttctaacagaatagctttatatgttaaggttcttgagtcactaagctacctttttgctttttttttttttggacttagggtagttctgatctgatgaggtgtgctcacaatgaggtttcctctaaaagtctttttagactttctgctttcttctgttagcaaagcagttgccgctacaggttgaatgcatttgggccatctgcgggttactaggttaaagatttttgataggaaggctactggttgtcagtggcctcagtgctttcgggccttgtttacactgacaacaaggtggtattggagtgttatagggtcaggagaagaccttcaattatcaattataggttttaaatttaccctggattttaaaggaatagggtacactgttttctctttactatttctatctctctctctttctttctctctttgactttctgtctctttctctctttgactccctctttgtgtctctctttctctctctctgcctcactctttctctctgtctttgactccgtctttgtctcctcctctctctctctgcctctttctctctttctttcctctctctctctctttccccctttctcctctctgctagtctttccctgcctctgccaaccacttatgctactgttctcccctctccttccccttcccctaggggagggaccagcgggagtggagctactctttcttcctctgagaagaaaggaaaggggggttctgaatatttttcttactaccagagatttttgtgaggttcaaccccacaccatggggatttctcacctcttttagaggttcaactcccacttcatggggattactcgcctctttttgaggttcaacgcaccccatggggatttctcacctcttgttgaagttcaacgcccccccgtggggatttctcccctgtttttgagattcagctcccacctcctcatggggacttctcacctctttttaacctccaagacatcccgactaaggaatacttcaccaccactcccccgcccccgcggctttctttccctaatcccgactaaggaatgctttaccgcccctgcggtttctttctccttagtatgtcctaaccaaggaatgctttgctgcgtggtgtctttttccttagtccggaccaccaaggaaataccttactgcctcccgtggcatctccttccttggtctgtgcacagagtcgttgccacagtatgtgaggatcctttaagctaggttgctggtcagtttcttttttccctcgcgttgctgagagctcaggttattcctcgcactgggtgggtcttgatttctcacccctgaggctgccacaagggggtggggtgcacctcctcacgaaagagaaccagagaccgcccccagaggggaacgtaatcccagagcagcccctaattgttatatgtaaagtttcagtgccacaaaaggaatagcacttgaatataaaattttctttttaattctcagcaaggcatggtacctctgtatagaaggatgtgcccttacagatggaacaatggtgagcacacacttggacaagggaggggaaagccttcttatccctgacacatgtggcccctgctgctatgtcattcccctattggctagggttagacagcacaggctaaactaattccaattggctaatttaaagagagtgatggggtgagtggtttggggggaaaatggctatgacagagcaggtaatcagaatgagtcagggtggagcaggtaatgggaatgagtcggggtggagcaggtaatcggaatgagtcagggtggagtaggtaatcaaaaaaggttgctttaagaggaagttaagtttaaaagtagaaggcaaagaattgaacatactgacatactgattatttgaaaagaaatttagaatttatatctaacaataaatagactcatgtctcttggttttaattctgtgaaaggaaattgtgccatatcacctggacttttgacttatgggttctaagataatatattcttacatatatacattcattttagatatattcatatattcattatatattactatataatatatatgtataaaaacatatatacacagtcacatacaatttttttattgaggtgaaattcacttaacataaattagccattttaaagtatacaattcaatgggatttagtacattgacagtattatgcaaccattccctctaagtcaaaacattttcatcactcccaaatgaaaccctgttcaagatactatattcttaactcagcagttctaaacctttttgtctcagcacctctttacgctcttaaaatttattaaggacttcaacagcctttgtctatgtggattctatctgtttatgttttacagtattggaaattaaaactaaaacaattttaaagctttatttatgaatttattaaatgacattttacatttttgtaaatctccttaatgtctgacttaatggaagatgactggataaatcatatcttctttttttctcaggctggagtgttgtgctgcaatcttggctcactgcaacctccacctcccagctgggttcaagcagttgtcatgcctcagcctcctgggtagcagggattacaggcacccgccaccatgcccagctaatttttgtatttttggtagagatggggtttcaccatgttggccaggctgtctcaaactcctgacctcaggtgatccacctgcctcagcctcccaaagtgctgggattataggcatgagccactgctccaggcctcatatcttcttcttcactcaatctattgtcatacaaaaatcagtcctagcatatgcatatagtcggaaaaggaagaaatatttttagtagccttttcagataattttggatattctttttttaaaactctaccaacattcaacaagtggtaattttttaaaaaaattattacaatgtgaaaaaataaaatcatgttagtgaattgttcacatgcagttacattaagatctattgacctaccttgtactttgagtggatcttttacttatgcatgattttttcttagcctacattgctcatttagaaaatattagtaaactgcgttatgcagatcttccaatgcaaacatattacatcatataacatcaaaaaattacatttgttaatatcaccacttattttaaaaagtcattaaatattgggaagttgtcatgctcgtggtgcagatccagattttctaaaattatgacgttttcttgaaagcataaattttatcattgcaacaaatattactgttttccttaaagtagacactcacttggttcatttctgagaaagtgtctgccaaatacccaagtgtcagtaaccatattttgtctgtcagttattcttttacgtttacatggtgtttcatgaaaaaagaggttcagcttgcaactcagtcgcacaactgctttccctcaagtcaacttcagtatgcagcagaggtgctttatgcacctttcctccttcgttattatataaaaggtgtgctaaagggtcaggattaaataaaattaataattttgctcatttatcaagtaaagctaggctttttttttttttaatctgtgagtgtgtagcagtgaagaatacaatgactattggtataacttggtaccactgtctagattcatgcgaagcatcacagttcaacttatcttttttttgcatctcatggaacccctgaagggtgttggaaacctccccgtagttaatggaccaacagagaaccactgtcctaaagaaaataaaaatcacaaaatagctttgtatggcctagagaacataatatcctcattctagccacctcttaaaagaagcatgtctgggccgggtgcggtggctcacgcctgtaatcccagcactttgggaggccaaggcagatggatcacatgtatctccattttctggactcaaatacagaccatgcgcggtggctcatgcgtgtaatcacagctctttgggagaccaatgcgggaggatcttttaaggtcaggagtttgagaccagcctggccgacatggcgaaaccccgtctctactaaaaatacaaaaattagctgggcatggtggtgcgtgcctgtaatctggggtggggcaggggaggcggctgaggcaggaggaccgcttgaacctgggacgtggaggttgcagtgagccgagattgtaccactgtactctgcactccagcctgggcaacagagagagactccgtctcaaaaaaaagaaaaaaaaaaaaaaaaaaaaaaagagcatatctgactgtaaagtacaaatcagagggaaattccctgtgagtacattcaggtaactttacctaattctatagaagtcgtcatttaccttcctgagaatttgacaaattctgttgaagcagagctaatgtgaaaattgcctcatgcaatggccgggcgcggtggctcacgcctgtaatcccagcactttgggaggtcgaggcgggtggatcatgaggtcaagagattgagaccaccctggctaacacggtgaaaccccgtctctactaaaaatacaaaaaaaattagctggatgtggtggcaggcacctttagtcccagctactcgggaggctgaggcaggagaatggcatgaacctgggaggcggagcttgcagtgagccaagattgcgccactgcatgccagcctgggtgacagagcgagactccaactcaaaaaaaaaaaaaaaaaagaaaattaccccacgcaacctactgatgtctaagattttttaattcagatgtctctgacatatttcatttggtgacaacgttcagtgggacatattttgtattggttgtaaaagtctggaggtttttttaatgaattatttgtagaattccaatttttaaaaagttgtagttctgccttggaatcttctcagaattccatacagtttttactatacagaagaactcttcctttataatagcgctgcctcaattttgttctacttgagaacctaattaaataatttggagtttcaagcttagaattctcattttaagcctcctttaaattcttgttctacagctgtgcttgacatatttgaccataagttctaatgttagggttcagaccatatattcttctttaatatttacattggatagcataactgttaaatggtattttaaaaagccaattccttctaagcatacaattccgcaatgtcattttaacaataacataggtgatttttttaatttttaaattaaattttgttatattttgtacaagtatgttactcttaatggtgaattcaagtttgacttaaaaccagttcttgggaataattagtatgggaagtttaattgacagtaaggtcagcatgaaacaacagattgatcaatctaccctcaaaagctagtgtaattttaatctacattagctgaattattttatctagaaaagagaaagaccaattctttataatattatcaacagtgggtagacatgataggaaaacaatattcagcccataatattgcaaagagaaaaaaacatgaagattggacttgaatcatggatctgttctttcttagctaggtgacaaccttgctaagtattcaattcctccgagcctcagttttttcatctttcaaattggagtaataacttctccctcatagaaaatgaatttaatagtataacacatattaagaaattaacacattgccttaaacttgatgaacattcaataaatagggttagtgttaaagtataactttaaaaatattttttaaacatgactttgtgaaagtatagtatagaataaacacgtcaaaggtctatgaggctaccagtagaaatagaaagtggcttcaaaagaggacagcagaggcttgtttatatgtccaatgaaagacacaatgctgaaaaaaggtcacaaagtttgatttaaaactggttaatgttctgtagggcaataaaacctcaacttttgagattatcttttctgctggacagaagttatttgcatctctaccagacaaaaataatttgcaaacataccaattttaacttagtttgatatctatctttgcagaagctgagtcttcattcatagtaaatagcgtaagttaagcaaaacttacatatccctaaaaaattatattcccagaaagtaaggacctaagctgacaacatagctgccctgggcaggtggggggcacaggtagaggaatatagaattgccagtgttggttaacttggatttcaaaaccatgtgagaatgagggtgagacatggggaccacttgtggggtggaagaagttggaactgagaccctaccttaatcagggatccttgacaggcctcaccatcattgaaaggatggacgagataaaaaatctactttctagcacagggattcaatagggaatttatttttctatctcagcctggcatctgtaaggaaatttgtaaccacattcaaattcattttcgcagtgtcactcagtgatacctcttgtatactcactctgtgtgcacttaacctgtgttatttaggatttccataagtgaagttcctctgctgataagtccaaaattataaacacacaaggaagtaacccaccattagctagagtggtggcaatagcgggaagcaatgtgggggaatatcaaaacccaagaacttcaagaataaaatcataatagaaaaattccattgagaccataaaatagttatgtttcaaaaataaaaacaataataagggattaaaaccaaaagaacaggcatatttgaaagaaccaactagaaggtacagaaatttttaaatattgttgaaattaaaaacatagctgatgcaataaatatcagactaaccaaagtagatgcaagactgagcaaacaggaaaataacttcagacaatttgccagaatgcagtccagggaaataatgaaatagaaaacacttgaagatacatgaaaggcagtatgagaaggtccaaaatatggctatgggagctccaggtgagactagagcaaatgggaagaggtcatatttgaagagaatggctgagaattttctaaaattgagagacgtgaaatatcaggttcagtatcacagccacttctgaaaagaaaaataaaggtaaataagtccacacaaatactcatcctagagaagctgcagaatacttcttgtatacacaaagggaaaatccataaagaacaacccttgaataataaataagagccaaacagccatggcctacattgtgtgggaaatagcgaaggaacatccagtcactagccttatccttggcaccataaatcctggtaacactagcaagttaaatgatgcagactttcttctctgctgtgaaagtagttttacaccaacatcccgtagatgtgggatttacaactggacattgtttcttgtacttacggtatcacctctgattttcagcttaatcacctcccgtggtgtgaatttgggaagcgtagcttcctttcttccagttttaggttttggacataaaacccaggtagtcactgcttggcagtctccttagggactctgctggctttgtgggcaggaaatgaagtctgtttaccttaggcatgcacttgattttcataaggtgctcctttgcttctcctttctagtatgaatgggtacatgtatctccattttctggactcaaatagaggccatgcacggtggctcatgcctgtaatcccagctctttgggaggccaatgcgggaggatcacttaaggtcaagagttcgcgaccagcctggccaacatggcgaaaccctgtctctactaaaaaaattgaaaaactagctgagtgtggtgacgtgtgcctgtaatctcagctacctgggaggctgaagcaggagaatggcttgaacctgggaggcggaggttgcagtgaacaaacattgtgccactacactccagcctgggcaacaaagcaagactctatctcaaaaaacaaacaaacaaacaaaaaaccaaagagttctgaagccattcttcacttgagaagcatcactgagaatgcgtcatatgccagaacacctctctcttggatcattgcaagagagttaggaaggaatgagaatgagtctggcaggaaggatgcatttttagagatgagggcaaaacagaaaattactctggttcgagtgtgtcatttctctttctcataattttttgtttcactttcagtgctggggaccaacaggtctcttgatgtagggttgtggccccatacaccttctatttctgctcagggagtgggccttaaatgtgtctttcctgggccttcatacagtcctcactctttcctttggtttttattaacaaaaggtgattgttttcttagctctttgggggtgactccttctcatcaggtgtcaccatttctgatttttttccctctcctttccttagcatccaaccaggcagtgctttggtgtttgtcagatataatgctcttcaggtaatatctttctttaattacttttcccttcttttttttttttaatttccctgaaacagacacacacactgttgccttgaacaattgcttcctacctccctctctctgggaactggattaatttttttgtcattgcttaatggaaatgtcgacatttcaatttctgctgcatgttctacacaaaatttaactggacaagatagggagagaagctggagaagggaaagttcgtcatatgacataaaagctttttttttttttttcttccataatggcttagagtgtgccttccttaaaaagggggaagcagctactatggcaacaggttctattttccttaggggctgtggtggcgctgatagaactggagtctggagaacatgaaacaatagccaggagccccaggagcctgcagcatgttttttttgtagtaattactagccttttccatgattcaaaactatgtggtaagtggaactgggtaggttggtggtggttttgtttctgagtgatatagacagcaggaccgtgagtaagggaccctctctacatctcacagagaacccgtacagtgcgcgcctggctggggagactgctctgctccagcccagatatccctccctcttctcttcacttcctgccttccaggcctggggctccctcctgataaacttcagtctgttccactagcaagtaccagagtgtgagtctcccctggcaggtcttcctagaaatgccacctccatttctttcagaggtttcccttcattaaagacctcagtgtcggccccaaacatgcagaaaaggggtgcttgtttgactctcctagaacaagttcttatcagaggcaatctttttcctcccctaactcagaatgctgatcctcataaagcttgagcaacagtgcttggttctgctaatcactgctggacccatgccggtcacacaattaaaagttggcgtttgggactttgtggcctggttacacccctgtgcctgttgcgtcgcccatccgggctctagggagacagagactctttcattgcacagctcatgaaataccagaggagaaagcttgctttcttaccaaagcattcttcactaataacgttctctgcatatactccaatcctgcctctttgaaacttctgtttaaattagttctcctcctccttctccttatcattgtgctttgtacagcccttgataattttcagtacttttttcacctcccttgcttgctttgtccttacagcatcccagtgcctctatgaaatagaccagggaagaggcagcacaatccatttttggtctctgtggtagccacaaacgtttatataatgcctcccaagtgccatggtggagtctggtggagtctgcccagcttcacaggggggatctgacatctcccaactatttttcttccccatgaaaatttgtgaaagatatatggattataaacacaaggataccttaataggtgtagagctttattaaatttttaaaatgtagaactaaggtgccatccttgcctggtatgtcgtcttctttacctgttcttttgatttgctttgctgcagactaattgtgcctgggaccttaaaagtcactggatcagtagacatgggaaaaagttcaatatcattactcttcaaagaaatgaaacttttaaaagtcaggaaacaacagatgctggagaggatgtggagaaataggaacgattttacactgttggtgggagtgtaaattagttcaaccattgtggaagacagtgtggcaattcttcaaggatccagagctagaaataccatctgacccagcaatcccattactgggtatatacccaaaggattataaatcattctactgtaaagacacatgcacacgtatgtttattgcagcactgttcacaatagcaaagacttggaaccaacccaaatgcccatgaatgttagactggataaaaaaaaaatgtggcacatatacaccatggaatactatgaagccataaaaaagaataagttcatgtcctttgcagggacatggatgaagctggaaaccattctcagcaaactaagagaaggaacagaaaaccaaacactgcatgttctcactcgtaagtgggagttgaacagtgagaacatatgggcacagggaggggcacagcatacaccgggacctaacagggggtagggggaagaggaggataaccttgggagaaatacctaatgtagatgacgggttgatgggtgcagcaaacgaccatggcacatgtatacctatgtaaccagcacattctgcacatgtatcccagaacttaaagtataataaaaatatatatatatacacacaatggaatattattcaaccttagaaaaggagatcctgctatttgttacaacatggatagacctagagaaaaaaaaaaagagagaaatgaaacttaagataaaagctttcaaaatagcaataccttattttggtgctagtgaaagcaccaaaaggaaaaataaaggtcctagggaaatgggcatattaaaattttctaggtgggaatgtaaattgacatagatctcatgggtgacagtttggtaatatctattaaaaatatttatgctggctaggcacagtgactcacgcctgtaatcccagcactctgggaagccgaagcaggtggatcatttgaggtcaggagtttgagaccagcctgaccaacatggtgaaaccccatctctactaaaaatacaaaaattaccctgcaggtagtggcacgcacctgtaatcccagctacctgggagacagaggcaggagaatcgcttgagcctgggaggctgaggttgcagtgagccgagatcacaccactgcactccagtctgggcgagagagtgagaacctgtctcaaaaaaacaaaacaaaacaaaaaaagtatgccctttcatccagaaattctatttctatgaatttattctagggaaagaaagatatatgcacatatttgtgtacatagagattcactgcaatattagtggaaacaataaaatattggaaacaatctgactgtccaataacgggagatttctaaattatcgaatacccatacagtgaaacactgtgccaccataacaatgttgagtgagacaatgaatggtacttgaaaagttcatagtaatgcagtaaaaaacaagttataaaactaggtgtctgcaatatgattccaacttgatttgaaatatgagtgtgcgtgtgtctgaaaaaaacatggaatgtgacatgtataccttaaaacattgaataacatttagttatttctggatggtagaatcactggtgatttttattttctttgtgctttgtatcagttattccacagtaaatactttcatttatcagaaaataaaagagaaaacatgtatctttttttccccctaatgatagcactgaaagaaagagtaaagggtaagctatttaaaaataggcctaatcggctgggtgtggtggctcatgcctataatcccagcactttgggaggccaaggtgggcggatcacctgaggtcgggagtttgagaccagcttgaccaacatggagaaaccctgtctctactaaaaatacaaaaaattagctaggcatggtggcacatgcttgtaatcccagctactcaggaggctgaggcaggagaatcgcttgaacccgggaggcggaggttgtgtgagccaagattgcgccattgcactccagcctgggcaacaagagcgaagctccatctcaaaaataaataaataaataaataaataaataaataaataaataaataaatataaaaataggtctaacctaaagaccaaactgacattagctaatgtcattacatgattctgtcttaacgaagatagaagcattttattgcataagttttcttctgtgtgtgggaatcatatgtgggtgtatatatgtttaaggggtatgcatccgggtagacgtttgtgtgtggacatgtgtgtacaggtatataagtacatgtgtcatagccttggtacaggtctcatagccttgcagcactgtgttcctggcgggagtggcatctgtctgcatgtctgaaaatgccacgtgtgcattctgctgatcaccaaggttcgtggctgtaggcatcctctcttcagtgcgtcagaagtctgaagaacatgtagctgcaccggggcgttatgagaaagtaacgtgtaggatttattaactcatttcttgaagccactcactgtttgtttttaagtaccaatttttattttccattgccaaatagagaagagactttttttggtgagtacaagtatgagtgatttttttttttggtcatttttataatgaactatttgaatcctgacttttcgcagagtagcaggactccctgaactgtgtttcttcctctccccacaagtttaccaagcccaaagggtctttttaaagggtgactttttcttttgttgtttgtcttgtttcccacccttacttaatgattacttagctctttatataatccagctaaatgctggtacatagcaacaggattgtggtgtggctttctccttgatgtaaatttctggaagatggccttctgtatggaagactgagcagtgggatctattagtgacatgtttttgggaggagctgcttcctaaatgggttgaggctgcagagatgggcaggaggagcagccagaagccacagggtgttcgcatcattgtgcgggtaaccacatggtggcaacgattgcacagcttccagttgtacttagcagctgttgacacagacttcagaattcccatggaaaaggaagtgaactcctttggaatacaatgcattgggctttttttttttttttttttttttttgaggtgatgtctcaatctgtcacccaggctagagtgcagtggtgcaacgtcagctcatggcaacctccgcctcccgggttcaggcgattctcctgcctcagcctcccgagtagctgggactacaggcacttgccaccacgcccagctaatttttgtatttttagtagagacagggtttctccatgttggtcaggctgctctcgaactcctgacctcaggtgatccacccacctcggccttccaaagtgctgggattacaggcatgagccactgcacccagcctgggcttcattttaaagtggtctcaggcaggcattgctgatgcttgtggttgaagatacaacttattattgcctaggtgtatgagggtgtgatttgttgtctgcctctaggctgtagacttctggactgcactgtttgattaatgggctcagctcacaggtctcttccctagagaggccttcctggcctacctaagttggtcctcttaggttttgtcatatacctctgtttgatttcttcatggcacttctgtaatctgacatttttactgatgtatctgtgtgttatttgccgtcggaatgaaagcagggatcttgtcagtctcgttcacttctttatcccagtgcccagaagggtgcatggcatctcataggtgttcagtcggtattgggtgtgagaatacttggtgtgtttaggaacagacagaaggccagggtagttagagctctgtgaataagagcatggtggtatgacatgaggttggaggggtcagtaggcaggggctggatcgtataggccacgatgaggtgtttagatttgctcaaggatctggtattcattaagtggtttcatctctgtagatttatatactctccagattggtctgctaaagtcagttactgatggcttttctgctgggaattgtgcatcattctgtccttgaagtgccactgtagcctacactgtatttctccccctatctcagctgccatcagcttggccttcttcacccaccttttctgttgagccaggcaaagcaagatgacagcaactaagatgtcaggctgtgatgcctgcacaatagaaagcattttagaactttgtcattaaacactttgacttcccctttgaaaaatatctgtttaggtttgggctttgtgagtgactcttgctgagagtgtgaatgttgggtggatcagggacccagatctcgacttcactctgaatcgttcggtgtctttgttaccagacacgatctgctcttctctgcctaatgatagttggtttgctcaccttggatctctggtttctgttgtcaaccctgtattttaaaatttgctttcatggtagcagaattcaatgagtttccagctttgtgccacctttgaggaggataaatcaggttttgctttgcatgtgttgaagtaagaactttattggcttcattccctgacaaatctatttttgtgattaaggcaataaatataacagaagggtttgtgtgttcactctaatcctcacatgtaccactatatataaacactgttattttgtatggatgaataaataagaggaactgttgtatcccttaggcttgaacttacattgaaattttaggagataatgatttagtgcagcaaggagctaggaggtgttgccacagagtttcaggaggagagggatataaaggtgtaatcaattcagattgtttctaacttttatggattgtgaagatttgtattcctttttcagtggattccattcattagcgttagacatgtaaacatatggaatgtggatgtactataccagtaattttcatggatgttagagctctaggatgtttttcaccttttaccgtatgaattgacctccagaactttcccatggggtctcagctcttgtacatgaagagcataaacttttctggacaccatacattactgttttttttctgtcttctaatcaaatatccaaacataatctaaaagtaccgtgacaggacatataggtttgtcaattccagtcactttggtagactggcccttgaaataaagctaacgttttcaacttcagcctcccagttttttttcagacttatggcagggaatgtaattttctgtttgctttttggggtgaaagtacattccatttcaaaaatatgccagtcacatgagttatttccctcatttaaaaaatccccacaaaaggagataggttacctagggtgggtatttcatgagtgtgtgcttctttatcagtctgtccatctctctgtaacatttcccatgaacccttctgtggatttggaatcttagtccttccagaaaggattatggtcatgtccatagaagctgcaatgagatttacatctcttgggaagtgacaagctctcagcgcaagctctcagcgctgggtcccagagccactgttcctgttggagctaagccacatggctaagggccagtcccttaacctttgatttagctccttttgtccctgtcctttcatctgtaaaatggtgctagtaatgtggatctggtttcagaagactgctgtttattttaactaattaaagattgttacaatggtgaaattcaatggactctacaaatattaatattggtgctgatcatgggtggctattagctgggtagcaggtaactcacacctaactcacacctagaagctcttacctgctctacgccccagttcaggtttggctaagattctgttcttccaccaggcttcccagtagaggtctccagcacaatgaccaagaggaaaatggggaacaactgcagaaacctatgaggttaacacagatatataggcgcaaaggcacagggcctgacacattttaattaaatatgaacagtactgtaatctggtttgtacatgtcttgaattctcttattgggttttatgctagcttgtaaagttcttatctctttttggtttttgtttgtttttgtttttgtatttttttttttagacagcgtcttgctctcacccaggctggagtgcagtggtgcgatctcagctcactgcaacctccatctcctgggttcaagccattcttctgcctcagcttcccgagtagctgggactacaggcacaccacattttgtatttttagtagagatggggttttgccatgttggccaggctggtctcaaactcctggcctcaaatgatctgcccacctgagcctcccaaaatgctgggattacaggtgcaagccgccacacccagccatatctctctctctttgaatgttaagcaacctatggaatttcagcatttaggtcttagttgagacctttccgagtctacagagaggatgactaatactgttacccctctgatcagaattttctaattgcttttcatctcactcagtcaagaacaaagcttttacagtggcctgcaaagttttccaggatttgccaccctcaagtccattatgtctctgacttttcctgatacttgccctcttgctctctgggctccaggtacactggcattaccagcatgccacccaggtacttaccccgaggtgtttgtacctgctgtttcctctgcctgtagctcccttcccagatgtcctcatggcttggcaagacatgccttctccatgagatgtccttgaccaccagtctaaagctacaaacatttcctctatactccccatccctttcatgctggctgtttcatcatagcaccatatattttctttgcttattgcctgtcctactccaaaagaatgtaagcttctctaaggcaggaaactggaggagtctgtcttgttcaccagtatatctccagcacttaaagcagtccctggcacacaaggggtgctaaaaaatagttggtaattgaaaaatagatgttgcagttttggcctttgtgctgggtcaccttgcactttcttcgttgggtagaaagtcccaaagcaatgtctccatggcttgcttgactttgggacaatgttagcttaaaggtagtaggttgtgtggttgaaggaaatgtcagtaacaacaggaaccggcatttgcagcacttggtaacaccagactggcatacacatgtgcaacttttaaacctcctctatttaccctctggcatctttttctagatgtgagaactaatcaataaatcaatgataatgaatgtggaagcattttataaactataaaatgctttgcaaatgttaattacattggactttagaatgaattgttatgtaatttaaaatagttaagtaattttccaggaagaaaggctttctgagtcagcttctctgcacgtctttttatatgtgaatgctgctcttccccatctgcaccctgtggactgggaccaagaatacagctactagctgaagcctaaactgtccaggatgagataggtgaaagctaatcagttaacccctggatctaaggaatgtgttttccctgtgcatgagacttctcaaatcccaggtagctgagacaatgtagggcaaataaaatgcaggttggcctatttaatctctaaatgactaattttggaaaactaggcagcttacagcaaaagtatcattcttcttgggttctagtaattcccatgacccagattagtttatttaccagtagagaagcttagagattttatactgttggtggacatagatgaccctaatattcttgtttgctttcaaattatccttgtaaaaataatcaggttcttctttgacccatgatctccttaaggttaggccatgtagaaaagaagagaagcaaatgagataaaataacaggatatgtattgtatctctccctctgtctgtcagtctctctctctctctgcctcatactagagcatttaagagcagtagatttgaaatcagactgcagactttttggtctcaaattctagatatgtgaccttagacagatttctgaatttgtctgagctccagcctctccatttgggatattaatggaatttccctcctagggttattttaaagatcacatgagataattgagggagtggttatccctggctcacagtaagttctcagctcatgttagttgctgttactattgatggaaatcctagtaataataaaagacaggcaggaaataaaggaatttcagaaatggataaagaaaaggagagataggagacactgtcttagagagctattaaatgtactgaaaggatcctggtatagtagtgtgagctcatgctatattatacaatgcatattaggtaatgcatgtaataattattagacctcgtaaatatttttttggctgttataccttccagattgtccagggagagacgcctagtgcattatatgctgtctgtgtcaggatgagctgctgtggccaaccacgtcccccaactgcccccagcttggcaaaggctctaagacagcagtaggtgacgtgtttaacccaggtacctagtgcagctgagccttgacacacttagaagaaggtggcctcccacagcatccatgtgttcctttgttttccattcaacacatgatacgcaaactgctaggcactggcgtgtggcagtgagggaggctgatgacatacctgtcctcttggagctctgctaagtaggggagacagaaaatgtcaattccatgaatggtggtatatttataattcagtaagtaccagaaaagagaattgaagaattagaattatagtaagggacctgacctagagtgaggtgtccagaaagaccactttgaggaagagtggcaaggaggacagagccaagtcaagagggagaggggctacagagtggcccaggaatggggatcagcattaggaaggaaggaactgaggcccaaagaaaattttagctcagaggtgggagagtacagggactgggtagaggagggccttgagaggtcagctggatcctgtaggtcctttgccaagggttttctttaagaaaatatatttttgttgttactgtaaaatacatataatgtaaactttactaccttgactgtttttaagtgtacagttcagtggtggtgtatagtcaccaacaccatccatctccataactaatcttgtaaaaccgaagctctgtatccattaaacaaaagctcccgattcccctttcatctggcccctggcaaccatcattctacttttcaactctgtgaatttgactactttaagtacctcatatcagtagaatcatacaacatttgtctgtctgtgactggcttatgtcacctaacacaatatccccaagattcatccatgtcatagtatatgctagaattcccttcctgtttaaggctgaataatactatattgtttgtacgtaacacattttgcttatctgttcatccatcagtagacatttgggttgcttctgcattttaactattgtgaataatactacaataaaaatgggtgtacaaatacttctttgagatcccattttcaattattttacacatatacccagaagtgaaattgctggatcaatggtaattctgagtctaattttttgaggagctaccatactggatgctaaagagtttcaacttgaaatttagaacagtcagaagcctttggtagattttaaatagggaatggagttgaattagagaagatgagtggaaatagagctagttacaccctcagattttagaatacctctgcgttagattgcaagctatatgcaaagaggtatcttgtctttttttaagacaaatcctttttccttttctctaaacaattttcagtaccaagtgggcctctgttagtggaggttaaagtggacctaagtaatactgagcagtacttaacatctcagcagccttctttacccatctgaaatgtagctatgtgtttccccagaagcagagaacactttgctagttattcacagagctttgacatccttgaatgaaagcagtacagcctggatgaatgcatatatggccataattatctcctttttggactacagaacccattttggctatttttccctcctttttaaaatttctcctcctctctcaatcttacagggctcactctttcattattaggaaccggctctgactgtgccagccagctataaatggaatgccatcatatttaagggtagttcatcattttcatagttttgtcaagtgtgcagccattttccgctgcaagaaagaggaagaaacagtgtttagtccagtatcactcccacaggcataaatgctctttctctcttttgtttttacttcttccaatttagtgatttgtgaagtgaatgagggagaggccctctttttcctattataaccactgatttttcccctacggtgacttcattttgggttgaattttctgaggaagaagaatgcctttttagcgtaggttggacttgccctggtggtgtgggagcaggagagagctggggttgggagtatggactctgcagacttcattcccctcctgactttgcccgtcgttagctgtgtaacctcgagccaattacttaccttctcagtgcttctctttcctcatttgtaaagtggtagtgacagtggtacctgcctgcctcaaagggttctcctgttaggagacactgtgtagaagtacccaccataagcattcaattaattatttcaagcttcctgtctggcttctcactagataaccattcccaggaagatgttaaatgtgtttggtgagccaggcctcagtcagtacacagaacgatgtatctgacaccctcattctggtgccaccattggggcagtcctgcaagctgtgttcatggccctgacgggtgttctcgacagaggcctcctcagcgctgtttggagcagtcctgcctcaccgagtccaggtagtattcaggcaacacagagtctgacttggtagaaaacatgcagtgagtggcagtgaggattccccccgccatcctctgttatatactaaggatagatttaaggctggtgaaaagaaccaaattaacagccctggaaactaaacttgtctggttagccacaaaaaagtgttgttccagcagcttcatttccagctaatcctcttcagccctagagcttggagcttctctgagagggtagtagagagaagggtgatattgactgcagcttaggtacccacccacttacctataatactttcagaattggtcatctcaggcctaccccagcacctgcctgtgttctgcagaagatgcattccaacgtcatgatccagcccctagtcctaaggtatttgtgaacaggggagcagctggtgtagaaatgtcccatgggattgactgtgacgtatctcttagaggaaaaagcttggtatggcctccaatggtcagtggagtgctcagaactgttctttgtagggtggtgggctttgtatggtgggggagaacttgctgggcaggctaggggcatgatgttgttggtgtcatgaaggcagagtgagtttggtggctttgctttggctccatgtgaggctctcagcctgttgtgccagaagtacttatagggaagtgatagaaaataagtactatagccaggtgtagtggcttatgcctgtaattccagcactttgggaggctgaggcaggtggatcacctgaggtcaggagttcgagaggagcctggccaatatgatgaaaccccgtctctgctaaaaatacaaaagttagccaggcatggtggtatgcacctgtaatcccagctactccggaggctgaggtgggagaattgcttgaacccaggaggcggaggttgcagtgagccaagatcacgccattgcactccagcctgcacaacaagagtgaaacttaatctcaaaaacaacaacaacaacaaaaaacgaaagaaaagacgtactattatgatttggggttttctatagattcaaagtatttcatattttttttttacaccaaagaatgaaaagaggagaaatacaaataggtagggtacagaagtctttgaaacataagtggagaagatgcaacctcttgccccaagcagaagcaggccactaggggttcctgggcaggataccaagcgaaactaccaactaacagtgtggctttaaattggcagttgctgctactgctaccactttcatcagcactacctcgacagccaccatgacaagagcagatgtcatttattaagccattatttcatgctaagggatttacttgcagaatcatacttaatcagcctttcaagtttacaagctacaagctacatattattgctcccattttatatgtgaggaaacaggtttagagaggccaggtgacttgcctgctgccatccagctgttaatgtctgtcttattccaactactgtgctatgatctcccttagctttattgtccaaatttgcaaattggagagaatatttgcactttatacctctatagcagtatttctcaaatagtagttcacggcatataagtggctcatgaaaacaatttattggataaaaatagaatcaaacaggataagatgggaatagaaaatatcagagtgtgtcatacttactattcctgaaaacttttgtttctgatatagtgtgggggtgtgtgcctgtctgtttatgtatgtgtgtattgcttggtaaaatatacttcctaccttgggtcattgtcagaaagtttgagcgctactattatagagttattatataggtcagataaatgtaaaaagttgttgtagagcttttttaaaaagtctaaaatgctctgtaagcctaagttcctgtttaatattggaaggtgaagcaaacaaggaagggatggtggataagtgggatgagctgttgctccacccatccaacccatggtacattgtgaatctgtcactacattgtatccagtggagccagtactcctctttgacatttttcaacataacactctaggcctcaagatgaaacttatctccaaaccctacaataagcttatgtattgttggaatactttaggaccagtctggtgttttaaagtactgcttagcacttatagagctctggctctcatttaaactctaggaaaacagatgtgatccctatgacagcctgggggtctctgccttacaagccctacaagggttggctactgctattcccatcataatgctccctctgccaccatccccaccaccatctttatctggaagtgatttacctccttctgcctctcaaaggacatcagaccaaaacagagtctccatctatttcctcttaaagcaaaggtggcaagaggcccctctgccaaggccattttcatggaacatgctctttcctcattgaatccagttcatgcgggaactgcctgaaacatggggtacctatacctccctacccccaacaactgccctgaagtcatgcccctcgggagatccactgcttctcagtggatgcagccattctgatgatcacagaagaaactggatctctcccaagtgaatatcacatgcaaaactgtttctctgcagcagccaaaggaagcctgtagaattggcagttctttcaaaagacgccacagcagagtagtccacgtggatgtagggatctgaaaagcatgtgtcaaagactccttcactgcaacatgaagtgtacaagaagcttctctgtgtagattttaagtcaagactcaacatgacattctgagccatgtgaggaggaactcagacagctcaatttgacaaaagagcaggttctctgtgttttatagaccttgctaatgaacgagtcccgtggcctctgctggaccggctccgcagtgctctgccagcctgtttcccatgcatctgtaaattcatcgagctataatggatggctggtgcctgcagaggctgacgtctaggcctttctgtccgggatacatagagatctcaagccattaataattcattctggagtaatgaacatagctgtaccaagttgtgagcagtaataatcaagtgatggatcaatttattacttcagtgtgccgaaagataatggtcattaataatgaaaggtgtaactcttcccacccaaaaaaaagtttcctaagacttagatcaatgtgtcttttaagttctaaaataacatggatcattaaaagggaaatgaattatgctgggtaacctcaagcttatttatattcagagttgctaatccagaattaatataccttttttccaaatgcctttgggcactggggcctgcaaatcagagtaattattactcattaattaagtctaagaaatggaacatagctgaagactttgataagggaggttgggatagttgagatacattccccaaaaatcatttgaagtttaatgagtaagtagctgggttgggaataattgttttaggcctactcagaaactctcctcatcttttattgccttagtgaaagctcattgtgcacctcctgtgccaagcagtgtgcttagcactggtgctaccaaataaaataccatacttcctcttctcaggccttggtagggatgacaacactgtgtaataaatgcaggagcaggccaacacttctgccttcactgggtatagaggattggagaaaggtgaaaggaaagtacagaaaggaatgggccatttgagctgagccttgcatattaacagtttgccaagcaaagaaagcagcagaagaacatttcaggcagaggaatgatatggacaaaggcagagaggtgtggaagtggaatgagagtgaaaagtgaattagtatgataattaccacatatcccatgcattctcacatttaatctgtacaacattcacatgaagtaggtatgttattcacccaacttcttcttttttttgaagatgaggaacccaaagcttagaaagattgagtcactctgcccagacacccagagctgggaggtggcacaggcaggcctagtggtgatttgaggaaaggtatgctgttttataagagttcagtctttgtgttaaaaatagtcgggcaggccaggcacagtggctcacgcctataattccagcactttgggaggccaagctgggagaatcacttgagaccaggagttcaagaccagcctaggcaacatagcaagactctgtctctacggaaaaatttaaaaactagccaggtgtggtggcgcatgcctgtagtcctagctactcaggaggctgaggcagaaagctctcttgagcccaggagtgtgagggtgcagtgatctatgatcatgccactgcactccagcctggatgacagagaaaggccttgatcacacaccggggactgttgtggggtggggagaggggggagggatagcattaggagatacacctaatgctaaatgacgagttaatgggtgcagcacaccagcatggcacatgtatacatatgtaacaaacctgcacattgtgcacatgtaccctaaaacttaaaagtataataataaaaaaaaaaaaagaaagaagaaagaaaaacagtggggcccactacaggtttacagtcgtcattatcagaacaattaaacaataaaagcactgctaaacattcacatgtgccatgccattgtgttctccccaggggaggtgtgagagctgagttttaggtggaactgctgatagcagggaggataaagctgaaattagaggttcttgggtcaggaaccctagttaggaggctgttactttagtcagatgtagtgtggagaagcctgacggggaaaaatgatcatcatccaaaccgtgtatttttatattggtctacaatttgaaggtactttcataaaaaaatagcttgttgattcacttgcacacgggacttttgtgacaagaggctaagtttaatgacttagctcttttgggaggggaagtataaggacatagaatttccttgccacacagaggagctgatgttgaaagtagtgatgttaaaagcagcttgtaaatatgcatacttgctgattgactgaggcacagaaccgaagtctctcccccttgccaggtcagaatttgaccatctgcattaactttgtcaaactggaaatgtgatgtaattctgggtagaatggaaaacataagtaaaaccaggagactcagcaagaactaagaaaatgtttgtaaaatattctttatgtggaccagaaacaggccactctccctgctgcaggtgttgcttagcaatcaaaaagcaaatcctctttctaactgggctgtgccacagttaaagtttcataaacctaaccatgctctgcccacctttagaggaggaagttaaactcagccctaaaaaaattatagaaaagtacacatctgctaataaaattggttgatatggtatttcaataaaggctcagtttaaaaaccagcgcttaaggcagtataatctcttttcttccttaaaaaaaaaaaaagtgtaccagagaaacagtgagaaacactgcaggcatttatagaattgtgtgaaaaaatactccatataaatagcactaaatgctagggaggtaggtctgtgcaaactgcctatctctacccaatttgtctctagtttcaagttagtaatgaatagcttccttcttgtaacaggtgatttagggaagctcttgatattgtctcaacaaaactgaatggcattaacttttaacttatttgttgccaagtagatgatttatatgtttttatacatggggccagcaagtgaacaatcgagttttatagctaggtcctggtggcctgggtatggagttcagatacatcttttgagtagttgtttattcaaaaatatgcctacgtctttagcaaattactcacagggtcagcgactgttgaccctgtgtgtttgttagactttgagtgtaagtgacaatataaacacagccatatagatgaatatacactagtgcatttttatttctgtttatgccctgtttcacttaatgtgagccatatgtttaatctgatcggcctttaatactttacatctaaagtgctgaatttccttacttggttttaaatatccagatctgcccatttaaaaaattatgtctatttaatgcttatgtttgcaaatgtattaaagccatcaagaggttttacatttgccatggagaaaaatgctaacgattgcagtttaagcagctgccaagtacataaattgtaattaagagggattagcagttacctggacttgcaaaacagggattcagatgttcaaaggttagtaatttggcagatagttgctttggttggttggttgttctaggcaaaatggaaatgataaagcgtgtcatatcctgaaatagcaaaatagcctggatgctgaagatttctgaaatgtggtagattttctgactcctgtggcatctgacgatgacccaagttctggctcctacagatgaggagtctataaataggaagataggaaggatacagggtggttggtatctctgtgtacacgatttgtctcattggtaccttttcttttccttcctcccagtgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaaggtaatatgtaattgatcacttgcagtgaagaatgtacctggggggaagctgcattggaattgaccttcagagttggctcagatttgcattgctaatcactcttacactgtcatgacgatgaagttgctggtggtggtagtgatggtggtgatgataatgtaaggttggtggtaaaggtgtcaaccgtggtagttacaatgacaacagccatggttatggtggtggcagtggtgggtaaaattgattgagcattatgtgccaggaactgtgttaaatactttatatgtatattgttattttatcctcacaacaattcaatgaaggaagtactcttatgaacctcattttggaaacatgctttgcccatttcttacttgattgttttcttatgaatttatgagttttttaaattttagggatattaaactttcttcatttgtgttgcaaatattttgacctatagtttgtctttcagttttataaatggtgttgtattttttgtaccgtttgtgtgcgcgtgtctttatggtctgtcttttcttttggggaattggggttcctagtctttctttcgaaggttttcctcatcccccaatttgaagaatattaacgcagagctgcccttgtaaaactggggaggggacataaagctgcagtcctctcacccacttcattgctcttatgagcaaatccatatgaagcttctcagaacttgtgcagggttccctaaagcaccatttggcagcaacaaatctggaatctaataaaaaatgctgtttctcttaaataaaaactttgcctagaatggcaaattaatcatgcacaataaatccagaatctgaccatgcctcaccacgtacactgataatgttgtaagccaccactacctcttgtctgactttttacaagagcctcctaatttgtttctttcttgtacccttggcctgacaattctgataccagccaccagaatgagattttttttaatgttaagccagatggtatcagttttctcctaagaattatccagtggcttcccatttcatacatttgcccacatagtctctgtccttttactgttactacctgatctcgtctcctgcatctctcctatagccatcttgtttctgccttgctgtttcttggacaccacaggcacattcctacttcaaggccttcgcagttgctgttcccagtggttggaacactgttcttccataaaaccacatggcatacttctcccttccttcaagtgtactaagtgaagcctacctagatctctctgtttaaaattataatcccaacttcctgcattcccttttccttttattccacttagtctgttttcatatcaaaagacaaaatcacaacaagtttagtttaaagatgttaattgacttttatttgcgattctagaattgggcaacacctcattctgtaaaatagaatgaatattccaggagctgagcagaggaggttggctttatagacagaaaagggctaaagaagagaacaaaaagcagattaattgttttgaagttactttccttgtaaaagttaaagcagaggggacttccttcagtgctgactaaaactggcctgtttggggatttgcctgttatctctcccctcatttattggaaggtcagacaaacaacttatttttggcttgatggcatagaacttcagcagaagtaactgcattttgatttggtctcttgagcctagggcaggagctcagtccaaaccagtggcctcctatcaattttatttaacacataggacttcacaaattatagggcatgtaataaaatttacttactgattagatccattggctttctgacctcttcaagcatgtgtgcttcaggaaagcagggacgttgtgttttgttcctcagtaggcactagtacattggttttgggtgaatgtgacagccagcctccaaaatggctcccagtgatcctgtccaccagtgttcattcccttgtgtagccccctccacctctgaatagagctagcctatgtgatcaatagaatattgccaaagtcatggtatttgacttctgagaacagaacatgtacattactctgggaaggtcatccttcatattcatagggtttgtcgtctttgtgagagcaattggaataagccatcttgactcctttttcactgtagcttcaggcctagcctggtatgaagtaaggagatgctccctcagtcttttttggaagtctgtggtgttcaactcacagcaattctaagcatccgtggctgtgctctggcctctggctttctggagataacactttgtataaactccctgccaatagaacttaactttaaccatcaaatccagagcaattttatgtcctcagaaggatgttgtcggagacttactctttaaaatccacaatgttggccaggcacagtggttcacacccgtaatcccagtgttttgggaggctaaggtgggaggatcatttgaagccaagagtttgaaaccagcctgggcaaaatagcaagacccccatctctacaaaaaataaaaatgaaaaatcagctggatatggtggcacatgcctaaagccctagctatgggaggctgaggtgggaggatcacttgagcccaggagttcaaggttacagtgagctatgattgcaccactgcactccaacctgggtgacagtgagatcctgcatctaaaataaataaataaaatgttttagaacataaaacttcatagtatttaaggtcttagttaatacttaccaaccatttccttagacttggctttaattttctgtaatagaaacacacacacacacacacacacaaacacacaatgtctaggggtgactcttcttctgtctagtcttagtgtcaaaagttagacaaaatcctgaaaccctatttgaagaaatgctttccagcagcaccttttcatgtgaaacaagtttgcttgaaacaagccctactacagggctaaagtatataccccccatagcgactagcacagtattctctcatgttgttaacatcttatataaggtatttactttgtgcttcggaataatcattaggagggctctaggaataaatggaacatagcactgaaaagaaggtgtggaaacctaggcatctagccattggagccactccattgacggagagacgaagagagccatgagatgttttaattttctattgctatatagcaaatcatctccaaacctagtgacttaaaatagcaattattttattactctcaattctgtgagtcagaaatttgagaagggcttatgtgtgccccttgtggtatcagctgggttggtttgactgggactggagggtccaaggtggcctcactccacacagctgggactttggtactaggtgttgaccagaatgccttgatcctctgccacaagacccccctctttccaggtgctgtcccatcattcaggagtccagccccaagttccaagagggcaaacacagaagcagcaagggctgttaaggcttaggcctggagcaaagtatcatttctgtcacattctgttggccaaagcaagtcacaagtccagccagattcaaggcagggggagctagatgccacctctgggtgggaggagcagtgtgtgcacacaggcgtgggaggattgttgaccgttatctctgcaggggatctatggtacccagcaagtttgcatttagttccctttaggaatgactctgctttcttatcagtggtttgtgctgagcatgggtagcaacccagtgtttttatggagagtgcttttccgcctcctctctgcattgccattttttattcaaccaggagcctcaggcatctggtggtagtgacaatttcagcccttaaatgccctttgtgagccttggtatggagaaccaactcataaatatctaaaattggaaaaacatttttaagattggcattaaagaaaaaggaaagagaagtgggtaattcagtttctttaacctggtaaaacacctctttttcaatagaaggtaagagacctctgtgttctaactagctaaggcatacaatcttttctctctttgcctacctgtctttctgttgttttccaagggttaacattagacattcagctgagggttaatagtgaacatgatctcctttattttgtcactcacacccacacatcctcaagatagtacctgcaagtctagaaacaccctctccccccaacccagagaatccatctatatcttcctcctgggagccatagtgatgtgtttcacacacaacttgtgtttggtcagatagagtgcactaacgacatgcttaccctgtcacaatggtccagaacttctgtcctccacctctctcacggacctgggagggaagcagtgtttggcacaattctgggaaataaatatcctagattaggaggagacagagaggaaaacagctaggagatatgatattatgtttgggggctcatggaaatttttctttttccatgttggtaatacatactgattgtttactcaattaaaattaatgaatcctttaaatgaatacagtccagaaataataatgatgatagtaatagctaacttttacttacagcttattgtttacaagatattgtgctaagcagctttatatccatcattcaattttcacagcaaccctataaaattgatatttttagctctgtttttacaaattataagcctgaagtgcagacactttaagaagcagctgattaggagaggaacaggggttgaacttagtactactctcagaacccaagctattaaaatctactctagttaatctcttttcagtgcagtaagcattttattgaatatctaccattagccaaagataagtaaaataggtccttcatttttcaaggcactcccattttatcaagatagaactaactataatacagtgtgctaaatgacctccagtaagatgaataaagtgttatggcatcactgaggataaataatttaattctactggcattgggctctgacagatcaatggaagttttctaggcagagaaagagtagagataggagggacagccactcagaggagcagcattaatcaagttgtttgtattaaaatggcatggttgtgaaagactgtgggttgttagcaagtagtgggtgatgatgccagagagttggattcagtccatttgctaagggtcctgaaaactataggaaaaggttttgaactgacttctgaaaactgggagctctcagaagtttccaagtggaggctaaaatgattatgtcagcactttagaaagacatccttggaagctgaaccaaatagtactttgattgctgacatcaaaatcacacattaaacaaataacacaatagagttaaccatactgttctaaacttgcagctcagatagtgtcacctttgacctacaggctttgcttggaggttagagagagattcttaatttgtttctttttgccagacttcctaaggggaaatactagctcatagcatcatttcctattagtgactccttaccgtggactctccttgaattatatgagaactaaagagtagatttgatggtgtagctctttttagctacagtcaagtttctgagttgaaagctcagatggcaaagattttggctcttcccacgctatgttaaggtagcagtcagttatgcaaaattaccatttccgtatgaacagaatcttttctccaaactcacaccttatcacactgagtcttaaaacataaagtaggcaaaaacttaaggttatggttaaagcaaccaatatttttatgcttccagctaagattttcaaacaaaatattgaatgctgtcatggtccaagatctcaaagcccagaaattatatttattacaaggttttccctttacttagtgttttaaacgcttacttgctaatgactatgacaattttagatgtttaagaaggacaaccatatcaagaaaacaaactgcttgcttttcatagttttggttcaacatgaaatttcaggctacttagtgtatgtgtgtgtgtgtccccttgctattaaattccaacacataatagtaggattgcacttgttctgtaacaatccatgctgtgtcttgtggctgtggcactcgaaacggtttctgtacatggagcaggatatgtgtgtgttcatgtgttatgtaccacaggcttttgccagcattgcctcttttgatgcctattaatgtttgacaaaataagttataataattccttccctagtccatcagttagctttggaagaggtgggagtgttgatcattgagctgttaattctcagaaatccccaaagatcggtgcccctttttaatgtgttaactttcaacctcagatgtcaaggagaggagctagcaatcatggatgacccccacttaacacctggactaagcactaaatcctaagcaacctcgcattcccaataaaatgctagtgacttacaatgtagttagctcaatttgagttgatttgggccaccaatctgccttgatctgcttttaccaaaatattggtgacattgaaatccattggactagttctggactttgtgcacaaaatgtacattagttaatatagttggtttggcaactgacaggtgtttagaagtcgcattttatttctttgatatttcaaacagttgttgatatgcaaaattaataaaaaggtatgactggatgcttcactatgttgagatagtcattggtactcttgcctgctcaggaagctaatcttgtcctgtggtcatggcttttgtaatttgttcatcaatttttatttttaaattttttgttgacttcccttccaatggttcttgcttgtactctttttgttcctctccttgttagggttcagaagcaagctagatttacttgggtgttgagctagaatgcttctgccacagggctattttctttttttagtgacaagtgctgtgtaagatactcttcattaatgtgataaggtaggttgtgcatttgaacacatatattccccccaataaatcccagataaaccaataattgtttgaattgtgaagctcctttaatattactcaaataaaggtggagattgttgttgtattttaatctatccatctttgtcagcaaagagaacaggaaatagaatctttctggagatatggaaaatcacagctctccatggattacccaagctgtctatatataccctcagttactaatgtaattggttccttttgagagatttttaatacaactacccaaactactttctaaattgttgatccctctgccaaaatgctgatatcaacaggacataggacttccaactgtccttaaaaaacctctgcagttacagcctctgaatttggcgtcttaacagttacaatacataagccctgctaagacttgcctggcttccactgtgaaggtgctgggtttatggcttctctgagagcaccacgcagtcctcggtcccattgtctgtcatgagaaggagtgagctgtgctcaactgttgtaggtctactttcctaatgcgtcaaacaaaccaatcccacattactagggaccctggtacatttgtgtctcgagaaaatgctcagtctcatttctcgtataaacctttctgttttgctttgtaatccccaggcctctgctgttgatttattgtctcagagctactttgcagttgtagactaggagctcttcgtcatgacctaatttccctcccataaaaatcacagcacataataaagagtacaccacacacattacagggagactcctaatccttttaaattgcaggcgcatgtgacagatgggattgaagaaggtctaaaaatgtgtatgtgacatggataagaacagattccacaagtgtcaatgctctgcaatgtcaagatgggccagagggggaatcagtgaaatttaaattttgtagacagtgcaagggaataagaacaggaaattctgtcattgctgtaaacagttaagatcaatgttttgcaaagaacagtaattatatttacacttataaattaaatcctcatgtcctgactgcaaataatccattgttgaatctccagttatttcccttcttgtgtgtctccttttttattgactacagtaatatcttttgaacactgaatgtcaaactgtattaggcgtgtcagtcctcaccacagtcctgggactttttacagataaggtctctgaaggtcagagagttacataatttgcccaaggtcacagcgctagtaagtgactaaaatcagatccgccagactccaaaacttatgtcttcccattttgtcctctgtctctcaaattaatagtagctataaagaccacaagtgcttaagacccagacagtcaagccatctaggtcccagtccagctgcactccttatctatgtgaccttggacaaatcagtgaatctcaaggagtctcagttttctcatctcaagagggcaagaataatagtacctcccttacatggttattgtgagtaaaataatccatgtagataatccatgtaaataactgagcatgataagtgctcaaattctgtttttattgtcatttataccaccaccatctcatgcctactctttgccacatactgcactgagcattttatgtgcattgtcttttcagtagctctgcaaggcaggtattagatccttgcttgcacaagggaaacagactcagaagggttaattatcttgactgagattacatagctagtaggtagcaaagtcaggatttgaaccctactctgtctagctccaaagcctgtttgctttgtacctgtatgatgatcttaagttcctttcctgtatttgatgtgatgatatggcagtgatgtcagcgtcagtgatggtgaggtccgtgtagctgtaggtattgctgcccactgaatgagaagcagaaccaagatcagcccaggtttgtctgactgcagaggccaaaccatccctgaccactgtgacttgcagcttaaggcgaaacagtagcttggtatttatggatctgctaattccacttacaggaagcttgaaattggggatacttagaagagttacccagagttatatttttgttttacaattttattccccaatagcttccagaaggcttacagtcttccttacttttatctctaagacattcctgactaagtcggaattactttgtgagtttggacagtattaacagggcacttggggcagaaaataaatctcccccttttgtgttaatttggaaagtctctgtgaaatgagtagattgttccagccacatggtagagctccataaatccatggctcataggttatatgagctcctgcttccgtcattcagcagggttgtttgcacagtgattcttctctacagactgaagaaaacttcatttgattctcttgaaatcatcccttccaaaatgaaataggattggaataaccaacaaagttgtgaataattcagattctcattagaatcccaactcgagcctttagcatagaggcaaacccgtggccagacagtcagcaggctttaaacaatttgcatgtgttcaagtgtcagagttaaataaacaacagtcacttggggaatgattttccagagtcattaatgaaagtttgtgtcgtctgccctgacttgatctaatttgcaaaagcaccctgtaccttggaagaatgtgtaatagtaattatgataatcacatgtctggcactggacattttgcagtgtgcttccttgcacattatctcatttgatcctgagaatagccctatcagcggtcttcaggagcctggtcctggctcacaatgagacccagggaactgacccttgggactatggctcttgcccatggcaaaaatctccttgtagagctgattctcttatgcttgaataacttaattattttagaggaaacagctgatgagcagagtgaacttctcccttgtttgttaccatgtctcttcctgctctgctgtatataaatattgtcttggaagcaatttttcacgcatctgtctaaagccatggtccttcctcaccagttactcttttttgtttctccagcatttactacagttctcaggaaatagtaaaagctcacatttttgttgacagttgaaattgaagtccatgttatttttgctcccattgtaattgggtaagggtctcattttcagtaactcattagaaaaaaaagagacaaaatttggaggccagaggcaaagcaggatgagagggaaaataatgagaaccaggcctatcgctaactctgaattcattttcaaatgctcttagctagggattgctgaaggtgctgtaactgaggccagaggcagaaaggtactagaagacactgttaggttgaaacacatccttgtatgtttgggacaccagcttttgtagtgaagattgcctggagattagccaaatgaatggctgctgcagccctgggacttcactcctggtcactctcctgcttagctgtgtggcattgtaagatagtcatccaacttgctatgctgttggcctccagcttagagatgcatcatgggatgcatctgcctagcatagtgcctggtaggtgcaaaactcatacatagtagccatttttaaatgtcaatgataatggtacacagtgaggttgtcaccaggggatggccaaaataaacagtagggagaaagcttcttagaggttgcagtccttgagcttttctttctattatagaggctcagtaagagactagagatgtttatagcactggtaaacttgttttttggggttccagctgctcgggaagttaggagttttttcttgcttttacttggtttccttctcttcttattcccttgccccagttgaactcagctacgtgtagtgattcagtttatcttgttgaaaattttcagtcctctagggaagatatgatactgctgttttcagacagctgtgtttcggagtgagactgatttaaccagctggctggcatcattggagcccgaggacccgccaacccatggagagcagctgtttgggctgaaattctcataattcttatgattttgtttcctacacatcggcttttgagttctgtttttaaatgcacacagaaaaggagagaggaccatgagaagactgatgtgtctagggccactcatgggtgaaaggtggccctagacacatcagagactgttaggaaggagaaaactcaggagggaggagaccaacttcaaagaataagagatggtaatgagtggatccataaattttgatttttcaatatatagtgggggtgttatgcagccattaagaatcatgtctgaagatttttttaatgaatgaggaaatactgtataatgttagatgaaattatatgatacaaacagaataaagaatataatttcaatgatgaaaagtgtgtgttaacattaactggaataattcatacaaagcatttaacttagtgcctggtgtggcaaggactcagtaaaccatagctacaggagggcagactctctaaccacagaacgtgtttgcctccttcactgttagacccatagtgcctactataaaagagatgcttaaaaggtgtgtgttgattgaatgaatgagcatcagtattattgtatccatttaaaaaggaatctggggtaaaaaaaaaaaaaaaaactgttatcttctgaaattgtatctacaattgtggctactgaacctccctgagccttagttcttcattataaaatgctgaggacattacctgttgctcaggattgctgagaactgagtgagctacatgaaaagtacacagtgtgacgactggtacctaagggagtctgcaataagtggtggctactataatcatggtaagcaccatataagtattagctattataattattaaagtctgccatacttttatctgtagaaataaagatgagagttgtcatgatttctatcattttcttctcattttttagcatgaacttttagaagaataaaagcccctcctccaaaaaaaaagcttataaataaataaaacctaaatgctaacagtggttatctctaggtggtaaaatcgggataattttttgttttcttcttgagacttttctgcatttttcaaattgtccatagtacgtgtgtgggtgtgtgtgtgttacttttatcaagataaacgaggaaaagctcagcatcacagataacacggagctgctgaactagaaaaggatgctgcagctgaggacaattgatgaggattgggaaatggtgccctgccctgggaccctttgtgaaatgttatttaaatacatgtttcacagtttaagaaagttgtgaagtaattgttaagaacttagaaccaatggagaaaaataaaggaatttttgattcattggttctggacaaaggtagtcaaaaaacttcaagtgctgttaacagacagtggcttctattgagcacagctgctttctttttccctggagagaacaataaaaagacgcttagtggaaattgtggcagaagaggttagaaatggaagtgggtggttatcaaactctgggataagcttccaaacaagaatgtttaatgccatttcctagaaaagtttaaaatgaagtcttgaacaactgccagtggtcttctcggatcttttcttgctaattccaagacactgccaagctttccgttgtactgcttcaggcctgttttcttcccagtccacagatgtgagtaaccttgttgtgaaacttcgtttgcagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacgtgagtctttgctgcatagggccagcgtggcattcagggacatcccatgctacctgcacggctcagggtggacacttccagcttttctctgtgtgctactggctttttgtgtccttgaagactgtatcattgtgccctcccaagtgcctttgctgagtaaccctgataggacaggaagcaatattattgagaatgaaagagaagggctgccattgaggattctctttccagatcacctgtggacaaacagctgagtctcttttcctcctgctcctacacaataagagctgagctcaggcactgcttcttaagctccccttttgttagcaattcccatagatccagtgtcctttccttttctcggttgtaatgaaatacccattagtgtgagtcacatgccctactagaatgtgactctgtgagggtgggaccttgtacggcttgatcttttactccacctttcatggtgcctggcatggagtcgacacctaaaaatatttgaaattcattagtgaattaattagggaacaataccttacttgttccaaataccagtgtgttatcaccacaattatatcacatccgtttttcatctcaggatttctgagttctttgcaatgatgaggtactgacccctaaaatatacagtattgtttcagcctttgctctaagagagcctccatttgctcatctgtaaaatagggataataggacccactcataggaagttatgcgaattaaatgaaattatgcatttcagcatctggcataaggcctgggacatggcaagggccaattactgagagcagctactaccattattggttaccgtttaatcacacacagataaccaaggatggttcattcatgcagctgacgtttacacgacacctaccagggactgggaatataagcatgggaccttggctttaaggagttcaaaactgagtaaggaaggtagacaagtgactacaaatgtgagtcagcatcacagctgcttcattagagatatacacattgagagaggtagcagaacacagtggttaaacacactctggccccaggtcgtctgggtgtgattctgcctctgctgctcatcagcagtgagtggcttgggaagttacctaatatctcagggccccattctccttttctgcaaaatagggttgatgctttctatttcatggggttgttctgaggattaaggcccttcaaatgttgccaggagcagagtcagtgctcagtaaatgctgggtggtaatggcacaggtattgccatcatcatcattattataactcgtttctgtgaggtacagtaaagggacagaggcaggacagtgagctactttgccttgaagaggagaggcttcatatctggattggtatctttctttttgtcaccaaaaaggtgcttatttaatcccctccgccagggttttcgagttaaggggcagagtatttccaatccattgtgtagtatgcagggttttatggctgaaatgcctgcccggtgaggccgccagaggaccaaacaatacttagatgcctacgcagtatcaattaacacagcgtttgccggaagaagataggtctttagggactccccataataccgcctcgtcaagagaggcaggggtcatgggaagaggctctcccgcctgcgcggaccaacactacgtttacccgcactcgtcgccgcaatgaagtcagggacggctcacgcatgcagggaagacgttcggtttacaccctaagacgtcgcgtccatgacacgttaatgtggccgttatgctcaaatttggctagagtcctccagagcgggacacttttgcttcctgtcttctaaggataggtgtttgtacccgcttcgtgtcataagcagatgacctgctctgcaggaaagttcccggtcagataaacgccgtcagcgtgcacagcgcaggtctgcataggacctagataatacgacctacgtcagagccgttgccgagatgacgaacatgcgccccctgcttatgacatagcaggcacccaccggttctctttggaataggctttaaagcattctctgggagctcataagaatgaagatggagatcaggagaaaatcagctagatctttgtccaagattaattttatcacacaaggcagaggatgaaagttaaggatgtgtgaaagcaggtctgtctcagctgcagagcaagctgctctgtccatgtctgcagatggtagacaggggatgcaaaaggagaagacagtgaacaatagggcctttctctaaatgttaggaaatgctccctggaaacatgaccggagcatacagatatgctcagatatttgtagggagcctaactttccctcctttctcagagaataaacattttaactgcaagtctgtgtgttctttaactgcaatttatatgggtgtctgtgtgtatatattggtttgttttagagacccctttttttctgcgaagctagcatactatccaaaccggcatggaaggcaccctgtgggggggcagtgggagagttgactggggaagactgagctaggagctggaaggttctgctgggacctgctccctcccaggttgtaatccagccacccgtcactgtcgggtgagcagatgataatgcactgtgaagttttcacacacttcacctttctctttgtctggtctatggacaaagacagaaaactttatcctagcactttgctgaatttactgtttggcattaaagtacaggtaacgattatgcaaatgtaataatttgtgaaaaaaggtatatatttccatataacagtgatttcagtttgaggataatcttatacaaggtagatcattcaaaacttgcagtttacgcacggaccgaaaagcgcacgacgacaccgtgacagatagctcgcgggcatgctgcgtacgacacgacgggaagcggtttgctgtaaatgcttgtacagacgaggagataattagtgctacctatagagtcttactatgagctcacctccgcgaatatctgagtgtcgcggaatcggagctgccatggtagcctcatgggtttccgcctctatttagaaagtcaacgtgaagtttggcatgccggcaacatcaagtacccaacttctgcccaacgatcgctactaaagagccaatagccccgcaggaataatctaaatgagagcatatgacggccgccatctagtcgaaggaacagaaatacgtcaggtttataccgacccaatgttgccacgggacccatgaccagatacaagtacattctcggaagggacctatgattggccggcgcatcccgccacttgagagaaaaggttactacgaaccagcactacgcaaaaagaaaattgttaatagccgggcaaacaccacggcgctaaatccctgtgttcccggggttggtcgcttgtgctggcgcgctagtgttgcctaaagtgagctaagatctgtaatacctgcgatcattttcagaacctcatttcttttgataagtctgtccacctgatcccttttgagtccagtcattctcctttttctcttcattgatgcacttgcaagttaatgtttatttggcattccatttgtcagtcctctctccagtccgcagttgaaatgcttagtggggttgaggcttccagagtagctcacttaggtatttccctcaaagagactccaggtgctgttggcagcatacatttttctcccagcctctctgcagtgtccttactctgtgcaaaagttggagcccactgtttgctcttagaggtgaatcttggccttggattgtcatttgcctcttccttcccagagaagaagctcctcaggctcaggcctctgcctttgcacctgcacttcaggctcatggtctgggatattagaatatgctcatagatgtgtgtcttatttgccagaaggggtttttcctacagtgtgagtagaccagttgtgtgcccaggtccctgcctgcgactctctctctttaatctatgggtattagtatagtcttctctaggtggttttgtgttttgttttgttttgttttccttttcctaaacgtaaagctgtggtctattctcagaatgaggagcttgatggtttctcatgctctgtgctgggcagggacttaggtcagttataagacagcaagtcgctcctcatatcataggcaatgtgtgatggaaatggggctaggagtgaaatgggagcagcctctgagatgaaaactttgtggacaagaggaaagggaatgatggggaaatgcaggatttagaaagcatcgtagcaacaaatacaaaccatcaggaaaccactgaatattttagtgaggaaggagctagatatcaaagttatctgtagacagtcaaggaaggttttctgaaaggaagagttttgagaaagatacaaaatgatatgaagggtcccattctggcccaatagataggaacggtggtctgtgatgggagagtctctctgtgagtagcagtgggcagctcttgtctgtagaactgcggagagaactgtagaaaggtgatttagccaaactgaacctggaagacgttttccctagaaattgatttttttcttgtctgtgtttaatatctatgactatataacttaccaggcggtttcttgtgttggacattgtgcaccacaacagcccaactaatctttaaaattatatgacacaggtactgtccctgttttacagtcgaaaggaaataaaatttacattaaatagtgtacgctcagggttacacggcaacaacgtagatttgaaccctgtcattctacctcaaagtgacactgttaaccagtcgttattttgctttcaaattgtgggatggttccccaggagatgcattcttttagggttagctgttgtgacctagtccgcgaactcttccttatctccaagggaaaatgtttccagttccacttaagaacctggagttcaaagtttcattcagctgggcatctgccggtaaaatgctgaggggctggggtggaagtacaaatggatacatttggtaaagaactttcaggccaaactaaatttgaacctcatctaataataacaataaaaataaaaataattatagctctacttatgtgcctactaacctcattatctcgtgtcatccccacaattgatgataatcctgtgaggtaggttcttatatccacattttacagacaagtaaactgaggtcaagaggttaagcagttacactgtcagcaaatggcagagaagggatttgtacccaggtagtcttctagtcttccttccctatactttgttatctccaaaagggtacctttgtcagttcttgagctacagaagtgaaaaccttgctagcctgagttacagaagcaatgaaaaccatctgttccagcttccagggctacatgggggcagttgaaccatattgaatgggtacctcaatgtgcgtcctggcaggctgcagccacgtgacagtctcccctccaaatctagcaccaactacacagagagcgatatgtgttgaatggtagctttaatatgctcggccaagccactcacgctcatttgcgatcaccttcgaacagatggaacgaggtttttcaactgtgctcccagatgaatggcagcaaaggagattactctttaatctccaagtttccacacagatacaccatccagcagagactgtactggtacatctaggtgaaaggtactgacacacacgctgtgctttttctggacgactgtagaagggggagccagaaggattgaagggagccagcaacaaggtcttgtaccttatagatttcttccaagggtttgcaaagtgacacttaggatttattctgtcccaaatttttagcatttataccaagatgttgaaatgcgtttcttggaacagtggttcatagacttgagtgtgcatttgaatcttgtagggagcttgttaaaaatacagatgcttggtctcctacccaggatattctgagtcaggaggtcttggctggggctcaagcatctatatttttaaagcaccctagtgatactgatgctaactcaatttagagaagtactggcttgggaaggtggggacagtcagggtggcttgtcttctgtcattagcagaacatctctttgaatcactgttggagtttggagcaccctggcatggtggttgaaagtggaggctctgcagtcagactgagatgttttaatgtcatctctatcacctaccactctgagacctggagtacgttactttccttttctgagcctccattttctcatctgtaaaatctatcactaataatagcttccttggagggtaattgccatgattaagtgagccagtatatataaagtacttgacattgggcctagaccatagtaagcacctaataaatgttagctacaattatgatgattatcatcacgctgtagttgtatcttacaactgactaaggaaatatccttccctttggagcctgcagattccaaaagagaggcccatatgtgagggaaatgcagattccccccggcccctgagacagcctgtctgaggcttgagtgcaaaaacatcagcagcctaggacacattgtacagtgtcggtgggggtgggggtgggggcaggagtggattcttgggccttgttttacatggatcatgttaactagctgctgagattatagctctgaataatttttttagttccgttaattcatcctagaccctctcccagacaggcccagtgagaggttgagaattcagcttatatatttctcatgtgtgtcttccttgttgaaaaatgactgggaattcatactattcaaaggcttacgtaatgcctttctctgagcagtcaaagctgtagcatgtgccctttctcaggttgcctttgcagatcccgggtgccctgggcacacctgtttgctttggcagatgacatgtttattcacatggattcctgttgtcacacgggctgcagaaggtgtgtaatgtgtttcttgggttaactatgtgtaattactacacgtgactgaaaaccacgttgataatgtggctattaaaaaatgatgctgtggaaagctggtggcaggaaaaaagttccagctagacccattaaatgaaaacaagccattctaggcgcatacttttggcactatcaccaagtgaacaaagcagataccattaagtatgatgtgagtctgcttcgttaaaaaagtacatgtctgtgtgtgtgtatatgtatatattcctctgtgtagcagatcgattggacatttacacaccaaaatgaatacaactggagcgtggcccatacgggatatctgtgtgcagatgcaaatgcttttctagactttctaaattggagagaaatgcatatttcttatatattcacttggttttaagttattaaaaacaaaactccctaattgcacctttcatgtactatctcaaacccattttgctgtgagtcatggtataaaagtaggtgtgtagtttccttctaatgagcaagaatataagccgtctgtacgtggactccctcagatcccagtcaactgtaagttaacgggaaaccaacttttcctaaaagcaagtctcacatagaaaagagggctgtcttgtgagtaatacagtgtccatttaactctgatcattcaaccccctagtcaacattcatcagaggcccattcctcctttgcggtttctgaaatggtgttttagggccagtcttcctcattgtgcctccacgtctctttcctgtggatcagtgcaatcccaggccacccacagtgacttccccattctctcatgaaattcagttttattggcattttttccctttgcaaagaaaagggttattacaggtgctgcagggagtcagtctgtccacacagaaccaaaatcagaagtcgttttgctgaagataatctgtcaaaggttttaatatcatctttcatgtactatgatcaaaacaacagattgactctacttttcacttttttttttttttttttttttgagacagtcttgctctgtcgcctaggctgtggagtgcagtggcacgatcttggctcactgcaaccttcgcctcccgggttcaagtgattctcccgccttagcctcctgagtagctgggactgcatgcgcccgccaccacgcccagctaaattttgtacttttagtagagatggggtttcaccatactggccaggctgctagtctcgaactcctgaccttgtgatccacctgcctcggcctcccaaagtgctgggattacaagcatgagccactgcgcccggcctacttttcaactcaatgtatagagtctatcatcacccaaactcctttttaagatttttttaaaaaaaaaacattgtccaaactgtttttatatacccaaacatattacgcagactgctttttaagtttgtttttatcatagggactgaggctgctgggtcagcctgaaatgagaccacctcagattttagtgtggcttggcatgtcactattatcaggaacaagagctacagggggtaaaaattgcttcagaaagtctgattccaagcttcccatgtacttgggtatttcccagagatggtaaactcagaaattgctgtgcactcatcactttttattgcaaaattcattaagctgctgtgctattatcatcccatcttgtcaagatgatacattacagacttcattgcaaaactttaacaagtaggagaaagtacacctctctcctgaccacagcacaggaaagcctctgggtattttgtgtttgccttcctattttttttaatataaatctccttgtctttgtaaaacttcgctctgtctggtaactcccttttctccttgtttgatcatgtggagagtctgttccctccttttggctctatgaggcatcctgagatgctgttaaagaacagtcctcttgcctcttctttttgccctctactcttaggcaccatggaaagttgggatattagcctgtattctgacagagtcccatgcatggggggaaacctcccgcaaatgtttcgtatttaccctccagctctgtgtattcagtgagccagacctgttcgggcctgccaagacgtgtgaatttggcttggctctgtgagtgctttcctggcctcgcctctgggttctgtgataaacagagctcctgcctcccctgtgtgatggggttgccattagagtgggtcggagtcacttggtaaatatggaaagtgaagtcgcttagctcccagatttccatggcaacccccagaacaagtacaatatcaccaaaattattctgcggctttccttttttagttgcagtgatttggttgcatactcatgtttttccgttcctgatttgtacaaaaaacaaaaactctgcccactgtcatcagtactttggtttcaaggacatttatggtccctgtctaaagcacctgaaaaattcagtcacgcaaaactacccctttctgttccagcagcataaatttttgactgtgtattattcccttatatttaatatttatcttataaccattcacggagccttagtgtcagtgacccatgggctaggcaccaggaatggatggctaatggtgacctcacctgccacgttaatggatgctgtatggccagacagcatgtccctgccctcgggtagtttgcatccttaaggaccaagttcacatgcagtttgtcactccttatagaacatatgtttgtgaaagcactgccaatgcatgcttaccattatttggggatttattttatcatgttcttgttgctgaggtcttgttttctgtgattgatacaaagacagattcctgttgacaaacatgtttgaggcgggcaagcattctcactgacttcaaccagtttaggcatactcctgagttgtgggcattctttcctttttgacatggtcctctgtgatcttgttgacttgactcataactagctgtttttcttttgaagcccactagcctataatttttttccttcagcaacataattgccatcagtccttcttataccttctatgaggataccagagctggattgaatcatcagtgactcagggaagtctagctatgttatttgaaggatttgcttaattttaatttttattttttaaagtgtcttctaggctgcctgttcttgtgcgcttctgtcaggagcagtactcatttgcctagctgatgaaaaactttcctgtttcgagtgacattacgggatcattttttctttattattattattattttttaaaggaggcagagtcttgctctgtcacctaggctggagtgctttggcaccatcatacctcaccacagccttgaactcccaggctgaagcagttctcctgcctcagcctcccaagtacatgggaccacaggtgtgtaccaccaggcctggctaatttttaactttttttgtagagatgggggtctcactgtgtttaccaggttgatctcaaactcttggcctcaagtgatcctcccaccttggcctctgaaggcgatgggattacaggcatgaaccactatgcttggctcattttctccttatttcctaattgactccaaatgctgtaaaatttgtcttggtatagtttgctataaccactaaaacatttgattggctgttggtcttattctctactctttccctggaataatcctcacctgcctacttaccgtcagtaaagattgtcagccttttggctttgatcttctacctagatgttctcagtctcattatgtgttgtctacagatgatgagacctttcttctacaaaactgtagtcgttttatagtcagggaatgccaggtttctgggttttcttgtcatatggcccagcaagggataccaataaagagtcagcctttcaagatgcatatttggccctcttggctgtaaaactatgaagccttatgatacatttttataccctcctttactaatggatagtaagggagaaaaataatctcctggtaacattttagaaagacgaatatacttttagcaagatattgtttttagtttgtagaatgataatcctctcctggaaaagtaaatataatcacaggagaaatgtgagcaatagttatgctcttctgttccctaagaattctgagaattatgccatgcaaacttagccctttaagcttctcaaactaaagttaatacaactgtttttcttcctgtcctgtgaagcagtaaatgtctccagttgaagcccagggaaccgtcctcactctctctctttatatggtagcctccagttcctcatggtctttcgggcatctttgtatgcgtgtcttgtgaaaaggaaaattttactgatactgattcatactgataaatggcacatccaatctctcaatgatccccttattatgtaatcttagcgttgtttttctttctggtaggaagttcccatttacaggccctgttagtcctcctacatcttggctcagtgtaactcttttggtttctctttgttgtcgtttctgttcaaaaacgaagctcttaaaatatgaacagttttaaatctcaggcatcaattcaatctactttttccaaatctactttgagtacagtagtcaggagctagcctcacagggtttttctctctcctgtggggctttatctagggcattaaggatttgctaagatatcaggggtattggggtgaatgtgtatgtatttaacgtgaggcttactctagaatcactttgtaagcatactttatttttacatacatgactcgtgcaaagggaaaagtatttttatgacacatcaccctcttaattgcctaaagagacctgagttcaaatattggcctttaaattatcataccagtgactctagactgtactctgagggatatattgtaacatacccctgactcgctgcaaaaaggtccaggattagcctagatatgatgtttaagtgaattaattttcagaaatatcagttgattttaatatggtatatctgtaataaataggggacaagaatcacattccacatctataatattttgctacagtaatggtggatgctggtaccatttagctaaattatctccaaaatttgtgttttccatttatgattccaagtttttaaagatgggaagaacataaagttctgttctttgagcagtgttctgaagtttacaagatacattcctgcctatgatcccacttgatcctcatgacagttccacaagctgtgaaaggcagttcttgttctccccattttatagattgttaaccaggaatccaagatcaagtagaaattgcctgaggccacatagccagtcagggcttgaagagaactcaggttttctgtctcttggcttggcagtattctccaagcatgaatatgactgctgggactatggactcaagtgttttgttgttgtttataggcaaaccattctgcagcccattacagagcgatttatcaaagaattcacttgaagtcaaacaccaagtacatggagctagaggcaacacagaaagatgtgtctgagaaagggtcaggaatttagactggtggagtcgtaaggacattggtggctaaatagtagatcttctctggtgaggctctatggaattggaggtgggacatggcctgatcaattagagcaatattagaggcaggagttttagaataaaaggtgagtgtcacagaagccaaggggatctgggtgaatgtgaggggtctgtggaggcttttctctactctggcaatctgccagtcaaaagaagatgcaatttatggtgccatagtagggccactcttagaaaaaatcctggcttatattaaaggggagatatatcctgttatgacgaggaaaggggtttgctttaaaatttcgagtcacctgttcccccttgactcttcctttcccacttttaattcttaaccttttctatgttgtttcttaagcttccctgggatcagagatcttgatccagtcttattctttatacatttttgtgcatgtagcaatagactgtccctatgcaataatattaatatgggacttgtggcttttcccccccagaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactgtaagtatgatgtccagctgcctaccccacaagggctttggtcagccattccacctagaatttgctgtctggctccatctgactttggaccattatcccctgaacattatttaaacctcctccctaaactgggagctcagctggcttgttgtgggtttttaaagcatcatcatctcagagggagtcgttattcttaacatactgcttcttagccttggtgatttttgatttactgtcctgctgagatggctttggtgatagctattgcctgtgctggctgctaggcatgaaaagcaatttctgtaagttttacaaacgtccagggactgtagcagctctgtggccgagtttgtttcactcatctatgttgtctcggtttccctccccactgactatgttggaaatgttcaatgccaactccatgtccacttccataaggaagagcccccaggagccctttgtgtcttcacatcctcaaaccttagcatgactatgacttcttgacagagactatgaaagagaagaaccctttttgctttatttttcagcattgagcacccatagtcaggacaattagtttgggggctggttgtctagccctccacagaaactaggtctactctgctaggatcagaaagttctccctcatggtttcaaccccacattgcttcacatgcttccttagactaccccataaatcttgtcaactagcgcctttgcagaaagaatgtgaggccatgaccggaacagttggactctcaggctacagttatgtaagactcaggaaaaacagatgattttcccattctctaagtgaaaatacattgaggttcagccacagactgtcttcagggcagttgtttcacgtggggagacgctagcatggcggtgagatgctaggatgtcggtaaccttttcctgctcctccacatgccatagtttcatgacagcaccctgccattcaattgctgtgagatatttacaaatctgcaaaatgagtctgataatttctgccttagaagacactaagggctattaaatgcttgggaggagagatgactccaaatggacttaagaggtacataataaaaatgtgactatactgtaggatgaaatctgaaactgagaatataagatctttttagttgttggcagctttaaatcatactgatgttcaggaagtttaattatttgcctgttgagtggtaaatcacatgttccttcaccaagaagtggaccagtgcctcaggacctcaaaataattgaatttgtttggcttatgggcagtgagtctcttccggttctccatggctgggcttgcctagggagcctccctgccttgaggtttgaccttctcaggttctcctatacccactttcctagactttagggagattctattttctttacttgtttttttcttcagttggtttaattttctgtacctagcagttgctgaagtgattccttgctctgtatgagcaaggttgaatttctagcccaagttgcttaacatcccctgattttagccagccgctaccaactagtggtctgtaattttcttttcagtggctggtaactgtgggcccctgagtcactgctgagtacagtgtgtacaaagaggttgcttaagcagctaagtggaaaaggggaggtgtgtcttttaaacaggtcctgaggagaaggcttgggattttttgttttttaggtgtctagatacgatttattttcataacatcctgggaatcgctctgcccacttcacaccacccagagggactgttgcctgcctggtacagatctggggggctttcctggggaagggagggtgataacaggaacggttctaattgtctctggaggagaattagaaaaagaagtgtgggtgtgcctccaacaagaccactgtccttccaagctgagtgagtcgctgattgatacctttgggtcttgaggtcagggaaggttgttcctgaggtagaagcagtaccagcatcagccctgataccagcgtctgccatggccctgagtgagagccatgtcaaagtcccccataagctctgcaggcaggctcgcagccacttctcaaaccccaggcagtgaggtgattttcctgggatcctgtctccctgatattttctgcctgggatttgctggtgtggatcatgcatggctgttaggcagtcctaacaaatggacccacagtactttccctgagcaatttgattctgagaaatctgtcggcacacagacgtgccacggtaacaatcacctgagacgacttgggtctcagcctcaggtgtggacccttttgttccctccatcgttgttgagttggaagtgtccagagatcctccagtgggaacacttaatgatgcagatgaaaataaagaacaaaggtgggctgggaggattaccattaacttgactattaaatatgcatgaggtagggaaccagtcaccaggaagctatctgttctttttatttcactcctttatttcactatttttcataatgactgggatatcattatgaccagagagaaatcatagtgaaagaaacatgtttgttactcataatacagtggtacctctgataatacattttgctgtattactaatctttcctaattctccaaggacatcagggccctcttatttacatgaatgtaatgctaaatcaggcatcaaaattagagaggccatcattctacctgtgccagggcaaggctgctgggtttaaatctttggcaggtcctcagcttgactcctgaagtagccatctctcctgaagaacaaaggacaattggtaagtcaggaccaaagtccagctagtctgaaattgttagcaactgtggctgaacctattttatgcccagacccatgcatgccaagctacctggggtaaaccggaataagagggttcctgtcttccccaagagttcacagtctagctaagaaagaaaggcagtggcatatggcagtgctaatggggacttacaagtcataatgtgttcagagttcaaccactgtcaactgaatatgtggtgagtgcacacactaggtcgaagtagtggaaaaggtcgggtagatggagtgtgaggtgggcattaggaaaaacttaggtggatggatgaagagcattccaggtaagaaggatgaaggaggcagagattatccaggatggataaatgcattctgcagacatgtgtattaggggaggagggagctggaattcctctggtaccactaccaccaaaaaaagacttgaacaaacctttaaaatcaggagtcttcacataaaattcagatttcatgctggaacaactggacatccatatacacaaaaatgaatctagatacagacattatacctttcacagaaattgattccaaatggaccataggtctaaatgtaaaatgcaaaactgtaaaacctctagaagataacataggagaaaacctaggtggccttgggtataattatgactttttagatacaacgttaaaagtataatctgtgagataaaaacttaagttggactgtgtttaaactaaaaacttctgctctgtgaaagacactcaagagaatgaaaagacaagccacacactaggagaaaatatttgcaaaacacatatctgataaaggaccagtatccaaaatatacagagaactcttaaaattcaataataagtaaacaaagaacccaattaaaatatgagcaaaaaatatgaacagatacctcatcaaaaaggacatacaggtgtcaagtaagcatataaaaatatgattcacgtcttatgtcttcagggaaatacaaataaaaacaacagtgagataccactacacacctctgagaatggccaaaattccagaacactgacaacatcaaatgctggctaggatgtggagcagtgggaactctcactcattactggtgggaatacaaagtgatacagccatttttagaagacagtttggtggtttttcacaaaaccaaacatattctaagcatacaatccagcaatcatgttctttggtatttacccaaatgagttgaaatttatgtctacacaaaaacctgcacatggattttgttagaagctttatttataattgccaaaacttgggaagcaaccaagatgtctatcagtatgtgaaaatggataaacaaactatggtgcacgcagacaatgctatattattcaatgattttaaaaagtgaactctccagccatgaaaagacatggaggaacttttaatgcatattgctgagtaaaagaagtcagtctggcggggtgcagtggctcacacctgtaatcccagcactttgggaggccaaggcaggcagatcgcttgaggtcaggagtttgagaccagcctggacaacatggtgaaaccccatctctactaaaaatgcaaaaaaattagctgggcatgatggtgtgagcctgtagtcccaggctcaggaggctgaggcaggagaatgggttgaacctgggaggcagaggttgcagtgagctgagatcgtgccaccgcactccagcctgggctaccgagcaagactccatctcaaaaaaaagaaatcaatctgagaagactacagtatgatatgataccaactatatggctttctggaacatgcaaaattatggaatcaataagaagatcagtgattgccagggattctggggagaggaagagggatgaatatttggagcacagggtatttttttcgcggtgagactattctgtatgatgctggaatgggatatacacaagacattatgcatttgtcaaaacccatagaacacaaagactgaatgctaatgtaaactatgacctttaataataatgaaccaatataaatattggttcatgagttgtaaccagtgtatcgcgttaatgcaagatgttaataattaaggaaactcagaatgtagaaatagagagggtatgtgtaaaactttcatgcaatttttctgtaaacccaaaactgctctaaaaaatagagtctattaacacatctttttaaatccagatttccagcttcttttgaagtgtcagaagagttggttacactaaacctatgtgaaacttgggagcagatgatactctctggtctctataatctcacagctggcctgcttcacttttatacctaatgcctgtaggcccatagtagattaaaaatggccatagaatctttgcaacccctcccattaagagctggagcccttgaatctaggctgacctttaccctttgacttattttggccaatagaatgtggaggaagtgacatcatgtgccttcccaggcccaggccacaatgcctcacagctttctctctcattctcttggaacccagtcaccatgtaaagaagcctgttgtagcctccttaaagatgacggattactggagagagaagcccagctatctctctcagcgcagctcagcattgggaccaccagtcagttgaatgcagccacctgggttagtcaggcaagaccagccaaagcttcccagacaacctatagattcatgataaatatcacattgtgattattggaacccagtgagtttagggtggtttaatatgcagtgatagtaaactgacacaagtcctgtgagtttgtgaccgcggagtcatgggcagctgtcttgggatggggctgagctgtctgcatgaatagaaaggtatggaagagtctcactatagtatagtgcagcatggagactagcctctcagttttcagaatcttcttggaaagaaaacaactcgtaactgagattctaagaaatttgggaaacaaaatttatggctaatggctgaggcaaacaagaaaggtggctcaaatattggaatggaaagcaggaaaccctaggttttagttctggcatcgacattgcctggctgatgatactggtctctggacctgagcatgcccactaccaccatcttccactgtctctggtggaagaaatggggctgatccacctccaaggatgagggtcgttcaatgggtgcttactgagggctgcagaaataaatcattctctccttccacagtgaccagtggggcatcatgccaactcctttctgggagagagtgattttaaaggaggaagtaaacaaatgctgagaaagaagtcagggaatgccccaccagggacataacatgctgcagtaatttccccaaattagaaactactaggtaaatgccttctttagaccacaaagattgaaagattgaaagaaagctaggagggctgggatgattactgcaatgatggaacccaaccttggagttctctctgcctaagtggtccccacccctaaaaaataactaactgctcagtagcctcataaataaaactaatttttctcgtccttccgtcttaacacacacgctcatgcatttccaagttatttctggtgacctaaaagacgcacgcatgccaaacgcctgcagattctgccagagtcaaccttcttctcctgtcttagtggccagagaacagtccctggaattcaaaggataaacaaggcctgcgtccagacagagttgtttctctgaaacattgctggcttcttctgagtttgattcagctgttctctgatgaaattcagggaaaacttgccttcagagatatctctcaaattttactaatcttccactttagttggtcaacattcattccacaaatgtcaattgaactcctactgtgggcctggtggtggtctgagtgctgaagatacagtgatttaaaaatattaaaaaaaaaaaaagagtttctgctttcatggattttatattctagtggagacaggagataaatcagtgtttaacacagtatgtcacacagtatattgagaagtcccagggagaaaactaatggagaaccaaggagatagggatttggaggagaaggaggcaagtgactttagctctctgtacctcagttttctcatctgtaaaatagtgtgatcataacctcctcaaataggtggcatgaaaattaagatcatcttttacttacgtattttagtactgtgtatggcaattaatagtattattttggagggctccccccacaaactgtccttactttttctccagtccctcagccatggtatgtatttttcctgtgcagagaaatgtcccaggctgtcccactcaccttcccccaccagcctcctaccttgaatctgagactggagctataactcagtccaggctttaagtgatcagtgaagaggaggaaggaacttctgctgtagaggcaggtgctacccctccttaaagcaagaccagctagggtagacacgccacaccctgttcctgaaagatttggaaacctctgaatcccacagggtacctgataattgtgtgcatagctgttatttattgagaccaaatgaatggcaaaatgaataatatgcattagacaagtgataattcatagcatttttttttttaaaaagcaattttaccatccccatgctattttatgccaaagggttacacccaaacaggctgctatgcttttactagaattgtctctatttgtcatcctttggaatgtggggctttgaaagaggaagttttcctctgtggctggatcaactttttgtggagaaggatctttccttttagatggagaattctgtttctcacccacctccaagcagaaaagatctcttcagaccgatttgcctgaaaagttggtgacattccccacctttggaaataacctgaacgcctcattgttttcaaaaggattcatttgcccctccttgctccccacagtgcccttggggattccagcttacttactcgttcattgttgtttcttggacatgccagataccctccctctgtcacctcaggctcctgggctgtggaggccacagctctgccctgtaactaggccacgtttccttgacattttcagtttgttactggtgtgacccattttctgagtggcttcatgtccacttttctctttccctaagcaagatctcactcatcaatcgggagcccagctgggcttcccttggttgagggtggaaattcctgccttcatccaatttttatgagataaatgtgttggttattagtggtggttcttcttttttaaaatataaaaattgcttgagacagacctcacacttggtgacccagcagggtttctttcccaagcaccagggacccatcggtggcacttggatctctacagcctgtcagcagagggggtatgggaggaggtaagggcagagcgccgtttgaatgcctagccacatccctgttttccagcagagtggaaatcacaaatggaaaaatgttttcctttacacatattgttctgttcttttctcctgtacaagctaaaatcatataaagggtctgtattttttctataaacttataaatcttgctaaataacctaaaacagtttccaaaaattgccctgacatacacagtacatgcttaaagctttggagtttaattaaaggtatgaatgactgaatttcattttgaatttagctgccctcaaatgccttatgacactgtattttatttgtgtaagtgttaggcattttaaatctcaaatttttggtagaatatttgggaaggaaataggcttaagatttcgcatggctttttcaacattgttatgcctgtgagggaactttgaaggaaatctaaagtgttatttttcttatttaggattagattagaattgtttctacctctgtgtatttaatctgagggatcttattcgtagattcagattctaaattgggtaaattaaaagtacattagagttcaagtactgcttttgaaaccttttttagtcaatctggaaagcagatgcttacttagctaggaaagcattcctagttggaaacagccttagaatcttgtttttaactccttctctgcattagggatctggaaagccaggcaggatcaaccataggcttcatttggtctctgttacactggtcttccaaggcagacccttagctctgtgcactggttctcagagtgtggtcctgggaccagcatcattggtgttacctgggagcctgttagatctacagaatctcaggcctcaccctagacctataggatcagcatattctggaaggagggccctgcaatctgtgttttaccaaaccctgcagatgattctgatacatgctcaagtctgagagccatagtgcatagtgatctagtgcgttaagctcatggacttccaccagaataaaatcaggacttacctcagtgtaaagctctcagggccaagcctgtgtcatcaccagcaccctatgattgtctgtgcagtgatgacagtactggggcttaactgagctctgcccgtggcctttgggatcagtcacagcttatatagctgaggagggatgggtttgcttttcacaggaacctattagctcaccagggctgcactttccatctccccccaaaagcccagtcagctgcttcgcaaatgcgtgcctgttggttacaaatcaagacagggtgggtgcatcaattaatcaagccagtagatgtttttattgtttatctattgtgtgtgtaacatgaaaagatcaagatgctggtattgacagaaaaatagctctcaggctatgtgatactgaaggtgatggatgagcatcggcgtggacagattagagatgtctaaatcagcatttcccaaactggtacaggaagggaagggggcaagagctgctttggactaagttcaacacattctttctttttttttttttttttttctcgagacagagtctcactctgtcatccaggctggaggtcagtggtgtaatcttagcccactgcaacctccacatcctgggttcaagcaattctcccacctcagcctcccaagtagctgggactacaggtgcacacctccacatccagctaatttttatatgttttggcagagacagcgtttcaccatgttggccaggctggtcttgaactcctgacctcaagtgatccacctgcctcagcctcccaaaatgctgggactacaggcgtgagccaccatgcctggccagttcaacaaattattgactagagaacttctgagcctttaatatgtccatcttgaaggggcatctcttacgctacatttcctaaatacgttgaccatagtacatgatttctacagcacttctcttaagcctcttgaaagagcattccatggtttgggaaatgctattctaaatcgacattctacttttgaggggggaaaatgtatttctcataatggatggcattactatggtagagatcctttcagagaacagagattttgtttatatataagtgtatggccacaaatagctttccgaagactgaaatgggttatagggttatatcacgtgaaaagcattggtaagctttagaatctggggcagggcaaagcctgtgtggcctgattgtggatctaccagggtcaagcctcagctctgccatttcctaactgtgtaaacttgggaaagttatttgctatctctaagctaaacctcttcagtgaaatggtagcaataataataatacctactttcaaggttataagataatgccttcctaacacttagtaaatggcctcgttcagagtatcaatcaataaaaccaatcaataaaaattggtttctactattatttttattccttcttcttatttgctctcagactgctccccctaccaatgaacaaacccctagtgttgatttctttccgtggtggcagtggatggacactcaatgtttacttttgtttatttgtttgatcctgatgtaacataaagcaacccagattaaaaacattgatataattttaaaaaggaattaaaataccccaaattaaattaactataaataataaaatacactgaaatcaatagaagtgctcctcttccaagacaggcatcgaactgtttacacaaagagcgttggtcaaagccccctaccctattgttcctccgttgggtggagccaactggaaactacgctgattaggctagaaactaattgcaatctcaactctccactggggaagaatttagcctcaggaattcctctccagcctaggactctgtgttgatttgactgtcattatggcaaaagggaaaagagcttctgaaaaaaaaattatctggaaatgtagcatcttagtcattcactgcatttgcactatcaaattctcttctaatatctatcaccttccttcacaaggaagcagtggagttctcactaagacattgctttaatgttccttctaatattctttatgaagtaaaggcagctggtgatggggctattccctggctgttgtcaaaaatactcagaaaagggataaaatagctgcattacagactaccctattacctcttgttgccctatacaggagaagccttgtcttcagggaaaaccaagatgttattgtccacaaacaaacaaacaaacaaaggcaaaggtgttcattcaaggttgatgtattaggatcctaagaagaaactttggtgcattcaaaataacataactcaaggagggtttattaacaaaagagttggtgccgaggaatcacaagagatagtagagtaagccagggctagcagctgctgcccagtcaccacccttagctgagagaacatgagaggaaagtggtacaggaacccagaaggatatatgagttggtgtcttgacaggagcagtgaccttcagtcaagggacacagccagacctttcagaaatggaataaatgccttggccctctccttccccctgctagtctaaagagctccccattggtgaacccaacaggaagcccgaggttgcaaaagccctgttgaagaaatccatgctggttagatcccagagaagagatcagggtaaagattgtgtctggagaggcaaattaatgatgtccaaagagtggaaacagcaggaatagctatcaataaaggacggcctaaataaatagtagagttgagtactatccagtacaacagaggaattaggtagttctgtatgtgctggtctagagctgccttcaaaggcacattaaagggggaaaaaatggtgcaggacagtgtgcagctgtgactctcagtccagatggcacatcagcaccacatggggagcctaaaataaaaattaccaacatctaggccccttccctggagcctcagagttaactgatctgatgtagggtctgagtggtggtatgtttctgaagcctcccaagtgattttgatatgcatctagatttgaaaaccatcagtgtacattatatgatactattttatataagaatccagggatatagacacaggatttatagacacacatgggtgggtgtaatatctgtaatatttctgggaagatacaggggaatgaatctgtgtggttttccctgaaggaggcagatgggatggtgatctgtggcggaaggaacactgccttttcattttaacactaccctcttgtggtatgggattttttttttttttacatgtgtgtgcattgattgtttagcttcaaaaactcagaaatacatttgcttggttttgaaatgaccattcattcattctcttaaagctttggaacatgtcttagtgagaaaagatttttctttttttttttttttttgagacggagtctcgctctgtcacccaggctggagtgcagtggtgcaatctcggctcactgcaagctctgcctcctgggttcacaccattctcctgcctcagcctcctgaatagctgggactacaggtgcccgccaccacaccttgctaattttttttatttttagtagagatggagtttcaccgtgttagccaggatggtctcaatctcctgacctcacgatccacctgcctcagcctcccaaagtgctgggattacaggcatgagccaccatgcctggccaagatttttctttttaaccttaaacttttttgtgttacctcaatagctaggagtctaaatgagatgctatttgacagaagagtaaggcctttaccaagaagttgttgcttttggtggttttttttttctttctttttttttctttttagacagggtctcactctgtttcccaggctgagttcagtggtgcaatcacagctcactgcagcctcaacctcttaggctcaagcgatccttccaccttagctcctgagtagctggatagtcccaggcatgtgccaccatacccagctaattttttattttttgtagagatggggtcttgctatgtcgcccaggctagtcccctggatgcaagagatcctcccacctcggcatcccaaagtgctgggattacaggtgtgagtcattgtgcctggcctggtatattttaagtgaaaatgaaattaaggccattggtcattgaatcattccatcaatggccaaatggctccctctctccaggctggcctcgcccagggctctgtgtcagtgtagtaagtggtaactgttggcacagcagaagaaatcacatatggagttaactgagctctcgctcaggaagctgagtagaaccagttagaccccagcctctgggctatttcagattttttttttttttttttttttgagatggagtctcttaccttgttgctcaggctggagtgcagtggagcgatctcaattcactgcaacctccacctcctagtttcaagtgattctcatgcctcagcctcatgagtagctgggattacaggcacgcagcaccacacctggctaactgttgtatttttagcagagacggggttttaccgtgttggccagactggtttcaaactcctgacctcaggtgatccacccgtcttggcctcccaaagtgcagggattacaggcatgagccactgcacccggcctcagatttcctattaaaattagggagccctaacttaagaaaccagaaagtcaatgttaacattgagcagctactcatgaactcctcctccagcccccaaccaacattgtgaaatgtaagtagttcaattatgttgagctatatatagttctttcacctgatcttcatctgtcattctccatctgctatctacccaatttcctttgaaagctccattttaaagcagaatatataatggaaaaaccttaactcctgacctttatggagatatactagagttactcaataataattagcagttgccctggtaagctcagacttactgcttaaatcacccatatttgtcaccatcccctgcctgtaggacaataagatcacctgctttgtgctaatgaaaattgggacattttagtaattttataatccttttcagcttctgttgtaagggtagaagtgatattgtttgtgattatgctaaaaagaggctttttgttttgttttgtagttaccaaagcagtgagatagaaatcattctgggttttgagcaaattggaaagccctgttcagtctattttgtttaccactgtattgaaaaccttcaaaaacttaagtaggtgaaacttgcagactagaatttaaggatgatggccctgagatagaaaaggagaatgaaattggcaagtctgtcatcatatcagacgtcacagacaaagatgagtaaagcccactaactccagcactttgacttgcgcaatgctgctggaaggttggtaaatccaaagctgaagcacaagagagatttcttcaaatgaatgtgttggcttctgctctgtctcgggggaagcctgcatcccctctgtagcatccatatactgtgccttacagcatagacctcatggtagcatggtaggagctccatataactctgcttcttctggaggagaaacagacactctactcccaaacacacacatacacacacacacacacacacacacacacgcaatcccctttcccatttttcccttgatcctttgcgtggaagtagaattagaggaaatatgtccttagtcatcccatgacagcacttaaaatgttcagttgtcacagtgaaaataaactggcaagaaatcagaaatcaagaagtggagtcatgggaatcctggacatgctaatccaatagagacaagatctacatgttagtgatggccatggccaaggtaatcatcccagacagcagtcagactctgcattatcccaagagaagactacaaacatttcatttcatatgaggaaataaacacccaccaattgcccttactgcccgctttccccttcagcctcagtggaacgcaaacttattttcatctaatgtttccctttggagtatggcaccaactgttgaatatttgctactgtagcctaactgctctctggagcactcactaatatcagcatccagaatcggccagctctgacagacagtcccttcccagtcagtgagcaaacacgcattgaatgcttagtgtttaagacactattccagggtacagtggcccacacctgtaatctcagcacttcagaaagatcacttgagcccaggaatttaagaccagcctggacaacatgacataccatctctattaaaaaaaaaaagttagctgagtgtggtggtatgcgcctgtggtcccatctacttgggaggctgaggggaggattgtttgagttcaaaaggtcaaggctgccatgagctgtgattgcaccactgcactccagcctgggtgacacagtaagacctcatcttaaaaagaaaaagaaaaagacactattcgaggcactgtgaaaaagactaaaatatactctccttgctgctgctcagatgagggagatcagatctacgtatgtgggggagcattgctgccaatgcaagatacattttaagtggtaagtgagcagttgggtcatttactcaaaaatatttatggttgaatgaaggatcttggcaattgtaggcagggtttccaataatttccctagttcgttttctagatctgccttgaagtgtataatttcctcatctgccttggtcttattgctgtgagttgggtagaaggagttctaggtttgtttgtttgtttgtttgtttgtttgtttttttttaagatggagtcttgctctgttgcccaggctcgagtgcaatggtgcgatcttggctcactgcaacctttgcctcctgggttcaagcgactcttctgcctcagcctcccaagtagctgggattacaggggtgcaccaccacacccagctaatttttgtattttcagtagagacggggtttcaccatgttggccaggctggtctcgaactcctgacctctggtgatccatccacctcggtctcccaaagtgctgggattacaggcatgagccaccatgcctggccagagttctagttttatgatccatcttttttctcttgttctccaggaggcttcctacctctcagaccctaccaagctatgtccccaattttttgtttttttcccactgagacctctatggctctaatgttttagatttcaagaaaacttaaaatttggactataagaatgacatagaaaggaaaaaatatcacaaagaatgaaaagctgcaatttgatcatttgcatgtgttgcatttttgaagtcctccccaccccattgcaacaagagactttatctttaggttgtatttgttcttttttttttttttctcccaaacatctagcagtttactaatatttgtagtgggcaaaaatttgtaacaatttcttatataatgcagtatatcaaatatcctattaaaataaaatttagttcatatcttgaaggattattttctgaccttatatggaaaaggaaagttttgagaatgagtagttctttaaaccctgaatcaatgtaaccaggaaaaaataagtgaagagagactgtgccttgccatgggtcaggggaagttttactatcaaattttcatgcaatacccaaatctctgtataggtatgagggctctcttttctgtttctttgtctataaggaaattctaaattaaatttcctcttccttacaagccagttattaagttattaagttctgcctttaatttcagcttgaatcaattaggttagatgcccacaagcaagtgccctggttcatcatttcaaagaatgagactctttttgctgtatttttctttgcatccatggctgatttttctacccttctactagcagctcttcttccgcctccaggagtttattcttttcactagtatgccaactccagtggcattacaaagggagggttaataaaacctgtgttgagttggtattttgactatagctagctctgaattggagcatagagagcgctgttagccataacctgagtgttcctgatgaaactcagagccagctttctgccttagtcatcatttttggttcactttgtgtaagcaagttcccagtgtaacccactggccttggcacacctcaggaagaattaggtctctatgtacaaaaatgttcgacagaaacctaagaccctcatctagaatctgaatatataatcagtgtgtcgggcctcaaaagagaagagcaatgtgatttcatgtagaaccctatttgtatgctgccacagccctatgctttgctttacttcggattcatatagaaatccaagaatttgtagtaagtaagagaaagaaaacaccatctctgctcagctgagctggcccgtgtgccgaactaggaagatggctcttttcctctggagaggatatgatcttttcaaggttgctttttacacatcaccatggggctggcctggttgcatgctgaagctgtgaaacctgagtgtgtatctgtgcaaagctggggtcgaatcagggcccctaggggccctgcactggttttgttgagtggaacatacaggttggggtttttggaggctgggtggggaagagggaggagagatgagggtgttgtcagtgagggaggaactttggggaacagaaatatctaaaaggaagtttaatggactttcttgtacacggtgcataatgtgaatcctcgtccatgtcacctcatgcgggcttcggtaagaaccactccctcattcttcagtcttccacagtattaagagcttgggttctgggggcagatttactgaagagttcacatcccaactttattagttgttttacaatgatcacttcctttttaaaatttattttagattcaggaagtacatgtgtaggtttgttacgtgggtatattgtgtgatgttatgaggactgggcttctaatgtacccatcacccaataatgaacgttgtacccaatgggtaattctttagtcatcaccccaccgaccctccccacttttggaatccccagtgtctgtcatttctatctttatgtgcatgatgtgtattatttattccctgcttataagtgaaaacatgtagtgtttgattttctatttctgagtacgacgaacagttccttgccctctataagcctcatctgttaaatggaaacagtagtagtatctacctcctagggttgttaggatgaaatgaaatagttcatgtagagcactttgcatggcttctggctcataatcagggctcagtaaaagttacctgccgtaattatggtcatcgttgctcttttaacaggcactggggatttggaatgtgtttggagggttgtactgaggtgcagagtcctgcttcgtgatgggcacaaggtgagaagggaggctgccctctgggttccagtcatatctcaattaaagaataacacacgcccttcccctaactcatctagaacaaccccatgtacgtagctggcagtgaacacaaaagctctctgagtagccggaagagcccacaatttcatcagctctctagacctgttggacaccctcagatcagggtgactgagggagtgtgggcaggaagcccagaccaggaatccaggagaggctgcttagggctttggggtccaggcagagcaggaactataaggaggtggagccacttggaggaaggcgaggaccagaatggagtggagtggctcttttggctccacatgaccaccatttagctacttggtgtgttggcctctctacatccagttgctgcttctcagtgctcccctctggcttattctttcccaccattctgtgcctgggctttactctccctcacagcttctgcttccttttagctttggattgccatgacccctgacggccccagtgctttcatagcctcattctccttagaatttcacctgctgctttgctaaattctctgccatccagccctgagggaaagcatctatggactggagaccttgaggcaggggattctacagtttaatcatctgtagccacagtgaactgggttaccaacctttcagcaggaactgaaggtagagcacgttcgaagactgccaagtccaggacataccttttgcagacaattacaacaaacttggctccttggctttctgccatccagtattttgggagtaacagtcataccacaaaaggtggttacattcacagaatagaaagttaataattgctgatgaggcaaagtccagaagaactttttctgaagtcataaaagctgtaataatacaaaggtctggataaagaactagctacccttcaaatccagcagcagcttctttggtcacaactgtataacagcacaagacagtattgatttttataattttctcacctcaagtaaattgcatttgatatattctgtctttgaaggtagaaaaatgtgtgccgtgttttagaaaggtttcctttggttcacctggcacggtggcccatgcttgtaatgtcagcatgttcggaggccaaggtgggtggatcacttgaggtcaagagtttgagaccagcctggccagcattgttgaaacctcatctctactttaaaaaaaaaaaaaaaaaaaaaaaaattagctgggcctgatggcatgcgcctgtaatcccagctactcgggaggctgagacatgagaatcgcttgaacccgggggggaagaggttacagtgagctgagatcacaccactgcactccagcctgcatgacagagcaagactccatctcaaaaaaaaaaaaaaaaaaaaaaaaaaaaaaaaagaaatccattgtttgtaataagaataggggcgctcaaatgattacatttcatttgtttgtagagttgttcatcaatgatgtagattgtgtatcacaattccttaagacctagagatggtaatagtatgggggcaagcgcatgactaagccaggccaaccataatattttcatggatttttttgttttgttttaactggtgctgggttaagaatttgtcttgcctaccagaatatccagcagccgtgttctccatcacatatagaaagttcagctgcagccattccaatgtgcaaagagaaactgacaagagatagtggaagcattttttgagcttttttttaactctctctgccattcaacagatttttctgaatgtcttcaatatgtaaacacattaaagatgagttacaggggatcgtgcccttcacgatgagaaataacagaaacataaagtacttgtattgaatggtctaggtgctacaggataaagtgctgctggaattcctaggcaagagagatgactttgaactgggatgatcaaggaaggctttgtgatcaaattggcacttgaacatgcatcttgaggataggttggatttagacagcaaacagtgggaaaaggctcagaggcaagatcatacagggcacatgtggggagctgctcatagttaactttgaacatatgcttctcatctgtaatattacaattgttttgttttcttgtgtcaatatgctttttacctcttcagacactaaagctggggaagcctagtaatgttgtcttcccattccagaattccatgctagctggctcctgatgcaacatcttttgtcaatttatttcatgtaattgacttgcctgagacgttccctattttcatcacagctttgcttcatagtcaaatagacctcaccatctggaactcttttttttttttttttttttttttttttttgctcaaattttcttccacaaagggcctgttttggtttctgagtgtcacacaagatcttacgacattctgcatcatcctctttgctttgagttttataatgttaaaaagccaacaaaataggttcaaaaataagctgtattcctcttctgtgttgcaacccaagactaagcacatcagacaaattctgacaccttcagcttttagcaaaggctgtttggttgccttggagttaggctatatctctaggagattagctctaggctctgagagggtaaagcaactcagaaacaatcaggatagaccagattcatggtgggattaataaggagaggatatagatagtgatcacgtagacttacagaaaatgcctgcttatttttactccttacacagagttgttttgtttagccttcacttactatgctaaacctgctaaagtacatgtggtatttattttcatttggatgggtagcatcccttctctttctcaaactgtaagtgaactatggaaactgcatcccagacattcagtggtgatagtctgacacattgtcacagagcaccatgcactactaaagtgactgttggggcctttgcttttgcaatgtttgcatttctctcaatccagggcctctctgggctctaacaggagctattcctgtcttcctcacatgtttctgaaaactgaacactggtgtaaatttccctaatgtgacatcttttacatgtacagacagttctattcaagaccctgtatgtcagcttgagcagatttacccatcagtgttcttggttgcaagtaacagaaaacctagcccaaataagttaggctaaaatggaacttactggttttccattgtgcaggaacatttgtattcaggcatggctgggtccaggggcacaggtgttgccatcagaacccagctcttgccagctctcatttcagctttcctctttgctgactctccttagataagctctttccttttgattgcagggtggttaccaccagctggacttaccttcttaaaaagcccaagcccagcagaaaagaaagagagagcctctttttctcagcagtttgaaatacaggctgagcctaatttctgttggtccacattgagtcccatccccatcccttaaccaatctttgtggccaggggtataagtgagcctctgtggggctgggcctgaatcacctgttcacccttgactgggtgggaggggagaacaacacccaaggcacacggactctgcggatggagaaggggtggtcctcagagaagagacagccacagatgtcactacactggacctttcttatggggacttcgtgaaggatttggtgactttacactccaggatccaaatttgtactgctttctttcccctcaatagtgttttatatgatctctgaaaatatccccttttttcagtccaaaggcttcttgcataatttattttattcctagttgactgactgcctcctttaagaaaaacgtattttatagttttttaaaaatgaagaaaatgttatcttcctacttagccctggacacagttgattcatttaaaaaacaaatttctgggaaaaggctttcattatcagtgcccattacaggttattagagaacaaatggcaaacaccggtgtgctggggctggcctccattcattttaatgacagtgttgtggagagtgcatcttagaatgtgactaagcagaaggaaaagaatctgaaaaggactggccccttgtcttctgtgagagccatgaacatgcaaaaacagtggctcagcagctctgagagctcctcagacacaggccactgggtggtggcatcttttggtggcctgccagaaacagtggggcagccagcatccacctcacgagctttgcaaaagtctccaacttgttgtgacattgtccaaaacctatgagtttggataagaactgtttcttctgccaggaatcacattgagcggctggaaaattccacctcagtttgatcttccagtgcctggttcatatcctgagaacaaattttgttctcaaaggttgaaatgaagtctccatgagctatggtgatgataatggtggtaatgacaatgataattcacattaaggaagccccagtgtcccaggcattttacatgtgtgtacttatttaatcaacataatgccggaggtactgttgtactccacattttgcacatgaggcatagagagattacctaacttacctgagggtagaggtgggatttgaacccaggtggtcaggttctagtactgccccacccacaaccactatgcttagttgcttctgcgggcaatggttgggtattggcaagctacagaagctgggtgtgttgggaaagagactgaagcagcccagtcatgtttcttctttttcttgccctccattctctggtatcgttcaagtatcagatgctgggggagtttggggagacaacaagagcatgggagaataggaagcagagaatgagtacctaaaaacagaggtcagcgggccagagtttaagagaaaaagagaggggaaaaaagagcaggaaatccttgaaaggagctataataaaggacagagaatataaaggataaaaatggattccaaggaggaaaaagaatgggaggaatgtttattgaccatctgctgttgccaggcactagcctagggcttttccatatgttatctaatcttagaacccagttagatgaacaaccactatcaatattcccattttacagatggggaaactgggtttcagggggataaagtgacttccccaaggtcacagaaagcagcagtttgagctgaggcctgtgtgacccccagccaacaagtcatccatcgtcttgagggctagtccctcattcctggccatggtttgtagccctagatgagagccgcacttgagatcttgagatttgacagatacttggagatcatactccaaggaatatggccattcctttgctgggaggcagttgctgtgtacttgcatcacaaggaggagaggggaggggagaggaataaagttttatgggacacctccttacttcccaagtttcaaacttttatcaagccaactctttaaactttaaatatgttgccagaggtgctgtcacttccttaagcattccataactctccaatctcaggtaagctatttttttcccatacttgtgagatttcctcctacatttgcccatttctgccattaaaaacaaaactaaaaactttccctcaaaagctgaccatctgcttgtcactacgctttcttccaaattgaagaggtggtagcaggatgtttgcaagcccagtatttatctctggcgtaggcacaatcccagcatctactgattacatttcccatttactgttaggtttgcgatttgggatttgaacttcctctgcatttttttttgtttccttccttttatttcttagaatccaggtctaattgtccccttaagggttagactggtttcaatagatttattaagtgatgactttacagtgtgggtgttatgtccatctcaaaatctgtgcaggcaaccatcacatacatgcttgtcccctattgccagctaaaactgaggcagcattttcaagaatgccaagcctttactaagtgcaggcatttgtttgttatttcaagtctttgtatgctgacaaattctgtacatgcatgcgtgtgtttagagcacagttgggtgacatgtgccaggtatctggtggcaactgtcctctgagcatggttgataaccaaataaaatccaggaatgtgaggcttgttactctttaaaaaaaaaaatacatgtacagttgagtaaaatgagaataaaaaataagattaacaaaggctgagagaggaagagagtaattcatcataaaactgtcctgagccacctagcagccacgacaaagaagggaaaaaatataatgggatgtatagttcaattgtctgttcaaaaaaagcatgccagttcatcaagagctacaagttataatattaatttgtcatgtgaatctctatattaatgattttgaatagctcaatagataatatcttccaaagcagtttcatgcaaaaaataaatgaggccctctatatagggctgttactcccattggttttgattaaatacagagtctgatattaagctgaagtattgaaaggttgtttttactatggtgcaacaaggagaacaacctggagaaagcatgtttgctggtgatcggcctggtaacagaatgataggtggaaggcaggatccctcttagaggatcccagttatcttggccatgcttttgataggagctacatgacatgtattctaaattgaggtctgtgggaatataaatacccgaagggcagatacccatgttgttggttgaaagaagatgccagaggcatagatcatgttttattgaggctgactggaattcttgtctccatagggttcatgcgagttcagcaagcagttaccatgtctacggcatgccaggatactgttgggaaggtagtattccgtgtacgtgagacctgcacccaggtttctttaaggtagcctggcagtgctgtgacagagacagactcaggatgcagtgggacccaggggagggacactgagcctcaccctctgggctgcatcttggtaagtgagtaaaagttacccatgggaagatgggggacattgcaagcaaatggaactgtgcaagcacaaacaaggagaaaataaatatggagtgccctcgaactctttggcctcaactgatcctcccacctcggcctcccaaagcactaggattacgagcatgagccactgcacccggctcatgctgcatgcctgagaagtaacaaaccattctgcagggtgtgcaggagccacgagggcctagagggagtggagtcaggagagcggaaaatcaccacaggccagaattttcaagagacgtatttttaggcaggtccaagatgtttctccaaaaacgaagtggctttgcattgttttattagtaagagtcaacatttccgaattcaggcacttcgcttcgcaatttacataggcattgtttttcttaatcctcacagtcacttctgacaggtgggtattgttttcccatttttgccggtagcagcctcagaaaggttaagtaacttgcccaaagtccacaaaatctaactgcagagacttccccacctcaccatttgggagcttttttgtccaaagactatgaatgtcctaaatcagagcccaagtagaattggagttctgagtcatgctgtgtggaagggagaggtgaccttgacctagactgcaccctaggcttccctatacctaaaaaatttaccctgaagatgatttttctttggtgaaggctgttagacattgaggctggtctgcccacaaagatgaatttggttttggcaaaactaagtagctcctcttcccaagattcagttgctgtttgagggcagcatcaaaacagagaagtgttgtatcttcctgtgtgtaaagcaggaagggtgacatctgtttcttccaatagcctctccatgttgtttagaaatcagtatttcttaaaaggaggatggcagcaggtagaacaaaatgtcaatattcattcagtgcctcttctgttttatccagctcagagattctgtcccatgcaaaataaaagataggtaacaatctattgttcagtgttaaggatccggttgggtatgttgttgtacatctccacaatggcatgctacatagccactaagaaagaacgaggaggcaacttttcgtgtaatgatggagcaatctccaggagatactgttaaggaaaacagtcaggattcagaacaatgtgaataactggtggtcatttgtttttaaagggaaggggagtgtgaaatcacacacacacatccacccacaccagcttgcaagttcatttagtatctctggagaaaatatgagaaactcatactaatggttacttctggagagggaaggaagagttatttttcctgtctacccttttatactgatacccttttatactgtctggaaattttatcaactgatataatagccattccaagcaatagattaatgtaaaaattaaagagagaaaatgccccatcccctaaacaagttgaaacatattcatataatttatttgtagatatatacctctatcccatggttgtgaattagccgtcatatgagtattttaaatttgtagtctataagcaggcaactttttagcaatatgggattacataggatcataggtaattggaaccctcagccaaatacttgctgatacactacctctgagtttctaaacaagtgagcaagaaagtcctgtattgaacttctaagcctcatacctgtcagggactgataagtacacatgggcaggttctttgatatgtttccaagtccattatcagagataaggaagcttaagtgtaaatctgtgatttaactacatttcaaatttgatgtggagctacaggaaggatgccagagagaacctgtgtgctccgaatacatctgttgctctagctctttaaaagactttcttttccccacataaaaggagcccaaatgttctctctgctatataaggctatttaactgacctaagggctaactcttactttttggtgcttcacagatgactaagtggtggtattattttaaccagtaaaaattcagaaatctagggtcaggcttgcagctggcagaacttgtaaacagttaatgattgaaaggactaatcagcatcttgaaaggcagctcatgagaagcataagcaaaatgcttaggggtgcctgcagatagaggactgtggcactctgtggtgacagtgaaggaaaatgtgtttgatgtcatcttgtcacagagaaaggctatctgtcagacctcaacttagcatgagtttttcttttgtaagtatgtaagatattttcagaaatgttttagaaaaaagattgttttttaaaccaaattttcagtgtctactcgaaaaaaatggtacacttttttttttaatgaagaatgttggataccaaaatgtaagagatttctaataaacagcccttctcagttggtacagacttcaacacctggtctagaagttttatactattgggcatatgtggggtgtgggaattattgtttgtttagtatttttgcaaaagcaggcttgggtttctttctgattcttatttaggtttgagagagaactgccataagaaggtttttgtttttagccaattttgactttttcccttaatttttaaatttcctcatctgaaatatggcacaataggccaggcacagtggctcacgcctgtaatcccagcactttgggagggtgaggcaggtggatcaactgaggtcaggagttcgagaccagcctggcaaacatggtgaaaccccttctctactaaaaatacaaaaattagccgggcgtggtggtgtgcccctgtaatcccagctactcaggaggccgaggcatgggaatcacttgaacccaggaggtggaggtttcagtgagctgagatggcaccactgcactccagcctgggtgacagagtgagactgtgtctcaaataagtaaataaataaataaataaatgaaatatgacacgtgacaatgaaacagaattgtctttatgagatttatgtcttctcttagccagagattagccaagcatttgttccttaaaaatgaaaagtcatgatgcctgtgtagtgagccatctgctgctcagcagactgcataagagacttgccagccacttctgcttttatatttatgaactgacgttcacttcttagatggtaggaattaatccagtgggactctactttgaaagtaagtttcttatgggaatttacctgcaggcttggcaggcgaaccctttgggcagaatagtgactcccaagcaccatggcatgtttgttttcgagagtttttgtgtccctcctctggttcttcttcctgggagcaccacctccatgctcatatgcattgacatagaagtcctttcaccactgaatgtaaagagccagcctaaaaatgagaaattaatttaccttcgccccagggtagcttagagacagcttttaaattttgatgttaaaaagcacttggaaagacagttcattttggagcctgcggaaggaattactttagttaagggcttaacgtaaacctaagtagcagaccattaggcagaggtctacatttggcattgaaacttaaatttcaatactataatgaaaatttccaccataaaagagactcgggtgtctgattttcatcgttatgcaattttcagctcataatctcagaatccgtaaatgcctttaggatctaatttgcaaagagaattacgtattgcaaggagccatgtaaagtatataactagttctgtggaaagcaaagctgtgagtgacatctaattaggctacaatatcaatgtgctttggctctggcactcatctgtcattactttgaacaagccatttgacctttatattatatgtagggaccatacctcttcatttgcctgttagttctgttgccctggtataaatttaattgcgcctttctgcttcaatgtgctggtttgggtgataagttatatgatcactcactatatacaatctagaataaatgataacacttcatcatattagtttcccaagtgtctttttcactaagttgatcatctgtggaccaaggaccatctagttggcctctcagaatagtgtttggcttttgtttgctacatagtgcttgtcaaatgaaggaatcagcttctcaggctgcatcacgagcctgtaggatttggatccgtgaaatgtatgtgagatcaccaagcataatgctccccagtgaaaacaggactcatcgaatgccaagacgctcagtcatggttgattaccagaccacagaaaacctggcagagctggcacgtcagtagcagacacgtacatgtatttgatatgcacgctcacccatagctgccttggagacaaggtgctgtcggcagaccagaagttgggaaaaatttctgataggcttaggatctggctggcactgctgtcaggaataacaataatactacaaaatatatttatagtgcttttcagttttcagagccacttgaaacagtttgcagagtgtttcatttgattttggcactaacccaaatcatagcacttggcatactgtactatagttgcccattttcttctctgattcctgctctaagctgtaacgtaggtcaggcccacacctgtttcttgttcactattgtttccccagcacttgagggtgctctttccaggtgtgtgataaatacggatggaaagcatgatgagtgcagggcaactactatctcctacattttctaaatgagggacactgaggctcagagggcataagtggcctgttcaagtctgtgtggcagtcctttttttttttttttttttttttttttttgagacagcatctcactctgtcacctgggctggagtgcagtggtgtaatctctgttcactacaacctccgcttcccaggctcaaatgattctcctgcctcagcctcccaagtagctgggattataggtgcatgccaccatgcccggctaatttttgtattttcagtagagatgggatttcactatgttggccaggctggtctcaaactcctgacctcaagtgatctgcccacctcagcctcccaaagtgctgagattacaggcgtgagccaccgtgcccagcctgtgtggcagtcttaacctgtaagctcctgttcaagcctggacctttggattcaaagttcagtgctctttctgttgaatcagtacccagaagaaggagcattgtgttcattgtatgagggtgacaactttgcaagaaacatagaaagatgggagactgcagttccttccacatgggatttgcttcccctacctacacttgctaacatctgctgtttcttttaggatccactgagtcctcctccagggagccttccctgctgccctgccccttgactggcttaggtgccactattcagcgctactacaatagctggtgctcatttctgtcgttgtacttaacaacagctgctgctgcccatgggggctcccttggtgccagacactgagctgagagcttcacatttcctcacgattgccccaggagggaggctgttcatacttcgtttttcaagtgggaaactgaggttcaggaaagtcatctaacttgtacaaggtcacccagcttgtaagtggttgacctagaaatcatctgactctaggctgctgagcccaccacaccccacttaactatatgatttttttttttttccaaggagtctcactctatcacccagggtggagtgcagtgatgcaatctgggctcactgcaacttccgcctcccgggttcaagcgattctcctgcttcagcctcccaagtagctgggattacaggcacctgccaccacacctggctaatttttatatttttagtagagacccggtttcaccatgttggccaggctgctcttgaactcctgaccttagcgatccacctgcctcagcctcccaaagtgttgggattacaggcgtgagccaccgcgcccagccatttatcatgtatcatgataaatacatgattatcagacattaatataccagctttcccccactggactgcacactcctcaagggctggcatgagggcttattcctcttcagcatctagtacctttcctggcaccaaggcagcacttactaaatacttgttgggtgtacgagcaagagaggcagcgaagagagctgtgggagcccaagtgaaaacagggactgcatcaacttcttggaccagcctgggatctcctgggttgcgttgctttttgtgactgactttctgctctgctggctgtgatcactgctcctgcacattgcccttgctgctcagaacagacactgtgagctatgcctggaggcttttggccctggggcatcttccccacacctggggcttggctccctgggagagaaggagagttcttagctgcaagccactgggtggccactccagaagacatctggaaggaggactctccagagggtttcttgggccttttcttgtctgaagtaatttgctcccttttatttcccatttaaaaaatctggagttatttccaatgtttggtaattccacacttcatttgttattgtggggaaagtcctgtgctgaatttttttcatccctactcttaaaactaaatataggaatgcctcatgtcagcctgcattttgtccccactcaacccactgacactgcctctcaccaaggttaccatgacctccctgtcaaacctcatgacccctttcacgccttgttttacttgatttctggcaacaatggtcattgtcaagagccctgttggtttaaaaccctcaatttgcttttgtctttggtggcaccacactcttgaagttttctggacatctctctgtctcaaaggagcctcctttgaaggctcctttccccttaagagttcttatttcagagagtcaggttttaaattctctctcttttttttgttttgttttgagatggagttgcactctgttgcccaggctggagtgcagtggtgcgatcttggctcactgcaacctccgcctcctgggttcaagcgattcccctgcctcagcctcccaaggggctgggactacaggtgcacaccaccacacccagctaatttttgtatttttagtagagacggggtttcaccatgttggccaggatggtctcgatctcttgacctcgtgatctgcccacctcagcctcccaaagtgctgggattacaggcataagccaccttaaattctcttcttaactccagttgatcttgtccctttctgtagttccatttatcagcaacatatctgtgttggtgcattttgtcactgctataaagaaatacctgagactgggtgctttataaaggaaagaggtttaattgacttacagttccgcatggctggggaggcctcaggaaacttacaatcatggcagaacgagaagagacatgtcttatatggcggcaggctagagaagtgttaggagcgaagagggaagagtcccttataaaaccatcagatctcatgagaactcactatcacggagcattcacccccatgatccagtctcctcccaccagtctctccctagacatgtgggaattacaattcaagatgagatttagatgaggacgcagccaaaccatatcaatgccaaaaaccatatcccagatctcctacctgttctttaggcccatctacccaaatgtctgccaagccagttgactgttacacatgaatggttccccttcctcccctgcacccacacctgtgtgtctccctgtttccatgaattccatctggtgcatggaaacctggccagcttcctttactcatcactgacttctcaacaatgatcaagacctgttgattctgttctcacagcagcctaccagtcaccatccccactgccaccacctcagcccaagccttggccatctggccttcctgaccctttttactggctcattctctactctgaaacctgtgggattgttctaccatgcaagcttgaacacagcactctcctgcataagagtctttgatggccccatggatactatatactccttaatccttttattaactgggaggcctgggtgacctactctggcttgccattgcagcgtctgtttacactctttactttgaccttactgtacttgttgcacttctgcaaccttgccctgtttcctctcatctctggggaacactgtgttcttaaacatcacttccttcagaaagcctttcctgcttccccctccttacaccttcctcctccatgctccctaaacttgatgggagaactctcgcgtgttagggaagcatcatccccagtggggcacttatcagtgtgttgtcatcacctggttatttgtctcattctctgtgggccatacctgtcttcccagttgtatctcctcagtgccaagcacagtggctggaacagagtgacaaacatttatttatacgtgacatgaatgagtaaacaaatgaattacaccggaatagatttctggacaattcattttgcaaaaagaggaactttagctccgcactttggagatgccagtgtctttgagatgttaaggattttttgttttgtttttgttttttaattctttaactatgttacaggtttagcaatgcctccgattcaggaatttgtttaaaaccccccagtggcttagagctgcacatagaataaaatctaaactgtttctcatggtctacatggtcagccattgtttacctgacttaactaacctctccgacttcccctgacacggctgcctccctggcttgtacgctcctgtgcttattcttgtccccgtacaaagcacatccattctcgctgtgaggccttagcagcacctgctcctgctgcctcagaaggttcttccctgatccttacatgctatagcctgccctgacccttctgtccccacacccatcactgtctaccacatcactctgtgttatttccctaatagtagtaagagttgacaactcttactactcttactactgttaactcatctcagctactattctggaggaacacaaagcactcggctttggtgctaacccactgggagttggccttatcttgaacagttgcaaaactcatccacagttcatcatctgctgaagagtggcttgcagatgatgaactgggaaactccataggtttccctctgaaatgttcttgcccggtatttcactcgtttgtctctcctcatgacactaagctccatgagagtaaggcctgtcctgtcttgtgtatcacaggattctcagcacttaggacaagacctggctctgatgcttcctaaatatttgttaagtgaatccgttttagtttaaaaaaacaataaaacttggtttgttgataagctatgaactcctttacccaaaccctgtcattaacatggaagatgcacaagatcatttattgtctactctagctaattggcctaggagataattcacataacaattgatttttatatactcatagccctgaaatttcctggctataaagacaaatcccttgctctatgtgtgtggtggcctggccatgccagttctcttaagtaaacagtcactctgtcgttatccacccaattctcaaaatcaagccccatgtaaatagtcatctccataaatcctgtcaagaaaattaatttttagggtacagtcattggttttattgtagtcctcctaatcctgtgtgacatagatcctttggaaagttggtgctaccagttgggaagtgccccagcaggccccgtggttgtctggctttgttgactgtctgaatgcaacacgttgacaatgggttagctgctttggttttagggttattctccttatgcctcatgcaaatgaaaagtggcaaaaaaaaaaaaaaaaaagaaaaaaaaacctcatttcctttcctagataaggcctgtaggggaatttcggctgttcttggtggcagtataatctcacaaaagatgtataaacacagtgctttgccaaatatttacagagctgaggggcaagaggtgggttggcatagggccagattaaaatgtcctggaaggttttctgtgattcctcagaatgccaaattcatatacatggtctcctcacctgtgaaatggggctaatggtaggacctgcctgctgatcttatcgtggggattgaggagataatgagagccgtgtgctccgtgacctgcctggtaataagccttcagtaaatgttaactcttagtactattagctcatctcagctactattctggaagaacacaaagctcacagctttggtgctaacccaccgggagttggccttatcctgaacagttgcaaaactcacccacagtccatcctgtgccggggagcagcttgcaggcaactcatttcttgagctcttccctgcccacacgtactgtgagttgccaagaaagcagcagctgcattcaccagtggaaattcccccggggcctcctcggacgccacccctacctctggttatgggcgaaggcgtaccaggggaatggcttcctccaccaactccttagtgtctgatgtaggtctctgactaccagtgtgagtcctgtggctcctcagcagtgtctctgcgcctgtctctgtcgtgctcctaagcaggcagagatgctggtggagaatatagtagaagggacttggggaaggactccattttcttaagtttcagtagaagtttggataacctgtagtttttaaagattgatgctcctgccttctttcctctcctcatggtaaccaaatggtttgaagttccctttgcccctgttcagaaactctgacccttgaataaaggggtaaagtatttagattctgaaagtttcatgggggaaaggggttaagggaaagcagtgtatgtgtgcaaatgctgacagtctgaatattacattatctatttcaacaaataaaccttggaccagatcaggctatccaatacagagacaacattgatctttcaggagggatctgccaagtctgaaatgccagctgtcccttcctgcccattagggggtagagaatgcctcttttggactagctgaaatactcattacaaatattcaggcctccccctaacctgaattaatgtattattgcttatccttttgtctctcccgtaaaaacatgtataaggagcattccctggtgattccctgagggttatggagggacattttacctgccagagtgtctccagcatcacagctggaggtgccgtgggtgggggtctgtgtgcctgtgtgtgtgcagcatgtgtgtatctactatataaaagctcattcattcccttgctataattcagtgttcagactcagcttgctgactgatggactgggggaagccagtaattcttaattcaggagaagaggctaagggagaacaaatctaccctcctgtctctcatcggcccccttgttctgaaacactgcagtggttcagagaagtcccctcttagagctttcatttcttttggagggatggtttgaacctagactggatctgccccatttttgccttagcaagtcttgatgagttcattggacagaggcaacaaaatccatatactcaagagactgaaaaaggggagaggagggaaggaacgtgtgtgaggccaaattgccccactgggggtgggattataaaggagtgcgacctttctggcaatacgtgttgtaagccttatgatgggcttatattttgactcagccactgcacccctagtatttatcagaaggaattaatgagaggtctatgcaacagtgagtggatttttacccctgtattatttactatagtaagagaaataatttaaatgtccaacaatactgatggttgggtagttttcacacagccatgaactacaatgcaactactgaaaattatattgctgataactgtttattaatatggggatattacataacaaaactactttgttgaagaaaacagagtgaaaaagtatgtaaattatggtgtcattttaatgcacaagatgaaatatgtatggatacatatatacacaaagaaaggttctaaaatagtcactaatgtgttaactgtggtatctggagtaggagtactgataagattggtttggttttgtcttttgcctgttgttttttaacaataagtatgaagtctttttatagctagaaacaacaaagtttctttctgtattaagaaaaaatttctgcattaaaaatatatgttatggggcatccctcctttttttcttttaccaaaaacgaagtagaaagaaagtaagctggctctgaatatttgaattaagcagagccctggagtcctccttgtttatttttgcttttccaaaagcaaatttttccaaaagcaaaaaatggctgcacacaccctaaggctatttatttccttccttaactccactactttatccggttcagcaagtatcaatccttgccattctgtcaagagagcactttctgtttaccagacacggtgcccacctcttgatgtatgttaactcctgcagtccacacaaacaccctttagggtaacttttaccctcgttttcaaaagaggggagtgaggcagagttgtcacaaggctggcgagcagaggagtgaagcttcccagccacactctgcctgcactacccctcccttgctttcccacttgaccttgcatccccggtgggaagtttctcactgaatgtcctctaggcctgtcttcctaaaggagccatcctatttaaagagccaggatttagcttctctgcagagatgagggcagggagagaagtaagaagttaagaggccatggctcagaaggaaaaggagggaggaaagctattgcaatggcccacctgccaccctcaagaaagccattctcagaagcctaacattcaaggatccagtccagcctaccttgtccagcttaggaatgggaactgtttgtcactcaccttgtggaatattataatatcaccttgtagagtattataataagaatgagcagtgccatctctggcagcatttgtatgaaacgttatgtcatgctgcttttaagaacatggagtccaaggataaagccaaccccaaggaggaagtaatgccctgtgactctgtccctttcccccaaccctgtccccactccatctccacatggggctcctaagaagccatccacagcagtgcctagggactcagactcctcactatgccaccatcagtatgagtgtggactgggaggtactgattcttccccatcttcccaggcctatttgctacaacatcaagcctctctttgataacaccagcttttctttgagcaaaccaatggagaaacagacatctcctgttttcctgccctgaaagaagagtctggggcttactgaagtttcataaatgagccagagctcaggattgacacctccatgtgaacatgaaattttgagctttgggcacaggtaatttgatacctgtggacctatttgccactggtaatacaacctgagcacctatgaacttgtctgtgaacattttccattggggagctttgctgtgcagacacagtgacagggctgtgctaagacaggaagtaatcctagaatgaaagctctagaacctgagatgtagtactttttctctctttccatttggttgcatgatgatgcaattctgtcttcattttcacttctgtgtggatcagtgccttaggatttagagatggtacaaataccaagtccttaaatctactcttcattttaaaataaaagcagcattttttcaggacaagccaagcatattctaattataacagctaccatttagtaaacactatatgccaggctttaatatactaagtatattgtatatattatctcctttaattatcaccaatcctatgaggtgtaagtattattaatgatccccattttgcaggcaaagaaaatgagggacacagaggttaagttgcccagggtgacacagctaataagtggcagagccagtaattgaaggctatctgaccctaaactcctgcacttaactgttaattcagtattcttaagaatattgttttcttttagaaatctgcttatcaagtatgacaagttttctctgaaaacagataacccatgaaactattgagaagcttccaagccattttttcctcttttctatttaatgtgtatttatgagatcatggaatggcatttcacctgtttcaacagcttctagggcaattcaagcaaattttctggaagtctgcttggtttgtgtcaggcatttcctggtcccttgtgtctgccgggcttgtggaggaggcgtgtggaagcttttttctgagccatccgccctgtggaagccacacaggcaaggccagaggagaacagtggcacaggcattcagaaaagcccagtttcccgacgtcagtttgcctgaggtcaggcggagcaccagcactttctggctcttagaaaatgactcaacccctccaacctgcagcttacccctatgcaaaatcagggctgcccttgcaggactgttgggacgagtcagtgacaggggagtgtccagccctacctggcatgtcataagtgcactctatccattgggagctgttattttagaagcaggacttcgtgttgttgctatgtcttgcctcagcagagagaaacattttgctcttgacactgattgtcccttctcagctgtaaggaggccacagcccccttgattttgaacccaaaaatggaaaatgagagcattccatctcacaggacactttcgcaaactacaccagcccagtctgatccctcccttctcagaatccctacagttcttttgaccaaatctcagattagcactaaaagtttattaattcagtggataagaagcttacacatatttccagagccaaaaagaataataaaatccatgcaaacaaataaaaggttttagaggaacaaagtaatcacaacagtgttttgctactaagtacaatacgtgggggcattcacacttcccagtcatttccagagctgacctagaacacaataggaaccaagatcagtggttcccatctctggttgctcatcagaaccacaaggccagagcaggaatagtattttgaagatatagcttcttaggccccaaccctgccatagtcattcaatttcttgctaatgttaggacttgccattttgtaaagtacatttgattttctttcatttttgtaattttgtcatttgtaatagtccttcccggaggggagtctcccttccttcctatagttttctgggagaatgacagaaaatttgagtatatatagtagagtaccattttgtcatgataaggctgggtgacaatgttggaagaaggaagagctgacagagacatgctgtggggttttggggatgacattgtggaaagtttaccctcactaacatttcaggtaggtatatttgaaagtgtagactgatgatttctgaagggaactgaatgagcttgtaccactgtgaccatgaataccgttgcaagtgaattaacataaatatactgacaaaaagtgagtagaactttagaactgttacatctcaggtagtgaaagtgagggtaacctagaaaaaggaggtgtaataactgtagtatcaaacagtgtgttgcatcctgcaaatagctagagatgtggcaggttacacagaagaagagaagtccctgggctgtttgtttggggcttgtgtagttccccgtttccaaaatggaacaagcgacatactcttttaagggtgcacagagacttcattgaaaaggcaagcatttgtttccctaaacagaatgactttttagctttaccaagaaacaatttcttgcaggaaaagtatgttttgctgttatcagctactactgggaattctgctacagacaggccaatgtttaccactgatcttctttccacagttctttcaaaataggaccctttccattaagttcacatagtattctgggaaaagtctctgtgattaagcaaagagactgtgaaggagcttaggcagaaatgggggttagctttgttttaatcctaaatgtttaaccataaaaaagatgcacttgggcttaagacagtgagccctcagcagtctactttgttgagatctcggctcagatgtcacccaaaagaagttgccctagccacagaatccaaattacacccacacaccctccccacccaggcacctgctttcacactgccttgattttagttgatttcatagctcttaataccacctaaaattatcttctttggttgtttacgagtttattttctgctttacacactcataagtagtatttcctaaattttttccattaggataataattaaaatattatcaaaaagcatgtacttccaataagtgtttgtttttatttacttaattataaagtgtatacctgccttagtaattgctatattacacacattagaaaacataaaaaatataaatgttataagaatcagatatttaaaatgccaataggagctttgatatttttctcctccaccagcctgtgttctcgcccaccctaccttgaagcctactgaacttgaatgtaagctgcctgagagcagagggcttgcttggcttgttacctgctgtgtttccagtgcctacaactgtgcctagcatgtactaggtgctaagtaaatatttgattattaaatatttattgttgagtagtaaacaaggctaaggcacaattcactcttccaggctcctaatagctaaggttttactacatctttggaggacagaaggaggggggggaaaaaaaaaaaaagacctggtttctggggttcagaatgccttcctaatacaatatgtgctgaataaggatttactgtaatgattcaaatccttcaccaaagaggtaattacagcttccttggtaagagcagagctcaggcagacagacaggtggtttctagtttctcttataacagatggcacaaatggaccagcttctgaagctttttgaggaaatttgctcataaacagttttaaatatttttcttttatatcttccaacacatgcttcttaaagtaaaaatgcttcagtagattgcaggcaagggcacatattatgaatagtgctgcacggggcagggtgcttgcagtttgcctgagtagcagatgcagcatgtcaggaacataagagggaggctctgtgcgccatggtggctagatatacattgaattttcgaagtgcttaaggaaaaaacaaagctgtccaccaagaattttatgatcagcaaaactattcttctcaaatgaaagtgaaataaagatattcccagacaatttctagaagaaagcataggagaaaatgtgtaggttaggcaaatacttagatttaacatcaaaagcacaatttaaaaagaaaaaaattaacaaattgaacttgaccaaaattaaaaatgtttgcccttcaaaagacaccactgaaaaaatgagaggacaagccacacactgggaaaatatatttgcaaatattatcactaataaagaacttgtatccagaatctatgcagaaatcttactactcaataagaacatggtgtccatagaatggaatagaattcagtaataaacatgaattgactacttatacacgccagaacatgggtgaacttcagaaaacatgctaaatgaaatgtcagacacaaaagaccacacaatatgcaattccacttttgtgaaatatctagaaaaggcagatctctagagttagaatgcagatcagtggttgcctgtggctgagcatgggagcagggcttaactgcaaatggcaggaaggacctttttggggtgatggtggcattataaaactgaatatggatgatgcttgcacagctccatcagtattctaaaagttgtacacttaagtaaggcagataaatttcatggtatataaattatacctcaataaagctgttttaaactctcccaggagtacaaagcattccttaaatgttgataactgttgttgtttttattattctgtaggtagtgtagacaaatgataccaaaattaagagagaaacattaaatgactgtgtacaccttgcttgagtggacaaatatgcttttcattcattaaattggctcttccaaataattaagtagatcttgggaaaatatatgccacacttttacaagagggtataaaaggattagtggccgagaacagaaatttccaaaatgtgagctgtgtgacactgagatagctgaaatagctttaagtggtgcttgggtgaactttattctatatactaataataatgagatattatttgcaatgggctaaagtagacatttgttaaagagatcaatctaaagaaaatattaagaaaatatgtattaaaattacatgtgatacacagatgtgacaaacgtcatgaaggtgggacactcatgactgagtttgggcgccaccacccagtagccaggagcaagaacaatgccagtgggtggctgagaatgaatactgaaacacaggcattcatccaagtttatgcccaatgtgcctgtctccctcccaaccagaaatgaaatgtctgaatgtccccttccatcgtatttgtcaggcctgtcttaggcaagccgacaagtggccatatgtggagctgtcgtgacaacaccagaatgagagctgtaccgttttatgacatcagataattctgactcagaaatgtctgccttccctgtctgccagcagtcttacccttggtttctggtagatccatttccattcttttaactatttacttgatcctgtggagtctttcttaaaaatacagtctttagatattgtcagttctaagcattcacagtgtgcaagagataaaagagggataagacaactgcaattcaatgtagcatcaagacgggaagaaaaacacagcccttaaagattccaaggagaaagatctaactcactggagaaagatcaaactcatcgtgatatcaaagaagcctgaggaaggaggtcgcatttgaaatgggctttgagtggcggatgagcagtggttacaggaaagggaaaggcatttcagatgggaacagcagcaccagcaggaacatggaggtgcaaaaggttaaagcatactcatggcacaagtaaagccatttgtttagaacaggggtaggcaaaccaaggcccacaggccacatccagccaggtgcctgcttgttctatggcttgtgagaaaagagtgtttttccattgttacattttaaatggttatataagtagctaaataatattctcagttttgcctcttggcctgcaatgtctaaactatttactttatggccccttaagaaaaagtttgctgacttggagacccctggggactttgaaggcaagtaatgagtactgagaggggagttggggctctattgtgaaacgccttggaatgaggaaacccagctagcttaagggaaaaaaatggaagtcataagctgacattttgggaagtctcatggtggatctaaccctcagcacatttggatttaagagcccaaattatcattttgcttggctcttcttccctctttttttttcatgttaacttcatttgcagacagatgttggccatgtaacatgaaaaaagatctctggtcaccctaagccaatacattttattgttggatccagaaagaagagcattcatatgcagtaggcgctcctcatctacggttttgctttccttggcttcagttacttatggtcaatgactgtctgaaaatattaaatgaaaaattataaaaacaaataatttgtaagttttaaacttcatagcattccaagtagcatgatgaagtcttgctccccacatgatgaagtcctgctccccgggacaggaatcatccctttgccacactgtggacactggccaccctttagttgtttagtagctacctcagttatcagattgactccaggtattacagtgcttattttcttttctttttttttttttttttttttttttgaggcagagtctcgctctgtcacccaggctggagtgcagtggcacgatctcggctcactgcaacctccgcctcccaggttcaagcgattctcctgccttagcctcttgaatagctgcgatcacaggtatacagccaccaaacctggctaatttttgtatttttagtaaaggtggggtttcaccatgttggccaggctggtctcgaactcctgagctcgggtgatctacccaccttggcctaccacaagtgctgggattacaggcgtgagccaccatgccccggcctacagtgcttatgttcaagtaacccttactttacttaacagtggccccaaagtccaagagtggtaatgctggcaatttgcatatgctaaagagaagccgtaaagtgcttcctgtaagtgaaaaggtgaaagttactgacttaaggaagggaaaatatatgctgaggctgctacggtttatggtacagtaagatattttgagacattacattcacataattttcattatattgttataattgttttatcattgtagttgttcatctcttattatgcttaaatgtataaattaaactttaccatagatatatacatataaaaaacatagtatatacatagtttggtactatccacggtttcaggcatccactgggcatcttggaacataaccaccgaggataagggggcactactttgttagactccacagatgaacaagggtcagttgtccacactgaccactgtggccagcctggatcacatgcctgccctgcagtgaaatcagcaggacactggactcacctgggtcacttaggatggaaaagaacttctccaagtgaaccagaagaaggggaatgcaaaaattctagaataaactgtaactacatattccagtctgccagagtaaggaatttattctacattcgttaagtaatgagaaatttatgagcaggaaaatgctcttcattcaacaacattcaacaaatatttattaagctatgtctttagcaggtgtttgtacttacagtgcacagtaggatggactggaatggtaaaaggtaaagaaaacaggctggagattcttataatagtctaggtgagaaggccttatcctatgagcaatggggaagcattgaagtgttttaagcagagaaatgatgtaatcatcagatttgaatttcgaaatgttcaccaagaatagttctcttaagttaagcatttatgtataaaacctttttgcactataagtttgcttagtaacttgtagattatccagagtaaatttggatccacctcagatttggaaaaaaaaaaaaattttgtgagatcagaattgtgttttgccatgtccatttttcattgacttctctgtggatatttggttttgaaggacaagaactagaagagaatataaaaatgattttccttcaatttgtttttattcacagatggtgaaactctttttctccagcggaaagggtgattttgctggaaaatcatttaaagttttttccagtcaagtcaataagctcctcagaaccaaatgaacaaggggtaaaaatcaccatgaggcttagtaagattacattcctccatggcagcctgcgccagccattgtggagggccagcgggaacacagggagagtgtcaggtttgtgaatggtcacgctgaaggagcagggccaggtgtggaagatataaatggagtagagaagaagcttgaacagattaaaatcagatcagagacaattttccacatgtttagactactaaataagcaccagaattagagggaaggctgctactcgcttggagggaaagaaagagacttggagacttttagccttttcatcaaagttcatctctctttctctctctgtctcatctgcctttcatggtatccggaccaaggttcgtgcatttgcaagagtttaacttaatcatcctggacattgtccttgcagaagtgctgcttctattgctgaaaagtcctgaacatagtgaaatattatagtaggctccttactcaaggaatctcctctccagggttacctgtaagctgaaatgccttgggccactgctgctaattttagttactcctttgttttcagcagtggacatttagattcttattaaatctttttcctccccctagtccaaacaggaaatattccctgaaagtagaccatacaggaaagtatgccagagagccaatgcccctcagcctgtgttgttaacatgttgtgcagcttactcagaatgctacatcagagacatcctccttgacgtccccctaccccaggtaaaaggaagagaccattgatttactgtaataagtttcccaaaataaaaaagtctctaaaagagtcaacataatttctcagtgcagtaggcagagaaacagtacaagttgggagctgccaactgtattatgcaacctaaaccgtggattggtgcaacaaaggctgaactatcattttgcctctattaaacatccttcttctatggagtaaaagttgtagtttgggtggctggggagacttttttttttttgtaatatttattaagttgtggttataaaagtaacatgttaattgcaaaaatatgttttaaaagcacaaaaactttgcgtatgggaacaagggatataggggaattctgtactttctgctcaattttgctgtgaacctcaagcgactctaaaaaaataaagctatttaaaagttacctttaatctcatcacccagggaatgctactaatatgttaaggtacttactgttcatatgttttaagataggcttgaacgtgtattaaaaagtacatgaaatataaatgtacgtcttaacaaattattatttagcaaacaccccctaaataatactaaattattatttagtaaccaccccctcaccccccactggttaagaactgcagccttgctggtgtccacatctcttgctttctcctcccccatcacagtcctcttcttccccacaagggctctaatctcatgtttatggcaatcaattagtttttatttatattttaacctcataaatacagtccattcttgtttttcgcggtagtcatgttctataaagtcactgcaaacacggaattactgaatactaagccattgcatggaggggaaatacagagtgagcttcctgtaagcccctggtcacaacattttcatcacctgatcagtacaccaccctgttttatatgtatttctgcctaaagtcacctcatttaatattattgttgatttattaacattgaacttaggaccagcagcactgttaactcatgcctggagctcatctaacacacacattttctctataaggcacattacaaccttcttgtgcttaggaacatttgacagtgcttcagctgtatgcttaggggccattttaaatggcaaaatcaccattgaagagcatgaaaatgtggtactaggtagacctcaaacagacacttgtttacagtatgagagctgaaacaagaaggcagagctttgccttgtttgacctcagctgggaatgtgccgttgggcgactcaaggtttttgctgctctgcacatgtcctcggatgacctcaacagcaccccagatgttgattttgaggttacagatacattttagtaagtaggtgaatttgcaaataaggaatatggaaataatgaggatagactgtatatatccctaaatgcaacattttattgttttgagttcaacttcatttgctcaaccacatttaagtcatttatgttgctgtagttcattttcattgctgtagagtgcaccattgtattaatacacaaaaattatttttttattccactttttctaaaattttgaatttccattttctgcttttacaaataatttgctctacacattctaatacatgtcttccagtgtacacataacacacctttctctggggtgtatgtctagcaatggaactactgggtccaagggaatggtatcttcacctttgctagataatgctacactatttttgaaaatgattgtagcaatttacacccctcctgcagcaaaatatgagttacagatgagaatgagatgtacctcattctcataaacctctggtatttccagcattttgatgttagctatttagtcattctggtgggtgtgcagtaacatctcactgtggttttaatctgcatttcctgcagcacagaaaggttgagtgccttttcttttggattttctcttttaacatccctattcaggtttcttgcccatttcccacttggttgtgttttactcaccagtaagaaatctttacatagtctggttataaaccctttgttcatttttatgttgtaggctgcctttttacccttttaatattgtttttgatatgccctctctatgccctactggataaattccaacccctgtttgggaaccttcagtttctggaattatttcttctaaaatctttattgtttgcctttggcatttaggtctataatccatctggaacacatttgttatgtatggtgtgaggtaggggattctgtcatttttttccatatagatatccagttagtctagcaccgtgtataaaagagcactttccactagtagcataaaatcgtataggcccatgataaattcctaacagtataaataaaaaagtgaatgtctagtccatatctgtacatccagttccccactctcaaccccctgaggcagtcatagtttcttgcttacagattttaagaatcatgtttaaacatctctagcatttaaacagtggctttagattataccccagaacaacgaaagattggatgtagtagcactattgcgtcccttttatttgtatgttacttgagtgaatttgttttggcaagcacaatatcttcattatgtggagaaaggcaattgtaccatactcaatttaagagttatatgcctagtaaggaagtattgggatttcttagcaactattcagatcttttgagatagcaattgttaccatatgaacactttataatgcccccaaaatgctttagtgttttcttacaaataaattcacatattgtgaaattttttagttgagagaaatttttattctaggcagttctgttgtgcctgaaatgcggtattggaaaagattgagaggctacacttaggttcaacaggaaagaatattaaggtcaataagtattgtgagccacggtgcacaatagaagcattctgcccatttaacctttctgaccctttcccttgaggtttttctgtacaatgagcaattgaactaggactgttgtccagatgtctttgtttccaatctggaatttttccctctacctcatatttctgtattattcagtgagaaaagattcggattattgacttggggaacattaaggatgatgtatgcgctattccaaaatcttgaattttgtttaaatcatagaattacttaccattcctactcaccccatctaagtttaaagtttatttaaaacttcagaaattattttatttgtgtaaataatttcaacttttagattcagggagtacatgtacaggtttgttccatgggtatattgtgtgatgctgaggtttggggtacaaatgatcccatctcccaggtggtggccacagtacccaatagtttaagaattattttttaaagctagaaaacagaaccgctgcattgtaaactagtcaagctatttttaaagtaaattattgaagaagtattttaaaatgcatttccctattattgttaagaccttaaggggatttcactagtttcattaaaataagaaaccgaactctgtcattgtttaaataaaaatgcatgttaaattatattagatgaggggaaataatctgtgcaaagacatctgcacatgagtagtagaaaagaacacgaaacagtcaagctcagggacttgtggattttttctgctcataaagttgtgaagtacatactgaaaatccaggaggttaggacttatataggatttctttgttgtaaaagcttgagtggacacacataaggaatatatgtcttcagattttcaacagataaaaactggttttgtgtcatttggtctggttcaccagtagccaatttaccactgttccttttggctctattttcttggctaaagtttgatttccctttaccttaagtcaagccagaaagggatattttccaaggaagaagaattcaatgaaatgggattagattagataggacattttagattttcatggaattttcttctctttttcatcataggggcaaaatcaaagccgccccctgttagtttaatagcaccatcaccacctaacagtctaacctggaaggggaactgacagcataaagaccagccctgggccggtgatccgaggctcagcccaggcctgagacatatcactggggacctggactgcagatcatgggccactgcctggcagagacgtgcaaatgccaattttgctgcttctccaaagtctgacactgtggagactcttagtgcaagactctcaggcccttccttgtgtgccttatccctctgacttcatccttgttttgaaagtcctacactaagctacaaatccactactttcttttcctctgggagcagccatacctttcaactagggggtctcacatctccaggttgtggatatctgtctctttatccatcagcctgtctccttccccacacaaccctcttgtcaaaatgccctttggaaaattaaacattgcttccacgtggaaacagaacacaggaagggaattgtattcattcgtacatcactgaaaagaccaggaaagcaaagagtccagggtaacctctgaacactgaaaaaatgttcatctaatttttttctaatgatcatgctcaatgttggtggggtaatggtgagaaggaattgtcagtgttggtggaaatgcacagcagtagaacctttctggaaagctatttggcacggtatatcaacacctttaaaagaaactcctagcctttgacccactaattttactttcaggaatttatgctaaggaaacaattgagacactggcagggattctctacaaagatgtgagttgcaatgctatttataatagctaaagggggataggagtctgaatatacacaataagaaaatggttacagaaatcagagtataccatacaatagaacagcctgtagccattttaaaaatatgttatcaaaggctatataattgcattggaaaatgccttattaagggaaaaaaaggagggtattaactacatgtgtagtataattctccaaaaaaaagcgaggagaaatatgccaaagtgttaacagtgattatcagtggcataaattatgtatggttgtatttcttttcttcttggtttttggtattttccaattttctacaaggccgtcagtaattttcattattagaattttgaaagattaactttcttcttcgtggtcagcttactcctccagttacagaacctctcatcttatagcagctctactactgtggtgtggagatcagagagggtctgccacatcccttgtcagactgggagcctgcctgggcagccctgccacagtatggcaggcatgccctggctggtccagcagatgttccatcattcaagtgagtcaccacagaagggtgtcaagctgatgatattgctacacactgtacttgaactatcagccacaacccattatgctgccaagccttttagccttatcttcctaaaccgttattctttcactgtccagtgaatttcagagactgactgggactgtctgactccttttgaggacactgtgggccagcaaactaaagtggatgtaagcctaccagttgaatccaaaccagaccagcaaatgttccttgcatgctacagtgtatgctgtgttgttgctgtcattgggcctagatgtgggggcctggcaggaccccaggaatatttaggggcactgggcattcagcttaatacacccatctggactctgagggttgtaggaatgcctttagcagtcatctgctaaaattgtagttataaaatcattttctcctcttttaattgtttgttatccttggcttcattagtgggaaaggggttgcaaatttgatattggaggtttcagagccaggagtgaaattgaccattttgaaatttgtctgttttgttttgggtttggtgaggggcaggagggagcaagatttttattttgtttatttatgtatttatttttgtctgccgttgtcatttttaagtaacctacagccagacacttctgtagtgaaaggagaatttaagattctacaaagagtcttgggccataataaccatccctgtgcgtcttatatctcacatatgtgttctatgagtatgagaacacatagtcatacacccttagttttgcatcagaactaaaatacaatgtactctctatttcttgtctgtttacagtccttctgttgcgacatgcatctttgcagtacataaaatgtgcagtagtattgttgataggattattgccatgactctaaagtacaaataaacaaaaggcataattcctttagtcatttaaaaaatcacagaagtgaagagtgctgtagatgtctgttaggtccgcttggtccagtgctgagttcaagtcctgaatatccttgttaattttctatcttgatctgtctaatatctcagtggggtggtaaagtctcccactattattgtgtggtagtataagtctctttgtaagtctctaagaacttgctttatgaatctgggtgctcctgtattaggtacatatatatttaggatagttagctcttcctgttgcattaagttagctcttctttttgcattgatccctttaccattatttaatgcacttctttgtcttttttcatctttgttggttttaagtgttttatcagagactaggattgcaacccctgcttttttttttttccatttgcttggtaaattgaagtgaactgccattcacaattgctacaaagagaataaaatacctaggaatacaacttacaagggatatgaaggacctcttcaaggaaaactacagaccactgctcgaggaaataagacaaggacacaaacaaatggaaaaacattccatgttcatggataggaagaatcagtatcatgaaaatagccataaaatagccatactgcccaaagtaattgatagattcaatgctatccccatcaagctaccactgacttccttcacagaattagaaaaaactactttaaatttcatatggaaccaaaaaagagcccgtatagccaagacaatcctaagcaaaaaaacaaagctggagggaacatgctacctggattcaaactatattacaaggctccagaaaccaaaacagcatggtactggtaccaaaacagatatatagatcaatggaacagaacagaggcctcagaaatgacgccacacatctacaaccatctgatctctgacaaacctgataaaaacaagcaatggggaaaggatttcctatttaataaatgctgttgggaaaattggctagccatatgcagaaaactgaaactggaccccttccttacattttatacaaaaattagctcaagatggattaaagacttaaatgtaagacctaaagccgtaaaaactctagaagaaaacctaggcaataccattcaggacattggcatggtcaaagacttcatgactaaaacaccaaaagcaatggcaacaaaagccaagattgacaaatgtgatctaattaaactaaaaagcttctgcacagcagaagaaactatcatcagagtgaacaggcaacctacagaatgggagaaaatttttgcaatctatctgacaaagggctaatatccagaatctacaaggaacttaaacaaatttacaagaaaaaaaaacaaccccatcaaaaagtgggtgaaggatatgaacagatacttctcaaaagaagacatttatgtggcaaacaaacatataaaaaaaacactcatcatcactggtcattagagaaatgcaaatcaaaaccacagtgagataccatctcatgccagttagaatggcaatcattaaaaagtcaggaaacaacacatgctggagaggatgtggagaaacaggaatgcttttacactgttgctggggttgtaaattggttcaaccattgtggaagacagtgtggcgatttttcaaggatctagagccagacataccatttgacccagcaatcccactactgtgtatacacccaaaggattataaatcattctactataaagacacatgcacacgtatgtttattgcagcactgttcacaatagcaaagacttggaaccaacccaaatgcccatcagtgatagactggataaagaaaatgtggcacatatacaccatggaatactatgcagccataaaaaaggatgacttcatgtcctttgcagggacatggatgaagctggaaaccatcattctcagcaaactaacacaggaacagaaaaccaaacaccgcatgttctcactcataagtgggagttagtgagaacacatggacacagggaggggaacatcacacaccggggcctgtcagggggtagggggctaggggagggatagcattaggagaaatacctaatgtagatgatgggttgatgggtgcagcaaaccatcatggcacgtgtatatctatgtaacaaacctgcacattctgcacatgtatcccagaacttaaagtataattaaaaaaaaaaaaatcacagaagtactatggagtatgcattttattattataccaattcaaacatagtggtaataaatgttaaaatgcagtcactttataccaaatgttactgctatggctaaaacataaacaaatgaaattctgaaattctgttgttaaaaattgcatttgaggccaggcatggtggctcatgcctgtaattccagcactttgggaggccaaggtgggtggaacacctgaggtcaggagttcaagaccagcctgaccaacatggtgaaaccctgtctctactaaaaatacaaaaaattagccaggcatggtgggggggatctataatcccagctacttgggaggctgaggtaggagaatcgcttgaacccaagaggcagaggttgcagtgagccaagattgtgccattgcactccagcctgggcgacaagagcaaaactccgtctccagaagaaaaaattgcagttgatactacggtaattgacatggggattgaggagtaagttattataatagttacgaatatcctgcattccagccgcacccccagataatttcagccgtgtagttctggccaaaaaccacttagatatctgaggatgtgaaaaacatttagaacccacattgtgttcacagaatatgttccaaactatgccattagccaaaggcataattcttggtacagatggaataggaagctggaggtgtttcctacttattaaagtcatttaaaaaaaaaaaagttggaaggactttttaattgtcctgtggtaaccactgaccaaaagaacagattggtacaagcccctgggtctgggctgttctcttgaacctccaaattgtccctggttctgcttgggttcctgggctgggctgtggtttgaaagttgttgccaggccttgcctactaggtcattgtctggtggggcagggttgtgttgagaggactgagaaagtgaggcctctctgactagcagcaactgtggaagaaaatggagactgcacagtagagaggagttgacacttttcctaggactcaagacagagtcaagggggagccaggtattaagctagtactagcttagccctcaactgatggatcttactgtcttacattactgttgtttttaaatctgtcgcttcttgtcaaatatattttaagctcttgaagtcaagggaccttggcaaatatcatttattgtattgaacatactgagtgctcaatgactagtttttgctggattaagaaaaaaaagctttaaagagtcatactctttacattttatttcttctcttatatgaatgccatctgctatatgaatccgccagaccgaacactggaggcaggattggggattttgttggaatttagaatatgttgagtcttattgtgattctctatcactgtattgtcattttcccttgcaaatagggtaggtatctaaaggaaacacatgaatcagtggttaagaagaattctaatgctatgactgagtctgtaaagaagcttggcacaggctagaggaacagggcaagtcctgctatgtcagagggagtacgctggctgcaggagccctgggcttagaatcagcagatgaggtttgaacctcagccctgttacttataggctgggtatccttagagaagcctcagcttagcccaggtttccacatctgtgaaatgggaattatagcagtacttgtttgtgggcttgttgcgtgggtaaatgagactcattaatttactcagtaatgatttgttaaatatagtacctacagacactggatattttagacactggatatacagcagtaagcaaaacaaaagcctctgcctcatggaatttatgttctaaaaatatacgtaatggaatttaataaagtgtttatcagtcacattagtttgagcctctctgatgaactcacactgtggtttttgctgttatttgtctataggtgttacaacagtaagtaattagggctattattgggtctcatgtttgaattggtataaccctagggaagtcccagtaagtaggacatttgtgtgtgcctgctaaattgcagtacgcttagaaagtctgttccccttgaaccggatttctgtcatttttgcccccatgaagggcttgtttcaaatagttcagcagtccgctgagattcaggagtggcaagtggtggtgtggctgaactggtttctctctgtcattggtgtttgcactatttgtgatgtatgatttcacagagttgtgaaggtgcttgtgtcatttgtggaaataagtcaaagggctaacacaaccaattaaaatccacaagccacgtttcagtgagtaatttcaacctttcctctccaaacttttgattagctacccgtcaaggaacaaaatgaacaaattgaaggtttcagttcgtttttttcattgccttccctctggggctttttctttgagtatcgtaatgcccaaattccacgaaaggagaaagggcaagcccaggcagcaaacctcagaggaaccgcattctgctggtaattgcatgccgtctcccaagaggtgtatctgtattcacctccatcggctatcaccttcttcatgcagtacttcagatctccagtggcacacagcccatctagttaaaaatgcaaacaggagattattttctcaccgaatggcctttgtggcccagaagaaaaaaaacatggtcatttctgctgagacgtaacctgaaaaacactcccacaagagtggaagctgaaggctcgctataagctagccctgcctcagaacaaggctggtgatagcacgtgggtgtgggaactcatgtgcgtgggctcagggcatttgtcgccaatgtacatgatcgaagaagcttctatcacctgaaaagcagttgttctgcagggcaaagcctgtttatactccgaggaattacagaacagacgtttacttggacgtggagatttggtctggaggaatgtgacatggccctgacagcacatccctgggtttcggtgctcctctgctctgcccagctttccgtcatctggcctcccatgacctcctgtgctcccattgtggtttccctgtgtgctgacaagttttctggttgttatgtcttgcagccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccaggtaaaatctcggatgatgaccaatctgttcccgtttatccaaagctggccagggacaacagggggctgcccctgctctcctgtggttccatcctaagagaccagagctaaaagggaccatttgcatgaatcagcatggcatttttcacacccttttcaaccctgactcaagtttctgaattaacctctctggtgcctagagttaggggaaggagcacctcctgaaccagactctggttttgatggctctctcaatttcatgtgctctctgcactttggtgtaagataacataagaggaaacagtgttgggacatgtgccaaccttttcttttctcatgtttatcaggcagcgtcaggcaatatttatttgtggggttgggcccctggccctaagcactgacacccagtcacttagaccagatccactgggggagagacgtcgaacatagaataaaagcttgagagacgaagcgatttctcttaaattgctcacggcttatgcctcgttgtcccccatatactcccgaaaccatccatgctcccagcctgcttctgtctctgtgtgtcatgaagcctgagctgtcctgggaacaggcactacctctctctgagggagagcagcttgacctagttcctcttctcagggccatgctgtagttttccctgcttttgtgacttccgcacttaagttttttgctcttgtgctctttgggaaaaaaaaagagctctttacaaccgggaaaagaacgaatagggatcctgcagaattcctatgctgtggagctcctaaacgtgcttctctctcaagcttagtctcagctttcagacaaccaaattgtagagcccagttataagcatcagaagcgttttgggctttgggagtattttcccttctgtctttttctccaaagggtggatccagcagagaggcttaaataatttatgaagccgagtttcacttttagaagaaaagaaaaccccatgctatttatatatatacagatacatatattactttattccccactaggcacttacacatctatcatttcattctatcctcgtgtgagaatgagaagagaaatggcctgaaccctactgtggaaaaagaaaactaaaacacagggaggtgacttggacacaatgctatgactaaatgagagccaatccagaattcaggacttctccccctcagctcagcactctttcctccaaacacgtgggtaaccccaactttgagtttccgtgcagctcccagcccagagcctgacttgctcttttaggttttatacagctttctacctggctttgtcctggatgatgggaaggagattttcagtaattcttttttttctcactctataaataagggaaattttcagatcatgtcttcctgacattctagtgatttcctaatcatttcttggacatcttctgggcactttgggagacatcaactttctaagataccagaaatagcatagattattctcattagatcatgaggacctgaaccagaggaaactaagtgaccacagacaagtcagcttccaaaatgcctcacttactcattagagaaacttgggctttaggaaaatgtaattccttcatttttatcaaaatggagtaaaaatcttcaaaatattggccctttggacaaaatgggttaagagactcaagagagtgaaatcactcagctaaaatcctaaaatgtcctctctgccttgatggtactcacttttttgtgactctgagatttggggccctgtttcttgtcaagtatctctacctcttcactcgttttcatctccccaaatatttccagactgtttttccttcctacttcttcctacctcccaaagtatttccagattgacagagggcaatggcaatagaatctgccattctgttgccatcttgtgtgtctggggtcacagttactcagtacctcctcccctggccattgttagaatagcactatttggacaccctttaggaagctgccctcttgaaatagtcaaggcaggccgggcacagtggttcacagctgtaatcccagcactttgggaggccaaggtggggagatcacccgaggtgaggagttcaagaccagcctggacaacgtgacaaaaccccatctctactaaaaatacaaaaattagccaggcatggtggtgggcgcctgtaatcccagctactcaggaggctaaggcaggaggattgcttgaacctgggaggcaaagtttgcagtgagccaagatcgtgccattgcattccagtctgggtgacagagctagactccatctcaaaaaaaaaaaaaatagtcaaggcagagttggactaaatgtgtgtgcccagatgagcacagacagcaacactgctgaggagctagcccatcagaggaacagagagggccgaaacctgtacactgtagtatatagcaaagaggtggtggtatacacccattattcaggtccactggggcctccctcaaatccacttccagagcatgaagcttcagatttccttccctgagcaaagcctttataagtaaatattgaattagatctaatcagtggtcccatgaacttctgaatgatgtctcctctggaaattgcttactgtctgaattagtctgttttcatgctgctgataaaaacatacccgagactgggaagaaaaagacgtttaacggacttgcagttccacgtggctggggaggcctcacaatcctggcagaaggcaaggaggaggaagtcacgtctttcatggatggcggcaggcaaaaagagagtttgtgcagggaaactcccgttttttaaaatcatcagatctcgtgagacccattcagtattatgagaacagtacaggaaagaccgtccccagtgattcaatcatctcccaccgagtctctcccacaacacgggaatgatgggagctacaagatgagattcaggtggggacacagagccaaaccatatcactgtcccctcttcaaaccatttatagaccttgtttgttcaaagtcaggaatgaagatgccttttgcagcacagtagagaaagggtgctggagacacattccctccgtatttcccttttctttcacttgctcacccctcccccaaaaaagccgatagccccaaacccgtaacttgcatttgcccaggggtccctggaaattatgcctaaatgatcaacccctttccacctgccagtctagctggtcccacctccctgtagtgccatatgatggcgaatgggtcatcattttgcaaggtttgcaagggcatttgagggaaactcctgtgagtgctttccaggccttgtgccatgctcagaggtgaaaattaaaagggaactagcaggaggatcccaacttgttcatgcccttaaaggcccagctgaggtctgaagggcactgttgacaggagcagccgaaaactaccccaggccctctgtatccagttttgagatatactgtggagaataggaagccaaagaaccaatgatgcctggtggagattttttattttatttttttatcagagccaaagcctacaaatacaatctctctgccaacaggatttgtctgttttggtaggaaccctacctaaagcaaactgcttaagacctttcagaaggagttatgggacacttgacttgttgggctgacaagcttttaagaagataagactttttgggtagggttgccagatttagcaaataaaataaaaatacagcagacccagttaaatttggatggtagataaacaacaaaaattttttcatatatgtatgtcccatgcaatatttgggacataacgtatactaaagaaatatttattgtttattctgccatccaaatctaactaggtgtcctgtattttatctggcaaccctacccattcctattccttgggcaacaggaatggccccctttaaaagcacctcttctgtcatttctcccatttttgtgcctatcctaaagcagtagagggagatctcaagggaaaagccctcccatagactgtcagttgcctatcaacttgagaaaaaaacaaggccctttcttggcttgcttatttatttatttacctacttactttttttttttttttgagccagggtctcacttgactagagtgcagtggtgcaatctcagctcactgcggctcccacctcctgggctcaagcaatcctcctgcctcagcctcccaagtaacctggactccacacgtgtcccatcatgcctggctaattttttttatttttttgtagagatggaggtctctacagtctggtcttaaattcctgggctcaagcaatcctcccacctcccaaagtgctaggattacaggcatgtgccacagtgcctagtttgttattttttaacgtactatgttattgccacttcattattcaatttcacaaacctaatatcaatggaatgttactccttttgaatgataatcttgggcacctggaccactcccttttatttctggctgccaaatacccctgctggttttccagcttgcccctgttttgtcccattatccttgtttagtgaggttaataaataatgtttgtgaaaatccagtcagaggagcctttcctcagatgctgtttcccttacttttagtcccccttccctggtctctttgctttttacccacctgctctgccctgtcctcaagaggcagaaatactgcctcaaaacctggtctctgagaccctggctaatgtgaactggattctcctttcaccttcaatgtcagtgtcataacaggctccatttgcctgtcagtatagtcttttatctgttttagcacttttcacagccaagtcactcctcctgtctgcttcccagcctctcaagaaaaaaaaaaaaaaaaaatgcctcttatattcctccctggaaagttgcacataggatgtttggtccttgctggccaatacatagactcggtttctttggctcacaggcagtgccccttgtcctgaactttattctgtcatcataattagccaggaagagctgttttcctgttggagctggtgaatactaaggactcttctttcctttgttcccaggggtcccacttcattttcccccactttcccaatgttttcccacctggccatcatctcttggctcctagaaaaccagagggaacaacagtaaactatggcccagcaataaattcgagataaccatttactctgatcactctgcacgatggagaccatgtggctcacaaagcctgaaatatttaccacccggccctttgcagagaaagtttgccaccttctgctctagaacagtggttctcaaccctcactgcacgttggaattacttggagagcttttttaaaatactgatgcctggccgggcgcggtggctcacgcctgtaatcccagcactttgggaggctgaggcaggcggatcacgaggtcaggagattgagaccatcctggctaacacggtgaaaccctgtctctactaaaaatacaataaattagccaggcttggtagcaggcgcctgtagtcccagctactcgggaggctgaggcaggagaatggcgtgaacccaggaggcggagcttgcagtgagccgagatcgcaccactgcactccagcctgggcgacagagcaagactccgtctaaacaaacaaacaaaaactactgatgcctgtataatatctgcatatctgggtagaacctagacatctgcattttctaaatgctccccaggtgtttcggatgcacagtgagagtgattgtaaacattcaacggacatgagaaaagcaaaaacaaaccaaaaaaaatgcctcatgtcccctctcccttcttcctcctccccacactccccatacaggtgcacgtgtgtgctcatgcacacacatgtgtaattgccctcatgcaccttgtctattccctcccctgggggttggagagctccagctctggaatcctgtctcaccagcaagacccagtctagtaagaaatcaggaacatctgggagagctcatgtccgcccgtggcctggaactgaaacttggctttgctggaatttcttctttttgactcactgagcattgccagctttcaacaggttctgttgggagtgtgttccccagagcagcttggaacttctttcctgcccctgcttccctcccttcccccaaggcactcctgctccaaaaatggggcccagcctgccctcccgctgtttggctgttgtaactcccaggtaaagttttaacatggcacaaggtgaccccacaaaaagtgtagtttcttgaagcttatggcttttctctgaatatttctcatttttctcctgtgatctttgcagctttcccacctcatgtcttgccatctggctgccttgccaggcacttcccacgagaggggactaggtagcttacagggaaagggaagaagagagatgaaatgtctggggctttctaagggttttttcaaaaatgttaaataaactcctgttttcacacagcacaccgttccggaaggcaaaagccttgtatgcctgcaaagctgaacatgactcagaactttcgttcacagcaggcacggtcttcgataatggtgagtttctcatcccctcacaaagatatgggcggggggcgggggcaaggggagcacataaataactggcattttcaaagctcctcccgagggaaaatctcaatacaatgggtaagaaaaaaagtgtgtgtgcgtctgtgtgtgttggtttctgtgtcttttcccaaaataaaatagcagcagcaggacttccggagacattgtgaagagtggactagtgtaatcagctccatgttgagttgttaccactgtaaatgagattgtgcctgcaaaagacccagcccaggacctggaagtggctttaagagatcatacacatcacatgtttaaaatggtactcaacatgtattaagcattcactaaattaatatttttattattaaaaccatcatcatcattgtatccatcttcgaaaaaggccctgatgctctcatagttcacagtgacagtttttcctcacttttgtctgggcagtgggtgctgcacctgattccgtgggtcctggctgcatctgtaaacacattccaggccagagcagagatgagttcctggggaccagcccttgactgtagtcacgtccacaggggctgccattgtgtgtgcccagcccctgcattcagcatagcagagatatccatcaggtacaggtagacaaaagggggaacaaggcacagaacatgagggtctctcccaggtcacactcaacccttggccttctgggtcagcaggagtgggagggattaccccagaactgcatgtgggcgtctgagtctgcattcccttttatcgttctcaaagcctcaagcactgtccttaagcctttgctccattaactttcatctaggccctttataaatcaaaatgcacgaacagccagcccagccacctctcctgtccacagctggtgcttgcaggccccagcagactgcaggtgcagtgggtctgctgaaggctgtccaaagccatttcactggtgagtgtcccccacacaggcccaggcggcggagtcctggccctgccgtaacatgacacggcccttgcagaagacaaaccagaatgggctgcgttgcttgggcttctgcccccctgctttgtcagcaaggaaggggcttctgcctatagaagagcaggatttgagagattcctacattgacaggtgaatccagggcttaaaggtctgtcctctaagtcccaattcactgctcatatgggcaggggatcatcatgtttctaacaaccattccctctgacaacacaaaggactcctgatctcaggggcagaattgttttaaactatcaaaagttatgtatatgcttctgtcttctttttgattccttttggtgagtgcagccttcttccattttttaacggtttattaagatagccatacaacatacaatttacccatttaaaatgtacaattcaatggtttttagtatattcagagttgtgcaaccattgccactatataattccagaatattttcatcacccccaaaagaaaccccataccttttagcagtcatgccccacttaccacaacccatttccatccagcccaaggcaaccactcttctactttgtctctctagatttgcctgctccggacatttcatacaaatggaattatatagtatgtgatctttgaaactggattctttagtttgcataatgttttcaaggttcatccacattgtagcatgtcagaaccttcttcctttttatgtgcgatggtatggatatagcacattttatgtaagcttattcatcagtagatgggcacgttgtttcctctttttggctgcttgaataatgctgctgtgaacatgtgtgtaggtttttgtgagggcgtaggtttccagttctcttggggatatacctaggagtgggattgcagggtcatattaattccgtgtttaagtgtttgaggaaatgccgaactgtttcacaaagaagttgcaccattttaccattttatgttcctaccttctttcatttttaagtctttctgcagtagcttaaatagttaagcataaagggggaaaaaggaagagaagcctggatgattgttaactgccaagtcctttttttccccagcagagtgtccttcagcttccacagccatcttcactgccacaccgaagctccgggcacctccacctctcacctgggcacttccactggccgcctgacacatcttctcacatctgctcttgctgccataaccccctctttacagagcagcgagagtgatctttgaaaaacggaaatggcattaaagcccttcagtggcctcccattgctctgagaattacttacaaggccctccagggcccagttcctgcccctctgacctcatgccctcacttgacatactacagcctcatgccttcttcatgttctcaagcaaggtcggcaaactatgacctgcccgtcaaatccaacctgccacctgtcacctaacaattctgtaactgctcccacatacaacatggtcgtcatcataaatcctataggtattgttgagagcaggaggaaagtttggttgagtgagtgagagaccttacccaagccttcctgtggtctctaggagtcatggcagagttcgctgacactggtctgcttttaaccagccttgccagtgacctttcaaattccctgaggagcaaaaggccaaattgaacctgaaagaaaacacctctcagtgttgactgagttgcagtagaaaatggacctgacaaaacgttagtacactttctcaattgggttagctcaaaatatgttattaggtcttttttccagaggaaaatgcttacacagaccctcttcctccccactccttcacctctacaggagaaaatgaggcattacagaacactattattctgtcaggcggtgggtggggtggggggtctttttccttgttccatttcttgttagtttactgctggggatatgaggtaaaggctatttaatttgtatgctgtgtagttgtcagattaaatcatcaaaccaatcagaaagtgcacgtgtgtgtgtgtatgtgtgtctttttgtgtgtttcaggattaagaagaatgaataaggaagaggaaaagggaggggcccgtggaggggaaagtctgttgtttcgtaatgattaatcttgaagcctttggattccaggggcccctactgtgactctggagtggctgctgctgtcagctcatgggctttgtgcagtgggaaatggatgtgcaatacgtgcaatacctagaaataattccagtgtcatccctggccaatctactgggaaactgtccatttcaacaagagcacctcagacagtaactggaaagagaaatagctcatattctcaggaacgttagtcatcttgaagcagcatgattcgtgatacctggaaaatgcacatggcagtcactaaaattgggttctagggatacttttaataagatttgagaggagctggatccattcattcccatggtacctaacacagcaccactacacagcaggcctgtcccaaatttcctttgctgctggagaacatcctcatgggggagcccccaagctgcctaggaaatgggttaacaggagggcactcagggatctccttcagtttctccagccatcttcgctgccacgcccaagcccaggccaccttcacctctcacctgggcgcttccactggccgcctgacacatcttgtcactggcttccactcttgctcccagaaccccttcttcacatagcagcaagagtcatctttgaaaatgaaaatcacatcatgttatttcctgcttaaaatctatcagtggcctcccactgctctgagaatgacttacaaggcccctagggcctagttcctacccctctgacctcctctcaccctcacttgacatactgcagctttgcaggccttctttatgttctcaagtaaggtcagcaaactatgacctgccagtcaaatccaacccgccacctgtttttgtaaataaagctttactggaacacagacactcatgcctttgtgtctgcgtgttatctgtggcactacagtggcagagttaaggagagagacactctcactatgaggccctttaagaaatagatgcacaccactgttctaaaatcatgcccagctttttcccgtcacagggccgttgtacttgcactacccactgctctagtctttctctctccttttaccactacctaaaattatatgcttgcttattgcttgattgtcctgccgagcaaaatcttgtctgcttgttctgtgctatgtgcaaggacctagcatggtgtctagcacgtggtaggtgctcagtaaacatttgttaaatgagtgaatgtactttaattacccaggggtctgcacctcttttagttaagacttcttttggggacagtcagccattagagaccttagtcacacacttgctccctgtccatggtgagtgaaggagggcagaagacatgagttgtgtacacagggatgtatggtgtacatgggtagagccgagagaaagtggttggcaggaagctcacccatgtccccagcagcttatatttagtatatgctgttgagctgaagagccactcaggcagcttgtggcaacaccttttgtgtttgtatagcatgttggacactggtgcagttcagtgttgcacattggcgccattcagcccaacaagcacttagcatctttgatgttcagagcattgggctaggcaacagcagtagtagttaaggtgacagactctgggatcagatgtcttggtctctgattcattttcattgtctaccagctattaatatttaattttggccaagatgcttaacttttcacagccacagtttttcatcagtaaagtgaggataatagcagaaccaactccatagtcattctgaagatgaaaggaggaaactcaggtgtgaagtgcgtattcgcaaagggtctgccacctggcatgtgctcaacatgttatcatccttatcagcatgggtcacaccctctggttaaatagaggcctgatacagtgggaagggagttggtctctggagtcaaacaagctgggttcaaattttggttccagtattatgaccatgcacaaattattttacctctctgagccttaattttctcatctgcaaaatacagataataataatacaagctgggatcctgaggatcaaatgaatcaacatgtctaaaactccaagcacacagcagcttcataacatatctaagtgttagcttgtatcattataattcacgaggcagaagggagttactgaaggttgtggagccaggaagtgctataatccaaaccaaaacgcactgaaaaactagatagagaagcaaagcttagcacgtttgaacagcatataaataggacccatgaatactatgtggaatgtactatgagcattttaggtgtctggaggaggagggagcaggtagaagggattccatggtagtatttacaaaggaagtggggcttcagctaagcctttacatggaaacagaagacagcagaaagaaagggggcactggtgctgcctccctcctctattagtaaatgacaatttgcattttatctcagaggcatttgggcacagaaaagttatagctcctaacttcctgtgagctagtgaaaatacaggttcctgtgtcccattcccagagattctgctttaattgatttgccatggggcccaggaatgtgcagtttgaataagcatcctgagggttccgaagcacatggtctggcacatgctttagtataaatcctggcttgaagcctcagtgagtcagcagtccaacccaaaggctgtgttatctcctgccatctcctgtgacctaccttttggcctccagtttggagggcctctcttgtcccctctaattcttcccttagccctcaaattgcattgtaaatgttttcaccccagtacctgtgctgtgggtgaacagctagccaggaaaaggagaaaggtctgaaggagatggactcagtgcatccagtagagtaataactcaacttggagctttgctataaagcgggagggcctggtttttgtttttttgttttgtcagtctggctgctttattctttctacgtttttattttggagaatgggtttgatttgttaattttattctaaacatttgatttttcctgaagcttaggtgggtggtaagggccatctggttttactaggtcgctactaggagggggtcttgctgagcagtcccgatccagggtctcctactgactagcctgtactgagcatttgctctgtgcctggctctgtgccgagtgctttatccacaccagctcctttcatatttgcaagaacccagtaaagggaagagggtcttgttgtcaccagtatgaagtgcagaaactgaagtgatcttggaagctttggttggatggatgggcagagggcaggggtatatgggtgttctttaagagtggcatgggagagctttggtcattggagaggccaggttgcttttaagttgtgtcttcttccaaggcacttctctcccagactgtctcttgtgtgggttgtcatgaacccaaagtatccttgctgtttattcctgaagcttagtgatctgaaattggccaactttggaggccaactaatagatgtttaaccttgtcttttcctaaggaggcactcaaggtgtacccaaagttgactgacactgatcttctggaagcctcaaggctgattcttttgctgcctcccatttgtctcctttggtttctgttcttgcgtctttccctacaaactgaaactagaattctgtagcagtgtcggagcggaaatgcttttctaaaacaagctcaggaagtcatttaattagcccaggaagggaataggggaaaatctattctctccaaataatcttggaaaattggagttttcctaacacattaagagtaaatgtcctgcctcactgcagagtgatctgtacatcttcagttgacaagcatgaacatcccccacctcttagtcccatgattccttctctcttccttcctgctattgactactgtgcagactcagctggattttagataatctttataatatcacaatggtttccatggagatggatcatgatgtcacaaaagtagatatatattctttggatactgaaaaatcaaagggcaatagagggaggaagagaagaattttcaaactggtatatagaggagggggaaatctagagaacaggaaagaaaactaagaaagggtgtgagtgaaacagagaaatggctattcaaaggctattcaaaatgacagcaaccaaaaaaaaaaaaaaaaaaaccccagaaaatttgcaaggaaattagaagcagggggtaaggatttgaaggaaagtaagatgatgacaagaagctggattgattgattgagacagggtcttgctctgtcgcccaggctggagtgcagtggtgcaatcacggctcactgcagcctcgacctgctgagcccaagcgatcctcccgcttcggcactccccctcctccaagtagctgggactacagacacgctccatcaaacctaggtagtttttgtatattttgtagagacaaggttttgccatgttgcccaggctgttcttaaactcctgggctaaagcaattcacctgcctcagcctcccaaggtactggcattacaggcgtgaaccaccaggcccagcctctagaagctggatatctttaaagagtagttcttagcagtcttccatgggcactgcactgagtacatagttgatactgggcaggtgggtgggtggatggatggaaggaaggaaggaaggaaggaaggatggaaggatggatacatgtatggatggaccaggacaactgttgccctctaacaagagtaggaatctgtcacttctttgtagtttaaaccaggagcttcagaaaatccgtgaaacccctaaaattgtacacaaaattttgtatgtctgtgtctgtttcctttttcattgtaaagaaagttcaggacagctttcatcagaaggcttatattccacaaaaggttcagaacctttggtttaaacttctagaatgatgtaacttaataagtgattgtactcattgtccaagcttccttcatacacacacacacacacacacacacacacacacaccccacacacacatctgccgcctgctctatctgtaatgccatctcttctcgctttctctccccttcctgtacagttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttagcaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacacttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggtagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaaggaaaaaaaaaaaaaaaaagaatgccatgccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccaaactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaaaggaatgacctaggtgttctgccaaaggagttatctatcatctctggcaaacttgacaatcatcacttacctcgacaaccctgccccacatcactttataaagtcagcaggatgtcctctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtacttattaaatggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttccatttggtggtattttcttgagtttctgatagagtttgactcaatacatgctttaatatgtcttcaaataagcatatatacatgatgatcaaaggtcacaagtctcggctcctgcggtttttggtgacaaccaccgtgcttatttctgatgagctctgagaagctttgctttccatttaggaagaggtcagatgctaggaaacttgagaatttgctcctcaggcatattaaacaattgagcccgaagagtcatagtccacttcacatttctaacgttcttctcttagaatacatattgttttattcttcctaaatttgactttctaatcacctattttctgaaacctcatgaacacaaggatggaatcatcagagccagaacacaggcaatgcccccagcacagctggtttgtaagtctgttgtttagagcttgttgcatgctgtcccaggccaagccagatcactgagtcttcgcattcatcatgtcccttccagatacattctgagtggcagcctgggacccaggcttccagtgagctcccagcttctgccacaagcacagaggactccctgatgggctcagtggaggcggcatggggaagccagcgctctggggactgaggatgaggcttctggcttcagatgcttgccctgggaggggaggaagggatgtgaagctcccttggtcctggttctaaggggaggggggctatttaaatgcgtgggtcacatgtgagctgtctgcttgtcctcatttgccacttcgggcactcgtttacccctgtgaacagcacaggctggcagcagctgctgccctcactgagttgacagcctcctctggaaaactcccccagcacccaaagcgtcccacatgtgtgggtcatcctgtaactaggcgaggctttctgagtatggtgtacatctatgtctgatccttcatggagagaatgaaatacgtggtgtgtattttatctttgtccttggcctttccaatagatttcccaatcacttcaactttcatgccttcctagcagaaggttttaattttgttttgcttttaacagccactcagagcagagcgcaaactgtcacgtcctgtggttttgcttggtgtttttcactcagttctgactgcatgattagtcctaagagcacctgggttagaagtggatttgattgacagttgaaattaggtaaatgttagagagtgagtgtgatgagagattttctcagaccccaaacacgcttgctcatgagaattaagtcatggctctaatttcttattttctcagttctttcccaacctccactcagataccacacttctctcctacctgaatgtgtcagtgtcattggcttgccctgcttttaatagcaccaagctaagctgccactaattaactatgcggggttagtcagtgttggctgactgcagcctgcacagcagccaagggaggctctaacctccatggtaactgctcggggtgggtgaggtttgtcacatggaggagctttgcataaccatccgcagggaaggggcatgcccatgccgggatgcatccttcagaaagccaccctgcggtacccagtcaacatcagacagtgaggaccaaagccagaaggttttaagttgaaatgatcaacacggagaccctctgtatcccacagcacttagcaactcctgtcgcactgtaaatctgtcacgtctcttacgtcattggctccatgaagcctgctgcaacttcctattagctgaaagccaggtagctttgatgccttccccaggccaaccagcaaattagtaaaaacgtgagtccatgggttctttctttaggtgccaaatcacatcttaccctccaggtcttgtgcccaccgtaaacttgaaatatttgttctgacactgtggctggatgtccttttgggatttgtgggtgggggtagattattggaaagaattattaactgtttttctaccttttctgaatcttcgtgacaaagaaaaggagtagtcatgcttgcctcacctgtgatgagcaagttgaaattatggccgtagaggatggccatctttctgttacaccttttctcctatcacaccatttttctccctcatgtactttctacctataattaattcatgatttgtcatcaaatgtttgaggcccatcttgctcttaataaacagctcagttaggacagagaccaggtcttgttcatctctgcccagtacccagcccagggctggcatgcagcaggtgctcatagcccctgggtgggctgaccaaggggaaaaaaagtggggaaagcactgcactagaaggcagttcctcctccctgttttactctacagttatagttggaagaaagaaattgcatgttattacacttgggtacttgaacacagggtaactttgtgacccttggcaaaacgcaccatttgctcacatactgggattggagcttgtgggaggaagacctcccaccctccactcaggcacacacagccacattctttcccagcctccttggctggtgctgggcacaagaaaccatctggagaagcagctgaccaagagccagagaccctgtgctgtcatctgggttacttaggggttgtttcatgaaccttatgtgaaaagggcctgccttcaagcaaaaccacatcagaatcacccccaaacataaaagaagtattcctttgtaaagtcccttcacggaaattccacactgtcccacaggagtttggtctgatatctaacactctcactgagggaattctttgggtctgactgaagtttcccatgtggcagcttaagtccatttccgttctgtttttccttacagtggggagtaactggccatggcccattgagagcaatcaccctcgattttttatgtttccattcagccatcagttattgaccacctcttccatgccggagctgctacaaccaggaagtgtaagacatgatctctgtcttcagggaactcaaaattggcttctgccatagggaaatatacaaggaacagcgtttgccatgtggtatgaccatactagcagtgtgtggcaggtagtgcagtgcgatgaggaagaggcatccttcctactgggaaataggaaccagagaaagtttcacggaagaggtggcattcaagatggaccttgaaagatagagaagagtttcccacttaggcaaatggagacatgtcccaagcagaaggacagcaaggatcaagaatgaaggggggagagagagaaatggggaaggtgggagtggggagaaagagcagagagagagaggtggctgggtggttaggtatgatttcaatgtgactgaaacatgaggagtcagggctttctggagaattgaaaactctagtcacccttacccaccccgcctgttagcctttaggctctgttttctctcaatgactgacaatattagctaacatttaactaggtacctaacgctgtactatattaatcactgaatccccaagacatttgaatgaagttctataatcatctataattatagatgagaaaactgaggatcagggaggtcacacaagccaggtggcggtgaacctaaagttcaaacacaggtctctctgcttctacagcccatatgactttttttttttttttttttttttttttggagatggagtctcagtctgttgcccaggctagagtgcagtggtgtgattccagctcactgcagcctccacctcctcgattccagcaattctcctgcctcagcctcctgagtagttggcattacaggtgcaagccaccatgcccagctaatttttgtattttatttatttatttatttatttattttcagtagagacagtgtttcaccatgttggccaggctggtctcgaactcctgacctcaggcaatctgcctgcctcagcctcccaatgtgctgggaccatatgaccttttaaaacttccaaatttatttatagatacacacacataattttacataaatgcataatcacatcacacgtgatcactttaaaatttcgtggcagtttttccttctggttttgatttggttcttccatcccccacatcagcctcctccctttgcagaacccatgttgacaacctcattttgcccttctcagcagtgagcccttcagaaagcacaatctctggcacacactcagctttggttttccagtggcaggaataagagcaggaaatgtttggattaaaaattttctttccttctaggagccctctgcttactcatcttgggtgaatagttccccatttcttgagctctgtgcagatactcctcattccctgggcagccccggggactccagctgcaagtgttggccagtcacttcatctttggggatgtggcatggaggcagcccccacagagggcccagccgtgctttgctggctggaaatatgtaatgtgaaatttttaaaaaatttaacaatgtgaggccggacacggtggctcacgactgtaatcccagcactttgggaggctgaggcgggcggatcacgaggtcaggagatggagaccatcctgactaacatggtgaaaccccgtctctactaaaaatacaaagaattagccgggcgtggtggcaggtgcctatagtcccagctacttgggaggctgaggccggagaatggtgtgaacccaggaggcagagcttgcagtgagccgagattgcgccactgcgctccagcctgggcaacagacccagactccatctcaaaaaaaaaaaaaaaaaaaaaaaaaacttaacgatgtgaaaatggctcctttctccaccccgatccagctgccgacaacagaccttcaggctctatgggattgccagggaaatcccatgagcgtgtgtcttcttctgggagaaccagtgtgtttctaacccgatcttctaatgcttaaaaatagatcattttcatggcatttgaaccccctcttgagcctaatgagatttaaagaagtcagagctagcagagagagcacgaagactcaaagcagatgatgggtgagtatctgtagggcacaggaatagtgggagtcaactaaggtgggcttactgagcaagactctcactcaagtctcctacactccctgaagggggctaaactgttgcatgttaagaggccagtgatgaagtctgtctcattgatggagcacttccatgttatgggcattgtactaattgctctacattagtctcatttaattctcaaatcagctcatgaaataggtgctgttgttaccctattttgtagatgaagaagccaaacattagattgggcaacttgttcaaagtcacagagttaataaataacagagcagagaatcaaccccagtgggctgacactagagcttaacgcttaactcccatactcttgacgctcttaattcccgtactattctcactctgggaacgatctcagaagctccactccccaaacgtccttcacttctttcaccccaagggaatatcttttgttttgtctgcttggcatccagtacccatctttctggtaacagcacctctgttttcctttggggagccaccctgcctctcccctcaccttgggttccatgggtttgggtgagctggcatcaacccgtgatccaaccgtgaacctgtgaccctgctctggcctatgagatcatcacatctacccagccaaagtgattgattgattcaggaatgggcacagggcctagttaagtccccagtgccagggctttgtcctggggaatggtatacaggacacagcagaggaattcatcctatcgggaaagaatagtaagtgctctttcccccagcctcaatgtctcctcagcatgaacactgtctgccacttgtcttcgtttagaggcccagtataaaggctcctatactttatgttgactatttactgagattttaatagggtacctctcagaaaagttgtttcagatagcaagcagaagatgtgaaatattcattacaatataaaatggacaaacagtgtcccactttgatcaatcctggaatgatttcactaaaagaaaaatctaggccaggtgctgtggctcatgcctgtaatcccaacactttgggaggctgaggtgggagtactgcttgagcttaagtgtttgagaccagcctgggcaagatggtgagacctccatctctgcaaaaaaatgtaaaaattagccgagcacagtggcacatgcctgtagtcccagcttcttgagaagctgaggcaggagtatcccttgagcccaggaagtcgaggatacagtgagccgtgatcatgtcattgcactccagctaagctacaaagtgagacagtctaaaaaaaaattaagaaaaacagaaagaaaagactttatgccttcctccactctggaagcaaagcttatttttaaaatactgactctcgttctccattctgggccaggaaaagccatgactggatctcataagaatagggaggaattgtgtcatacagaggcctctgcaaatactttcccaaccacagttgattcaagtcgtcacttgatgatttggcccatcccaggggtgcatcagtgttgagacatttcaccctggagttcttacaaaggacccctcagtcagttgtaataaagaatggcaataaatcatgcccagatcatgacatggaattggatggcataaagtgctcctcagttcagaaagatgttcacacaccttggaggccgcacccaaacctgttcaaccatcccacaagcatgagtctgagacactctgggggcacccagttcagaccttcaccttcactgaggtgggacagcttcgttggaggccctgaaaggggttaggtatgtctaatctcagataccctgctgctgctcttcctccatgccgtgctcacatttttcttgtttcaaggactgccagataaagggattccaaatcttttttcttttcctttttttctttcttttttttttttttttgatacaaagtctcgcgctgttgctcaggctggaatctcggctcactgcaacctccgcctcccaggtcccagttcaagcaattctcccacctcagcctcctaaggagctggaattacaggcacgcaccaccacacccgactaatttttgtatttttagtagagatgggatttcaccatgttggttaggctggtctcgaactcctgatctcgtgatccatccgcctcggcctcccaaagtgctgggattacaggcgtgagccaccgctcccagccagggattccaaatcttgcaggaacaccttcactggcaaggagggcactcctggcccacaagagataatacattcacttaagtacagcacttcaaaatgttcaagggatttttttctgctccaaattttgatcatggcacacctctgatcaaaaaatttcagaagctccttgtggcctggaaaggaaggaaggagggaacaaaagagggaaaaaaagagagag

SEQ ID NO: 335 - DNA, 5887 bp, Homo sapiens
ctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggggtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttagcaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacacttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggtagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaagg

SEQ ID NO: 336 - protein, 615 aa, Homo sapiens
LLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNVHPSQEPGWLEGTLNGKTGLIPENYVEFL

SEQ ID NO: 337 - DNA, 47613 bp, Mus musculus
  misc_feature (1)...(47613): n = A,T,C or G
gatgtctagagccattttggtagtcacatctgctgagagaggctggctgtggcacccagtgggaagaaggtgcctgctcttgctcttggtttcagtctcctccggttgcaccccagaagcgcacaggatgcgtccccagcactgccacagctgtcactcagaaagaggagctctggcttagttcagcaacacattctctgctttctctccttgctcatgtggtgcttgtctaaagagccacctcttcctttcatagcctcaagcagtgctgcttggtgtgtcagcactcagtcactttgtagcccttcgatatcagacctgggcctgtgggatctatgtcctgggtcctgggatcccagttagcttgcctgataggtatccttgtagctcatgcagtccttgaagaatcagagacactgcttctgcctaggatgtagctgtgtctctggtcactagccatcttgcacagtcacctccagaagttgtctgcccagccctgccctgctacccagagcacttagcaagcatggttcacctctggtgaagaacacctgggtaccagcatacatgcgcaacagaagattaaaaagactgcagtatcccatgaggaggcggagagaggagattctctgggggtgggtcttgtaggatgctgcctcccaagaccctcccagacggtgtgtatgggagagcaggctggttgacatagggctggcacagggactgaggttatgccgacgcaggtaatatgtttgacccctgatctagtctctagtttgagaagacatcttaagtaagggttaccctcttcctggagagagcaaccatccagctttgcttctaaggggaagaagaaagcaagcacagcctatgagcaaatgctagcaatgcctcccctcccccaggaggccaggaagagggtagtaggaggggcggtgtgattacattcatggaaatgagcctgctaggagaggagcggcgcacaccgagtgtcagctgctgctgcagctccgtgcatcgtccccatccccgcggctgggccagccttccccaccaggctctgctcactcccgcccgctgtttggccattcggcttttgtctcctctggacgcctcctcccctgcccttgtgtgctggcacacaaatgctgtcctggctccagctctccctgcacccagagctgggagagctccggggagcctgggcctgtgggattgctgtacagatccaccatggcctctgacgtggagaactgcggatcagctgaggctttgatgttgctgcccagagcttgacaggacactggggccacaggagaggggacacgccggccgccggtaagagcctggtggatggcgcatggagcgggactgcagcccccccttgttctgcctagatgcagcctctcccaccctgcaccccagatcctgcagcaggcagcaggagctgacatgctccgctgagtctgcatatctgtccttgggtttccagcctttgctctgtcctctcagggattttccacagtgcttctggataggtacccaggcatttgttgtttcttcttgtcctgagactgaagagcaagccaataaccaattcccagttctggctttggctaggttaaaaatagggtagcagaaagccaagggcagatttacagccaggctctcccctctaaatctgccgaccactggggtttctgctgactctgggcctttggaccttcctggtcaggggcagctagcaccaaggttctagcagtacacacaaagacgagcaaggtcctttccaggtgctagacagaaggaaggtttaagtgtgcagaaaaattcaatgtatgtaaagagttgttgtgcaaaggatctttaggaaggagataaagtgatagagaagtgacttctgaaacccccctctctgcttctgtttgggatgcaagggggtgtggtggcccagctgtgcagtgtgccagtgactgcagctggcaggcaccagaatggcactgcttcacccaaaagactcagtgtcctctgacccccagaggagggtgagctgaatgaccagggtttctggcatagggaactctccaccgacccaagagctaaggccccagtgctgtctctcacgaggggtcccagctttgtcctgcatagagaatgctgggagcttggtgctgaggagaagctgctgtgcctcctggctgtgtcgctcgccctgccaggtgttcagaaagggtaagggtctctcagctgtgaggacagtccctgcttgttttaataaaaccagatgaaatttgatgactcagttcctcttactgtgctgaactttgacctcatttctctttactgggctgcttaaattgtagcaaactcagctttgagttctagaatttgttcaataaattgtgttgattctttcctctaaatgatagtaaaatacgttcttgaagcttttaaagtcacactcgtgtgtacatgtgaggaaacggggtgggggtggggcaaggaaaagtcagtgaggtcctggctggtcctgggcatcctccccaccccctcctgtccctgggcaggtgttcatcagaggacctgtccctgtgccttgagaacaggagcagtcttccctccgaatccaaggtctttaatggatttacttgtagcagaggcctggcctgggcggatttgtctggaagaatgtaaactagagtatataaatctccactttggcagtttgcccaccacatctgtgtggaggatcactcgtgcttgctgcatgagaatctatcaggctttcgtccagtgagtttgtggatttctttaaaactcttatgctgcaggagggtggtgagacaaagtactttttcaagggccagatcatagtaaaaaggacctgaagtggaatcaagaggttagaatattgccagtaaattttctgtttatttttaattatggcaaaatccacataacataaaacttactatcttcgccatttgcaccatttgaagtatactaccgttaaaggtgtcgaacatatttaaatagtgatatctctctctctctctctctctctctctctctctctctctctctcagtgtgacccaagaacccttgagtaaggggaactccacagtgttcatcctgtcactggccatttcactgagcatctagagggttcatccagggctgtagtggcatcaaaacctccttcttcataaacccctgtcagtgtatgagattctaggaaggacttcgaaggctttgactcaataggaaggaagtggtattggttctccaaaggtgacagattctgtaatggtgtgctgggaatgtggcatactgctggcggcaagcttgtcactaggtctctgactgtggccacaccccttcctgtgtccaccttccctcatcctggattctgattgctatcctgaagactggaaacaacttctggcttggtgtgtggcctgaagcgtcaagctttgggtttttcatcctttgctcttatctgaaagatacttggaagggaggttgcatccttaggccttctgaatgactcagtcccatcgcttgtgaatggagagctctaagtgagggaaaacactctcctagccagtgaagcagcgatcagtaagaacttggtcctgcctttgaatctacagttgcttgcttctatgccagcctctcctgtcctgacacccttccctacagtttctgacttaacacaaggtgcaagccctggggctctcactttcccctctataatataagagccatgctccacttcagagtgttctttctggaagcagcctgccggcttattgttcatagaggggcatacgctgatgagatagcttacccagggttccacagctggtaagcatggactgtaggtgattgtaacccagcatccctggccagtcccaggtgggtacagtatctcatagacatggcccccattaacatgcactcctaaagttgttcatggcccccaggtctcctctgggactgctgcacatctgttcggaggcagcagtggctatagggtgggtgagcatctgtgctgggtaggcaggagaggaggagagtgagctggatctgcaggtgaagggatgtggctcaggacactgagcaagctgcctgtctcctttcctacgtgtgaggaacaggggaagttccatcttacagagaggtaacagccgctgcgcaacggtgtggctgcaaacacccaagttctttctaatagtttaaagtttttcaaagtgtaagtactgggatttcctggaagacaatcaggaagttgtaatacaggtccctggaggggacagaccctggccttgttgctaaggttacattgggcaggttcacagttgatgggttggtgcctggcactgtggccttcagggctcttcacactgtctctgtgctcttggaacaaggacagtcagtgtcctctcagactgctctgagagggaagcttggcttcatcttacctcctctgcaattctgggctgtgctaggtttacctgaggtgagccagaggtagggaaaagggtggaaggagagagaggaaatatccacatgcatgctcagtgttcaggaaactgtccaggtccagggtaggaaagggtgtctttggtttttcaagacagggtttctctgtgtagccctggctgtcttggaactcactctgtagaccaggctggcctcgaactcagaagtccacctgcctctgcctcccgggtgctgggattaaaggcgtgcaccaccacgcccggttcaggaaagggtgtcttaacaggagggctgtgtttatagatgtggaggagcccttaggcctgcctggagctctccccatggtggttgcactttgtatgtttacctgcttcacagggaggagaagatgcacttgtcactcttaaatacccactgtagtgctgcattaaacatagaccctcatcactgagaggctggagctagggggatattggttaatagttaaggtaggaaaacaacaaggctggcagtgtattctcaagccaggcagggctggttttttgtttgtttgtttgtttgtttgtttggtggggggagggagcaagatgaccttagaaagcaagaaggtcatctgagttccaaagcatggctggacccctctggttcacagcgtgcactagggttgggtgaatgccatgcatttgagcagtggctgctgaatagaacctgatgtcacaggggttgtgtctgcaatgggacctcagggcagctgtcatgggacagagcaggggctgcaggctttagactgctgcctgccatcctgtgcacattttctgctccttggcttgagaagaaggcaccgtccctttaagacagtcctcctttgtatgtgctggctgggccatgtttcagctctaggtttctgcctacagtgaaatctgcaagcgacatttaagtaaataaatgaaagcttcccttgtgtggcttctgtatttataactgggcacaatggccccttgttgtttggccactttaatccccttcgttaaattggaacctgggaaaggatggtgaggagaccagtgctgggctgtccctgctgcctgccggctggacgccttatgcattaaccttagagcatgggttcctgccctccggcataggcaccgtgcagcagaagggctcctctcacctggctccattgtgctcagactcactagacaacctgctgccctgctccgtggcctttcttttagagaaaggggtttagctgcctcctggcacagaagcgtggctgtagcacgtggcagtgggggagggggagttgtttgttgttctgccatctggcctgtcagagaatgttcttgtgcagtttagccctggttgtccactgggtttgatagccttctgagctggtgccctctaggtccagtagaccaggttacccagtgccgagtccttctgtctctttttcccatcgtggctctgctattcatagtatctgtgtcatcagcccagtctgaggagccttcccatctccagcaccctggcggtcatttaggttctttggattaaatgaagcagctatcaaggtttgttttttctctgccacaaaggctttcactaaagatttggtgctgcgtttggtaaggcttggtgttatgttggttgagtttctgtagaggaaagtactcattaaaatgttagatttccctcatcatagagcaaaatttcaggagaataaaaagagattgagatggttttggggtctcctaaattcttaattcttctttgaaccaaaatagaaaaagtgttgattttaggttaagtatttcaaaagtaacttagagatcatatagttagtgtcaagagactggatcgaaataaatgacaacaaatgtcacggtatttttgtgtgtgtgttttatttttaacatctttattaaagctgcaaactggctagaagccatgtgtgtctggctgcaaggacgcagaggccttttccctggaggccctgggttagtgtgtcagacatgtgacacgtgaatattcatggtaaccccatcactccattcccggacctgctccccaagacagtcacagccgtgagctcctcagtgtggcgcctgggtcttcagtggctgcctactgtgtcagagccaggaaggaaccgctgccttcctcggtaatggacagagacttcagcttgcctcctcttctgctgaggggttggctatgccttttagttcttttgtttttaccttgcaagtcctgtgatcgtgtctacactgtggacttctccctgggctgttctcaggccctggcttcctttgacctgcctctgcagtggggaccttgcctattgggtgaccccatcctgactcctctatgatactattatcacccataactgttcttcatccttggtgagcattttatgctatgcaagcaggctgattctgaaagccaacaagcctcaagtggttcaggtcaggactgcaaacagtgagtgagctgcacagtgcactgtacccaggcctctcactcactgcctcccaggagttctttgagatgagatgtgtttgtttgtttgtttgttcattttgcaagaacttgccattttgttaagagaaggtgaagtggtgccttcccattttcacagttcccagtgtccccaagagagtcttgctggcctcaagctcaggctgcccctgcctcggcctcaagagtgttgggattatagagtgtgttgcacaccctattcttttacttgcagtctttgttctttggggtacccttcctatagtccacagtttgcatgttccacatgctctctgccccaccccagctagttgtttgccatcctcacgctcctgagttggccctgtcccctatcctagagtgctcctcttgaagtcactttaaaacatgtggccagaagactggttctctgctacttggccatctggtgactctgacttgttccccacttgtctggggtcattttcatttagaatcttgaaggccttcacagtggtcactggagagtgtggagctcctcaactgtggctgatgaacccctgacccccaacccctgtcatgcagaggtctttgcttctgttgacttctctgtaggattataattttcactgtgcgatgagctgatggctgctcaagttcaggtctttgtctgctgtcccttttactgctcattttgtcctctagtcctttttgtgtgtttattttacatgtttgtgtgtttagcctacatatatgtcagtgtgccgtatgcatagttaacaaaaggttgtaatctagcatgtgggtactgggaaccaaacctgggtgccttggaagatcatcttcacctccaaggcatctctccagccctagtccttttttgacattttgtatttagataggagaattgaaggggtggaggttaatttccaagagtgtgatttttttttctgtaaaccccccccccccaagggtctaagtcttgtgaagagcagtttttcttgtttttctttgctctctagtatctgtttgctgcagggtgtgtttgtttgggtcttactcttttccctgtaggtgtcagtgtgaaagagaagcttgatgggcaagcagaaggctctgagctggcaggacgtccccaagggttcccatgccgcctgggtcagctcctcactaggtagcttgctcaccgatgctagtccactctcatttccttgcttagggataagtatatgttctcattctccagtacacagaacccagtggctaggctgcagagatccagtggcacccaagggtcccaagaaggcctgtgctctcgtcagctcctcctgcttcccactttctctgtctcttcagtggtaaaggtcaacagtctgaagacaaggctgttgtttgtgtttccatcagctttgtagtacggccctggaatctcgtcttctctctgctctgctcaaatgagattcattgatgatctgattaaccagccctgtaagcatcagatcaaaatttgatatcctcagctatttttaaagtgaacttctgcctccaagtctcaaagccatgccatgtcaaaatgagtgtgctttctggatcctcagtgtgtgtccatctgtgctgtaaacagaggcacattcctcctctgtgggtcgttctagtgtgccaccagtgtcaggtgtgaatgccgccctgccccgccccgccccgccccgccgagggagggctcagtgtcaaaccttgattcaagaacagaagaaagttgcctgtccttgttgaggatgttggtggcctacaccgtcctgtgcagggagggacaggagccaacactgcccactaaacaccaggcacagtttaggcacctcagttataaccattgcccaccgttacctgcagccaaactactaaatggaaaattccagaaatgaacaattcataagccttcacttacatgccacctgagtaacaggattaattctgtcctgctctacccttctctgtctgtgacccgttacaacgctgtaacgctaacaaaatcttaacacattttgctgctgttcttcaggctgccaaaggtttggctatggtgtacaattgtgcctgggccagacagaaaagtcatctaatgtgcgtatagagacagccattctatctgtgggtctagaactctgcaggggttcttggaatatgtcccctaagataaggggacacacttctgttccactttctcctcatgacgttggacagcatgtggctgagtggggtattgtagtgagtatgtctagagtcgtggggacttgggacctgcagggggatggggactggagtcatggggacagggacactttgctgattctagtgtttgttattcctgtggccacttgcttctgacagagtgctcaaataagaagacggtcatgtgggcctgtggcagtgtttgtgataagcatggtttgatggtgagagcacactatgaacattcaaaccaagctgaaaagactctcaatcccagctcctagacttaatgctgctttcagtttgctgtgtgtctttctagattttcttctctgtatgcgaggaattctcactcacttgtctccaaatggcacagaggtactcatgttgctttgcagctcaccggagacagctcctgaggatgtagttccactttgaccagcagggagctgaggcctgtccttgcccagctggaaggcaggagaatggtggggcggatggtgactaggcctgtcactctcctcatctgtggtggttcacctggtggcatctccctcctgttctctgtttgtggctgtccttgctcagctggtctaagagctgcaggtcctgccgcccgctcttcataaccctgcccgagtggttcccagcaggccatcatttccaaatcggcttctggcttcttttggtcaccttttacttgtgagtctttaggattttgttattttgtgggaggaatgcttttgtgacatttctgtctttgcagtccccagtgacctgactgcagaagagcgtcaagaactggagaacatccggcggaggaagcaggagctgctggctgacatccaggttggagggcgctttggaagctgactaacaggaatgcttggggtgtggctgagtgcctgtgttacagggtgcgcttatagctagtgcttgccacagcgctgaccagagtacaggcattagtggttccttttggtttcccagaaagtagaggctcagaaccactctccctactgccgtttatcagagctaaagtgactctgaactaagctttcccagctgacacaccacagaaggcagcctcaggtttgctggtaccttctgtaggtcctgactccactaccttccagctgagggcatgggatacggctctagtttgtttgtttgtttgtttgctttgattgttaacttctgttcttctggtcatgggatggaacaacagcaccttcacaagttcctgtgaggccggacgcatgtttgcagggcatgtccctagagaccagactatctcttcaagtttcttttcatagctgcaggctctcttgggaggaaggagccatgcagtgggttattctcacttagagcagttggatgttgctcttctaaaaccctgtgtaagattcaaggcagagaaaagcatggtccaaacctcacgggacagtaaaaggacaagcagacttgccattggcgagctggaatcattccgatccctgattctctggtaactgttaggaacgtggagaaacttttaccccatcctctctgcctgcacatcagaagaaggcaccagacctcactgtagatggttgtgagccaccatgtggttgctgggaattgaactcaggacctttggaagagcagccagtgctcttaacctctgagccatctctccagcccccacgactacacctttttaatacagtacaagtacaaaaaaaacaaaaacaaaccaaaacaaacaaacaaacaaaaacaaaccttcttccctagcccaggagctgtgggccaagtagctaactccaccttggaggttcactgtctgggggcctagtaggtgtcctggagtagacatactcttcttgctgacctggtaggtttgtgcctgtttagttgttctcttctgttctggggttggcttggagggagttgtgtgaagggctttagaagtatcactcttgtctgcagctctccttctggtaactccttctgtttacagaggctaaaggaagagatagcagaagttgctaatgaaattgaaagcctgggatccacagaggaaaggtgagtttttcttgcggctgggtaggcctcctggggctagctcccagtgcacccatcctagcatcctagcttccccacatgccctggcacattcaagcaagctttctgccttatagtcccagcaggcacacgaacaccttcctgtcctgcctctgagccctcactgcaaggatctggacataggaaactttttttgagacatagtctttctacatatctctggctgtcctggaactcactatatagaacaggctgaccttgagcacagagatccaccagcctctgcctcccgagtgctgggattaaaggtatgcaccaacatgctgaccaataggaaaccttttatgagtacaaaactgagccagaaagttcaaagacaccagaaaaatcttaagtcagtggttctcagcctttgggccatgacctctttgggggtcaaaagactttttcacaagggtcccatatcagatatcctgcatgtcagatatttacaatttataacagtagcaaaatcacagttatgaagaggcaacaatacagttttacggctggggtcacggcaacatgaggaacttcattgaagggccgcagcagtagggaggttgaggcccactggcccaagtgcccagcagtctcggggattattgtattctcctctatgctgtccactctgtatacattttaaaaatttctatcttacttttattcagtggaaaagcttagtgagcactgctaatgtgatttcccaaggctggtgtgcccacctatgtctgccgcagtgtcagccaaggctggtgtgcccacctatgtctgccgcagtgtcaaccaaggctggtgtgcccacctatgtctgccgcagtgtcaaccaaggctggtgtgctcacctatgtctggtgcagtgtcaaccaaggctggtgtgcccacctatgtctggtgcagtgtcagccaaggctggtgtgcccacctacgtctgccgcagtgtcaaccaaggctggtgtgcccacctatgtctggtgcagtgtcaaccaaggctggtgtgcccacctatgtctggtgcagtgtcaaccaaggctggtgtgcccacctatgtctggtgcagtgtcaaccaaggctggtgtgcccacctatgtctggtgcagtgtcaaattcatttgttcctccttatgctcgagggagaagaatgtagaaaccatcccagtgtaaaatgataagacgtcagtgactttggagggaattcctaggtcttttctaactgcctcccttgataaatgatctgcgttcagttccctgtgtctgtgtttgtctaagcctaagcctccctgtctggcttcataaggccctttggtttgttattttaaacttgtgtgagcagtgccattagggatgaaggggctacatcctccacagagagcagccagttagacactgccagcctctggttgtcatttagagttacagctttctcactttctattaatttttttttagactttaaaattttatgtatatgaatgctttgcctacaagtgcgtctgtgcactgaatgaatgtctggagtccatgcaagttcgtctgtgcacttactgtgcccatggacgtcaaaagagcgcaccagatcctttggaactaactctggatggtgtgagccagagggtcaggtgttcctaactgctgagccatccctgcagctccttgccttctgtctaaaagaaacatggaaatcaatagtttgaggtcatctagatttaaaacctctgctcttagaaaagataacaggccaggcatggttgtgcacacctttaattccagcacttacaaggcagaggcaggtgaatctctgtgagtttgaggccagcctggtctacacagagagttccaggacagccagagctacatagctataccgcatctcaaacaacaacaacaataataacaaacccataataaaataaagcaaacaaaaaaggctagggatgtgattcagtccagtaattcccagaatatgtgaggccccagattcagcacccagcagcagccctccctccatgacaagtaggtaactgctgaacgaataggcacaacacagagtaggagaaaatagctgcaatgtgtatctgagaaagaccttgtccagaataggctgcagaacatggagacagctcacatacatggacagaaatgctgagcagacccttcatgcaagaggcggcgttccctgtgagtgtgaacaatgtaaacctagtgtgcatgcagcctcacatacccaggctagaaccaaaggctgctgggacctagtgctgagcatgtgtcagcatgcaagaaaacacttgtcaggtctttaagacattagatatgtgtccagggctggtactcagcacacaggcatttactcaggagaatggaaatatgtccacaaaaacctttaccaagggtatttacagcattctttttttttgtttttgtttttgtttttgttttttcgagacagggtttctctgtgtagctctggctgtcctggaactcactctgtagaccaggcttgccacgaactcagaaatccacctgtctctgccccccaagtgctgggattaaaggcgtgcgccaccaccacccagctatttacagcattcttactaaaatcgactgatctagaacttgcacaactgtccagcaataagtgaatggtaaggaggctggaacagttgaccattattcagtagtgtcagaggagcacactgatccagtgcagtagcatgtgcaggccctacaaacatagaatagagaagaccacatggacatacttctgtcatgaagctctgagacataccatcaggaatagcagtgcctgctgacagggtttcagacagagacctgacccagaacctagcagtgggatgggaacaccagggcctcgtctgagtggtaggtcccagggcatgcatacgtgtcagaactgcgattgcggcacttagggtgcgaacatcacactgagtgaaaattatccctgcattaaaaagcaaatcagtgctcctttcctggctctaagtggattgttgtattttaagaattaattttatttatttatttatggcaggcacacataccacagcacaacatgtggaagtcagaggacaactgtctggagctagttctgtcctaccatgtgggtccaggggattcaatttagatcatcagcttggctacaagttcctttatgcattgagccacctcagtatccaggaatatatgtttattgcagtaaattggtaaaagacagaaaagcatgaaagaaaaaaaccccaggttttccattatctccagagagaaccatgattaatattagagtgtactcttctctgtgtcttctggcgcctgcacacatacttggaactcagggtactgtttgctgagtgtctatgcattatcatggtccagcaaactgaagaggccagcagtatcagcagccaggcactgagaacactcagtggtgaatttaagaaaaacaactttctggataccagggtttagttcttgccatggtgtcctgatctgcccatcatgagctagagaatcgggactggtctggagaagtgctgtctaaatagacaacaggatacctaccatggtgttgactaaacaagcgacaccgtcatctggtgaaacttaaaacatgaagaacccccttagagaaacatcgaagggctgacaggcagctcagcgtggataggagcctgcctggcaagcctgttatcggagttcaatctctggaacctgtgcaaaggtggacatagagaactgactccacaagctgtctttgacctccacacccatgttgtaggtatatacacacaatatcaaggaacaaaaattttccaggtaatagtgacacacacctttaattccagcacttgagaggcagagcaggtggatctcagtgaatttaaggccaacctggtctacagagttgagtttcaggataaccaggactacatagagagacctggccttgaaaaacctacatacatacatacatacatacatacatacatacatacatacatatttgaaaaagagaacatcaaggaaaatagaccaactttcatcagtgtttctggtgcgtctgagcacaaaagccatacatacatcagttattgatggtttttaacccctggagtttaagctggtattccagaattgaagattctgaacggtgagctgttctaacataggtgggtgctcatgtgtgtaatcaaaagcctgatctagcgttctgtaacaaccccaaacattgtggaagaagcaaagacagcatagtgatatgggacttaaagcttcctcaaggtgacccaggtgacacggctggtgtgcaagggagactgccgaagttggaacaggagctgacccaaaaagctctgtatgatgactatcccaacagtcatagacagaaggctagacaggtagagacaggagctgactcatggagacctgagaactttagctagctgagtatgcctggcagttgtaagctacagcactggatgactttgggtaggagctgctttatgagaaatcagtgaagttagccggccacctgtgagcacccagggccttcagaagcagcgacagctgacagagatcttggaagtgtactattgcagtctgggctctgggttctgggcttgccagaggcagaggaagcttcagtaagggactaaaccaaggcaaaagatgctgagagtccttgtcatcatcatgtgccttccattgtagggcctcgcataggaagctgccctgcagctagctttttgtttggttggttttaggggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttttttttgggaatatggaataaaagtaatattcctggatttggggaaaaatgtggttagataacctgagacttataccagtcccaaatctcaagtcagcctggccaaccatggtgggctcatatctgtaatttcggaggtgaaggcaggaggattgttttgagtttcaggccagcctggcctacatagtgagttttagtccagcctgagctacagagtgaacccatgtctcaacctgggaaaaaaaggaaaatataaaaagaataagaaaaggactttgtacctttggggtttggccagtgcagatgaggtcctgaaggcagtattgctcagaaactgtaaagtgacaggcagtgggcgtggtttccaaatgtctgccagactcacaggaggtttaaaaagtgtcacctagactctacccctaaactttgctcagtggcccagaacctgtaattctgtttgattgtgggccagaagagtcctgagcccttcacaggcacactgggtgagcatttgccctagcagggcccaggggcttgtccggagtgggagctggcattcttcatgtgtaactccctccctcagctgcgtgtgaaccacacgatctgtgcctgcgtttgtttggttggatggatgcacacttaagaaagctgctgcttgtttatacggcattttaaaaagctaaagctaaaacgctccatgacctgtctagatacaacattgacccttctgcccaaaagaaaggaaagcctgtgcacataaggtgcgtgtgctggcagcacgagtatgtgatgagccctgcatggaggcagacatagagggacattgctgagcaatttcagcaatagaaagaagtgttgtgctgatagagcttgaagacagtgtgctaagcgaaagcatcctggaacacaagcccagcaagtccatggttctgtgtgtgtgagacgtccagaatctggcagatgtgtgcacagaaggtaggccaagagttccccagagttgaaagaggaatgtgggggaactagaaatgggtgtggggaattttgttgaactgataagagttttctaaaactagttatggtaatggttgcacaatttggtaagcttactaaaagccattcaggtttacattcaaaatgggtagattctacaatatgtagacaacaaagtttaaggaaaaaaaaattctaagagaaaccatgaatctagagagaaggaggcaagtgagcctgaccgaggcttcggctgaccttgcctagcgggccagattgcttccttattcttttagagcaatcttcccacagtgtcggtgctgcacatgaaggctgcgccagcctcccagaacttcctgctgccagagcactaatggccacacttgtctttcaggaaaaacatgcagaggaacaaacaggtagccatgggcagaaagaaatttaacatggatcctaaaaaggtaagcagaaaatgaagtgacagtggccggagtattaagtgggggtggagcagtggggaccaggactctaagttgctgttctctggagtaagtgtcaggtggttaccctcatgctcttgagtctggggctctgatttctaacttaagtccccccatccctatgttcactggtgggggtttactggctcaggctccaggtctgcactcatttttccagcctccacaggccagcatcactgctctttctgacctttgtgcaggggatccagttcttaatcgagaatggcctgctgaagaacacttgtgaggacatcgcccagttcctgtataaaggggaggggctcaacaagacagccatcggcgactaccttggggagaggtgaggcccttagagctgggtcagagccagtggaagaagtaagctccctgctgcctaagtccatggggtgggtgactgtggtaccagggcagccagagccacaatggcgctgagtggagggattaccttacttgtccaggggcgtagaggtgccttgcttgtttagttagcaaacagagccaggccaacagcctcgtgactgtgcatggccaggctgagaggtctgatgggctgggactctggggatgccatctgcttgggctcaggatgggtcttggtcagtgtcagggtccgacgtgtgctcctcactcttgtctgtctcctgtagggatgagttcagcatccaggtcctgcatgcgtttgtggaactgcacgagttcaccgacctgaacctcgtccaggccttgcggtgggtgtcgtcagccgggcaccgtggggcagggtggttgtgactgtcctgaagtagttttcaggaaggccatgtacatgcctgcgtggaatagcattcactaggactgcttcttggtcttgggagtggacagactgatctgtccttaaatactgaaattatttctactcttcacaatagaaaaccctttcatttcttaccctaaactaggtagctgtgtatttcgttaaagaaaagaaaaggaaaggaaaaaatcaactatcatttttccccttggagacagggtttttctttgtagctttggctgtccaggaactctatacaccaggctggccacaaactcaagatatcctcctgcttctgcttcccaagtgcaccaccaccacatggctcaacttcagcttttttgtttgtttattttgttttgtattccagacagggtttctctgtgtatccctggctgtcctggaactcactttgtagaccaggctggcctcgaactcagaaatccgcctgtctcggcctcccaagtgctgggattaaaggcatgtaccaccactggcttcagcttcagcttttaaaccaagcttgttttgtgccctttaaagccattttttttctgccgtggatataaatcctaagatttttttttttttgaactctgattttttaatgatgcagtgttgcagaactaaccttgtggctgtggtcccatatgatttacagggttccatagtgactgccctgaatgaattcttcctttagagttcattttaaatgattaagatctgtatttcacttttgtgtgttgctctaaagtggggctgttcttcttggcttctcagttcatttaaggccacagtggttacatttgcttctgttcagtttctgaagcccccacttccttccccatgtgttattaactgccacactagcagcaaaactggtcaaaacaatgctcctgtcttcaccctcaggcagttcctgtggagcttccggctccctggagaggcccagaagattgaccggatgatggaggcctttgcccagcggtactgtcagtgcaatactggggtgttccagtctacaggtgagggagggagcctctgtgtgagtcggggagggagagctaggacaagaggctgagtccattccaagaacagttacttactggtgtgtacaacctggaaagactgaacgtatccagaagaccagcactacacctggtgtgcttagtggaggagtgcttgcctcatgtgtgtgcagcactgggttcagaattacaaagcatataactattaaagatgtcttaacactgggcagtggtagcctttgatcccagcactcaagaggcagatctctgagtttgtggctagcctggtcttcaggacaagtaccaggacagctagggctacacagagaaactctgtctcaaaagcaaatttatgaatatagctagctaggctacttaagcaagaccttgccttaaaaagaaagaaatattatgttcttatgaagatattggcatgggaaaatgataagattaacaaaaaagcatatatatgtgtgtgtaatgtatatacctatcccctgtgtatgtatctatctcatacatatgctcgggtgatagtgcattatagtgtctgtaaagtgattttataggcacatttatacagaagaaataaagcagaccaaattattactaaatagaattgcagttaattttttctttttgatacattgtattggtctgagattttgttgtatagccctagctggccttttatagaccaggctgtactggaactcacagaaatatgccttttgagtatggaggctaacgtcatgctccactactcccagccgttttattgttttcctgttcttttatatctgaaaaatagaatgagtgtctttagtgaggtcatgtgccttgccccttccaggaacataagcctgggaacatatgtacacttggctcatctgctcttcctgccagtgtctcctgtcctgggtagctgtctcctctgctctcacagcctggtctcctctttctagacacctgctatgtcctgtccttcgcaatcataatgctgaacaccagcctacacaaccccaatgtcaaagacaagcctacggtggagagattcatcgccatgaaccgaggcatcaacgacggaggagacctgccggaggagctgctccgggtgagcagggccagagccacttcatgtcagctggcaaagcatgcactcgaacgggatccggatcataggagaggagacagaaggataacttgctgagtgcctgatcacttaattcatttaaatatgtgaatttcacaaaggccagctgagaatcaggatgggaggtggcttctaaatctgaaactgaaaattaaaggctcaagtaggctccaggctgagaggcctgagtaggctccaggcagctatttcttttttccttaattatccaccaggcatcttatttttgtccctgtgagctgctagaaagcagagaatggccatgttcttttctagtctctgtgccttacagagactacctgtggactgagtagagaggaagggaggaaggacaggcacttctcgaatcagacatgcagtgtggtcttttatccagaatctctatgagagcatcaaaaacgagccctttaaaatccccgaagatgatgggaatgacctcacacacactttcttcaatccagaccgagagggctggctgctcaagctcggtaagtccctcccccagctgggcctgcaacagagcctaggaggaaaggctatgtgcacacagggctggggggtggggaagcgggcaggtcacagcagtccacctccataccattctggagctgttgacaagcagtcaccacagaacagactcctggacacagactctgcccttacaaacattgtccttatgtatctgggcactgtgtgaccagtcccaagtaggcagccatactccctgaggcactttccagggacctggacccttgggtgggtaagcagccatatccatctctctattcccattccagatttaccctggcactcctgcccacccagtgcatcatcacttccctctgcatctggctcccacaggcagtgtgcatggcaaacctagagcccttggctgcagcacaatccacagcactcttcctcatgctctggcccctcgcagtcccaatcaaccaccaaccagtcacagtaatgattgtgtcattcaaagagctgcagtgcgcttctcttccctctgccagaagtgagcctgtattgttaagatttatggtcatgccttgctaggaaggtgacaaagtagccaaatagcaatcagtgggttctcatgcacgcacatgtccacctctgtctgctttattaatcgtcagacatagacaggtcactgagctctctgcacatgaaagtgtggaggctttttgaccactagagagcgtgttccagtacccttctgccttggccttcccgtatcaggagggcagatgttgtaagagacccgctcctcttccatttggttactcgacctgtgataagtagtcctcccactcttggccatgactgacagcatccagtagagctactgacacaccctctgttgctaactcatccagatagcagaggattgacatttcctttaaaaggcccaaaactgtgttgttacatgacagttctctttaagaccgcttcaacgattacagagccttgcagtgtctggacgtggccggtagcagaaggtctgaagcaaaggctctgaaatggttaccccacaggcagccttctgctccacagtattcttccctgaccaataaagaggaatgtgctggaaagtttaaaagtgtccgagtttaggtttacttccccctccagggaagtttgtctccctgcgagtgctaagtgttagctttgacagctgagatactaaaattagagcagagattatcttggttcttgtaccaggatggcatgtaaattcatgagatatcctatatttttaaaactcaagaatttcagctgagtgaaatgatgcacacctgtagtcccagacacacaggggacagagcaggagaatccctggggcccaagaaactgaggtgccagcttttgctggtagagcaagaccccaaagaataaaagtttaacagtgtgggactcattcatcgtgaggtcgtggcttcatgtttctaacctctcgataaggtgtttccatgtgacacactgagactcagccgtgtgtctgtgtgctgtacagggcaggacttcgtgccatctgtagttgtctgtatatgtccctgtatgcacagaaccataagcatgtgtattcttgtgtacacacatatgtacatgtatatccatgggtgtacatgtgtgcatccttgcacacattttgaaaagtgttgagtatcttaagaaagacacttctctcagagtgcatatcattcactttgctctggtttgtcaggagtctggcaaacactggccttagaaaaatggattcatgacactgttagccacgtggggaataccccacgtcttgccacacggcacgggtagtcacttcctgtcggtgtctgcaggctgacctccctctccaggcatacatagatgggactggtacgctgcactttaagattaaaaagtcgggtttgatttctttgttttaattttcttttctccctcatttatatgtttccatgattttggctctccttttccttgccccaaactccaggaggtatgtaaccctgcacctgctcgctctctctgccaggccactgtcattgctgcagcgttttgtttttttttaattttgttatttttggttattttgttttttaattgctggtagtgttaatgctgcttctaacttactgtacagtccctagggaactggccaggatcaggggtttggggcagtgttcacagaagcagtactgcagctgcccggtcagagctctaagaactaaccgcgagtagtcaacaatgctagcccagagccagccaaggaaggcagagggagacgtcagctgtgtgctcatggcaattgctggattcaaattcccatccgtgcatcagcctgatttctggagtgagggagcaaagcagagggtgttatcttgtaacttcccaaagtcacatgcttctgccaccgtggttgacaaagttaggaaaagattgaacagttgacaatattgggccatttgcctttccacgaaaaagacaagtattgtcttctaaactcacaagtggatatttttaaaacctcaaaaccagaaacccctacctatagccctttaattccatttcttgggtatcagggaaggactcacagcctggatcctctgtctgtgtctcctccggtgtaaaccgtcctctgttacaaagagtcatcctcaaaacccaggtcggcctctgcttgccgacgtagcacagccagagtggagcaagcagagcgcaaacaccgcgtgctccttcagtgctgggaccaggcggctggactgctgggacagtgtcggccctctgtgtaagggaggcctgagaagccctgcaggggaggggtcctgtgagttccacagggactgtcctacgcgcacattgatctgtctgcttgtcccatgtctgtttttctttccacgtggaagtgttccccgtgggcccgcagcgatgctttgtggtagagggctctgtggtgcagccaaccgtccaggggacgtaaggaagctttgacagacagaacttccgggcttcgctttttctcctccattcctgccaccttgtttcttttggtatctaactcactctcttcatcatttcctgagttcattgtcacctggggtagtcctgtgacagaatgcatgggaggtcagcatgggtggaccgtccttgtgtatcaaagcctgggtgggaaatggtctccccaagagactagaagacagttacgctcagactcagaagtgagaaaggatctgccctaagacacattgccttcagatttgaacacatttgtgtaactccgcccagccctccctggtatcaacatgcatgtcatgttgttcctatggctttcccattcacgccacttaaccatgaaacttacagaatccctcactaccataaccacacacatgccacagcacatgattgcttgtggcatagtccatctgggaacctcggtctcagtcatgtagaatcatgtagttaacgatggctgcttacatctacttccccacccctctagctcagacacccaggcagagaagtccaggccctaacctgctctgctgggtttcctccttcacagttcagagatgagcctgcaggcagatgctggcattggaaagagtctctgtaaagatgcctggccctgcatggctgtcagcaacagggcagaggagtaggcatggcaggtgtgccactcccctgccttccacagaaactagagaaaaggtgttctccatagttggggcctagaaaaggggaagtgctaaggaacagggacagagtgtgtgtgtgtaactccacgtgtgtatcagcatgggaaggaagagggacagagtatgtgtgtgagtgtacaatgccacatgtgtaccagcatgggaaggaacagggacagagcgtgtgtgcaacgccatgtgtgtatcagcacgggaaggccctggataactctgagtagttcatgtcaagacagtcttcctcgacctgaggtaagtggagaccatggggatcctgagcatgatgcaagtgaggatgtagcttccttcaaagtgggcccagttaagccccaccaccacccttgtccccgtaccaatgcagaacagcatagagggcctcacgctcgctacttcctagcatggaggagtactgagaaaggctctgagcagcagctagtcaccacctccttgatgccagagctgcctctagtcacttagttttaaagagtcatgtgagtccacagaaggaacagctcctgagcccccctcttggacaagccattcctttcctggtgaaggaatcctgctttgattcatacccacaattctgggacatgactttcaggacactaactgagggggctagagtcagtgtggaacttcactataggcaggtgggtgatgggaagccacaggtttggttttaaagggctcacagtgcctcactttctgtatcttttctcctgtcatttccatggaacccctgaggtgcccatgcctcctgcgtcagggtgctgacccctcctttctcctttcttagcctgtctttgtcacaggctgtggctggcttctccagcctcaggtacatctctgtcacaggctgtggctggcttctccagccttgggtacatttgctttgcaccattgtcaccctgggcctcctccccagcccgtgctctcatcttgctgtccaggacatctcacggtgtcacccagacacgcttgctctgctcataccatagactttcactttgtgaaagatgcttctgtcttggctgtgtcttgtcactgatgtaaattttgccatggtctaaatgttctcctgataccctgccccacccgacaccctccctgggaagaaagctttgtgtgtgtagcatgcacctacttaggtgtcttttgtcaggagtgtctcctttttgctctcaggtggcagggtaaagacctggaagaggcgctggttcattctgactgacaactgcctttactactttgaatacaccacggtgagcatctactggggcagaatgggccaatcctccacttccaaaccattctccccaaacacagccagagggggccctagggagacggtcagatctgtcctacttccgtgggggttagggaggaactaaatctcagagtggaacatcccaacaggatgtagaggctgtccaggaggctgtagaccagagccagcacctagttctagacacacaggaggcacaagtcccaaaactgagagagagccatggacaccatgcttgttcagagctggaaacatggaactggagtcagttgccaaaaacctagtgaaggggataattgttgtgatttggtgaactcagattttctgtggtctcagaaatgctgaagggtttgattcagaacacacagtctcagtgtgagagatgcaacagaggaagaggagcaagacgaaacggagggagcggctcatgtgaggaaatcagagggctgggggtgacacttcctaataccatggaagttcactaggataagatcttccggcaggagcctgtcacttgcaggcgccctttgtagctgtaggaataaaaagtacacagtaaaatgcctccaggcttcctatggaagatcactcaaagccacaggttgttggtctcgggccatgcctccacactggtgacatggcaccctggtgttctgacatcttcctgggcacctgcaagcacagtggtggttcttcttgtatgcatgttggactttggtctccaactgggtcaggaaagctaacttggctgaatcttcactgagtaaaagtcattgatcccactgaggagctagagctgaaggaagcctcctccatggtaaaggtggaacaatcaataagatgattgccgtaagtgtgagggcagcctgggctacatagtgaactccaggctagcctcctagagttagaggttaattctgtcattcatgctgatgatgtgctgaggacatgacagcaaactgtttcgaggcccttccttctccccaggaccccacttgtgccacctaagtgctgcagctggtgttgctcctccgcatttaatcttctccaaccctaaggattctctgacacatcaaaatcgtcagaaggtgccccccgtttccttcccagggtactgtggacaaaggctcagtaggtttccctctagacatgccacccaccctcccaaaccctccttatttatagtctaggcagcaagaagagttttcctagcaagggctaagaaacactgacagaataaccctagtgaacctgtggtgggggtgggggtggcgggggtgatgagtacagccagacaggaaggggcatagcagctgggtttgccacctagctctctgcagtgggaaagacattgcagccagttacagaatggctctcctgcagcctgcgcatgaggtcagcctactccgcccttggcctgaaggaagacgcaggctggtatgagtgaagcagagttgtaagaggagttaagtctgctgtgggtggaaagggtgtgaggaagtgagcggtgggaggccaggccggagggtaatccattcactggcatctgtgagccagcaggtagagccagcccccagttctcctcgggcactgtgcaaagtctagaatgtcaaacacctgggccacagagactccaggaagatagtgtagagtcacttaaataatgaccagcgtgacctagaagacagaacaggacttcagctcataagagacaaagctgtgtctttctgaatcactgtagggttgtggggttgttgctcattctttagcaagactgcgtagactttaaggagtgggacacattaacttatgatgccctcactgcctgcacagaagagctaacagatgctggggacaggagacgattttagtgccacagcagttgatacctgcaaagtcaaaagttttgatgtattgagggggttgctccccggatgtagagggtgggggtgggggatgctgacttctttcccttcaatctggaacagaagtgccgagcttagcaagccaagtgtgctgacagaggaccagtgctgaagtgtacagacgggagacctggccaggcatcgggcgctgagctatgcaaccgtaaacaagatgaccaaaatgtgggcttgtgctgaggctgctgccagccacaccaaaaagcaggaccagtgctgacatgcttttaaacaagactcatgagatactcagacagagccggaactcaggcacactggctgtagagctcatgctaaaacaccccaagtatgcaagcagtctggagatacagggtggacagtgagccgtgccaagaccaggaatggactcactccaggactaagtagctgggccctgtggctgtaggacaggctgggagcattaggaacttggaaagtgtcaagaagtccgggacaacagggatcaagcagtaggaagaatactgcatctttcaaactgttaaagctgaaccacgtgatacttttccaaacaaaatgactgaacactagactcttttttagatttatttatttattatatgtgagtacactgtagctgacttcagacactccagaaaagggcatcgggtctcattacaggtagttgtgagccaccatgtggttactggggatttgaactcaggaccttcggaagggtagtcagtgctcttaactgctgagccatctcaccagccctagacattttttaataaggctgctttaaaatgggcttttatggtaagagacatttaccttgaggttccacatttttttcatcttctgcctcacttttctctttttctgtttttctttgtacctttatgtatttatgtatgtatgtatgtatgtatgtatgtatttatttctatttgtttgtttgttttgggacagggtttttctgtagccctggctgtcctgaaacctactctgtaaaccaggttggcctctaactcatagatccatttgcctctgcctcccgagtgctgggattaatggcgtgtgccattatggccagcttcaactttttttcttagtaggacatcttttatgaaaatactacatgaaatagcccatcctcacagagctgaccctgtctgtccacaccacattagcactcttagctcttgccgggtgatcatcatttgtgacctgatttgcagtggttttaaacttttccttgattcctttctgcattattttaagccctttaaaatgagcaggtcatatttttgcaaagatagtggcatttgctttaagaaatcatacaggccagaggcatcagtgctgactatttctgtccttgtggagggtacagatgattaggggcatagatgagtggtgaggtgcaccaggctctgttcctgaacttaggagagaattctttgcttatttaattttttggtgctggggacaggacccagctcctccaactgagctgctctttgagcctctggacgtccacatagagacacagaatgcgaatgtgaggcctgtgcagggaccatttcatacttcggacttgaattcagttgttgggaagcacagttctcgtgcactgcaccttctgtgcaatgtgcatagtgagtgtcttggcttacttcagccactaccagcctgcggaaccccaggggagatcagcagaggcccaggggtctccctgggctggtcacaagggccttcatagctggtcctcactcctgggcagaagatggcgttagccctagctgcatatccagagcacggctcgtgtacctcctgcccctgagtctagagagtgaagaagctatggcttcacgggggtctgcattaggatgacttgactcagcccacttcggcatcagaattcttaagaggtttggcaccgtgtggcttggaaaggagagtggagaggaaagaaaggaatggggaagtaggccaggaattattgaggaagcccagtggctgtcctccctgctgcagcctgggaggaatactgcaagtctctggaccaggggatccccttagcactgttaagggtggggcattacatgtgcatagaaggattaggggaactgtgggtaatgcatcgtcttccctcgtagtggccattgtgagtggccgatgccccagagagggctgcaaggatctcaggcagactcagtggtcagcctgacaggagcctcgtgagaagagagcctgtaacccacagcttactcagcttagtccaccactctgcaaatgacacagttggcaggtccagatggctaagaaggcagctggaggctaaagccactcactcacagttggggaagggctgcttgctagtgctctctgaggctggcccactgcagttgggagccaggaacagggacacggtgagcccaggaacaggcacacagacatgtccttgagaagaaagtgtgccagtcataaagctgtaggaaggctggaaggaaacaagtttctcagaaagaatacaaggccaaaggaaatgatacagaaggctagacgacagccatgagatgctaacaatagcttcagaccatccccaagtggaaaatgtgcttccaggcttaccttgcataacggctgaaaagaggttcttaccaagcccctttccttcctgagtctcagtacctgcaggacaaagagaaaagctccagccagcagaaaacttagtgtagaatagctctgaaaactgcaggggccatgtggccatgtggccatgtggccatgtgtcacagtttgcgaggggaggggggaaatctttccccctacatgtagacctagccaagctctcaaacaggtaagaccttcctgaccatgggggattttaacagggttctctgccttttgtgccctccctcagaatgctgtggagagcaagcctcaggcggtgctgtagtggagagctacaaacttgggggtgatctgtccccaggctttaagaggccccaccccaccccactcaccccctctctccaagtgttcccagccagtctcccagtctctttcctcttctctttctctctctccttcacagtcctctcattttctgcctctattcttttctcaactccccttcccatgcccccaaataaactgtattctatactatacccatcatatggttggtacgcccgctgaggtaccccctcccactgcactatcccatgctctataaaagatatcattggcattataaaacacattaatgctattgtgatagaaaagtaagtactagatgtgacccagagcacccagttagaaggtgggctttgagtgggggaaggagagcgaaggtgaagtaggttacctgctgcagttagctctgagtggcatagcctgaggagcccgatggtgctgaggagagcccagcattccctagctcagttattgagacatgggcaggaggagctgtgtctcctgtaggtgtcctctcacactgcaggcgcagaggagcagctcggatcaggtgtcctgaggccagcactaaaatgcttggcaggaagaggataacttcccacggggtttagggaactatcagaaagacgtatttgtttgtttttcttttatacaattatagaactggatttggttggttggttggttggttggtgggattgcttgttattgtcatattgtgcctgtgtcactctaatcagtatgcttgagaagcaacaggttttgaccaaggttagctggctggtaggggtagaagtctgtccatggtaagggccctggctgatgagatgcacagtcccagagagggccagttgaggtggagggaggggtgagatctgtctgtctggacctgagctccagcaccaatatggatcttggggccgctgtccaaaggacagtgtttccctaaggacacacatctgggtgatgggcagtgggcaggaggcaatgggaagttcagttgcagttcctccatcaggcacgggcaggagtacctgggcctaggctgggaaaggctcccagaagctagtggcacagaaccaggaggaggaaaaggaaaaggaaagcctggcaaagacatggaggagggggaaggccctttcttagggaaaatgggccaaagtgttcctgcttgagactcgtgggtcattcattgtcaggcatactttgatggcacctgctgagccctctggccttgttatctgtaaaaagctttggattttccagccacaccacacactcatgaccctattgttagaacccaagcatggcctgaaccaacctaggagcttcagggaggagtcaggatgggcctagggaggaaaacaggtgtttcctccacagagagtaaagcctttctcttgcacctgtcccaggacaaagagccccgcgggattatccccctggagaacctgagtatccgagaagtggaggactccaaaaagccggtgagtgtcttgctcctgtgcccagagtggggaaacagctgggattatgacctggagaacctgagactcaaagccttcacctttaccacctccaccatctcttctgattgtccttactttgcaagtctgtctgcttcggtgccacatgctgactttgaaccaagatctaggaactgtctcacagctgtgagcacccatagcttggtgccagttttataattccgatgcactatatggcttgaaagcagctcacctgcagccctgcacatgctcctatctgtcaggagcggagccagctggtgtcaggccagcctttcagccagcgggcctggaaacatagttgaagtgttctattctaagctgcttttttccataggaagaaatcgtgtctatgtgcccatgtgtgcatgtggtgaacttcattgtcactcttcattgtcactgtccacctcattttctgagtcagggtctcaggctggggagatgggtgggtggggaaaacatgagacaagagctggcaacacaagaacctgagttcagaccccagagaagctgggtgtgatcatgtgtgtctgtgacttccacaagccacgggcttgctcacctagtgtgcagtaggaaaacagcaaggaggcccatctcaaacaaggtagaagacaagggctgacactggaacttagtcctcttcattccatccccatacagtacactgcattacacacacacatgcacacatacaagacacacacacacacacagtgaatatgtatgtaattttgttttttgagactgcagtcctggctgtcctagaactctctctgtagataaggctggcttcaaactcataaatcttcgtgcctctgcctccttgaatctgggattaaaagcatgtaccaccatgccttgcttctttttttggctttttaaaaaacaaatccttaaaaagagagtccctggaagcttgtaggccgaatagcctgataaacataacagccagatcaagagatctgcctcatataagatggagggtgactttgcttgtcttctgaccaccacacttgtcatggcatgtgtttgcccacatttacatacatgcacacacacacaccaacagtgtatcttactgggaactgggtttttctgctggcctggctggccagccctagagtcccagcaggctcacagcttcctcctcccattgttggcattgcaagtctatgtgtatgccacacctggcttgctattatatatttatttttatttatatgtttgtttgtttagttttggttttcaagtcagggtttctctatgtagccctggctgtcctagaactgagtttgtagaccaggatggccttgaactgagatctacctgactcagcctctcgagtgccaggattaaaggtgtgcatcaccacactcggtctacgcctggctttgtcgattcaggatcaaactcagctcctcggccttctatagcaagcactttactagctgccttatgtccggtggtctcagaaagtgcatgctctgaaagtgctctctgacacatctctctcgagagtaaagacaaagagtcttttgggaaatgaataacattttctttgatcagcagcttcctgaaatcttactgccactttctcgtgttctcctcagaactgctttgagctttatatccctgacaataaagaccaggtgattaaggcctgtaagacagaggcggacgggcgagtggtggaagggaaccacactgtgtaccgcatctcagccccaactccggaagagaaggaagactggatcaaatgcatcaagtaggtggctccctcccaggcaagccgcttacccactcacctcatgaggtcctctccgctgcacttcctgtcctgccagccctgaaaggctgcagggaggttcccagcttgcttcccagcaggcctttggattcctgcctgttggaaaattagtaagccctgtctctagcctaggtacccagacagtcaaagacccagagcggggatgagtgccactcacccccattgtgagaggcatctcttcctgtggcagctcagtgtgacgagcactgggctttattagacctctcatccagtgagaccattctccagtttgagacacagaaactgaggcccacaggttttgagagttatgaaaggttccagagccttgatgcaaggccgtaaagcagagctccagcccctcccatatgctgtgagaacacaggcgcctgagtgaagggagccacttaaagtccaccattaatcacagtcccatgggtgaggtttacctcagggacaggcctgcccagggtggcatgtaactggaaacaggctttgcaaagcccattggtagcttcgtcagccttgttccctaggattcatgtgaagcctgggctgacaggcatctttctcctatccccaggaagacagccattgagcactctggcttctccaccctcttggcaattatttctcccagtaatgtatacctaatcacagtcctggtactgtggccgtcaggtgttttcctcagagagctttccttgttatctgggcttcgatgacctaggaagtgaggagggcgcgccatcaggccacaggctatctcagtgctctcagacatgagagtctgatttagtgtagtattttggtcaagattaggcagaaagtaagtaagttctggatgtggtgacagtgtaccagttgggaagagttgatgcttgactctgtaaagatgctgatcaaaattcctagagaaaggaagcagctgggtggggtgtggactcaggtcaccagtggagtcttgcggtcttgcggcacactgcccttctctcttaattccaaactacaagagctattctgaggactaagttagaatgcctaggctgatggctcaaacacgctgccttcagctaggtatctctcccacgtgacagccattgcacccatcctaatccacagataggggccaggctggctctttgccacgaatcacatacaaggagggggctcagaacagccagtcatctgagcattagctgtgtgtctgggaaagacctgagaccagggaacagagagtacagtgcatgtcccgtgccctgcatgtcagttgttaggagttgattcttgctagtggtctagcgtgagagttggaactgttgtctcagtgtggtagctgtctgtctgtctgacactgactcccagggcttccctggacgataccacattctgcatggccctaggctgcccggtgtagactgctgtttcccatgtgaacacacactgtttctgttagtagaatgcgctttggcaaaggctccttccctcaatgctctttccaaagaattttggctagttttgtacattttgcgtctcatttaagtttttgctgctatagtcagaaaaatggagtgttctttaaagtccttgtggatgctagacctcagcttctgtggaggatgtgcgaatgctggaagaaaccctacatgcccattccagtggggtagcccagagggtggcaagccccataccatagatgaggaactgagatacagcaaggctaagcatggagtggtaggctaggctccggcctgtatggtgacccatggaatgctgtgctcagcatggatattgatgcctctcctgtgctccaggttgagatgagaagtgggaagtatatgtcagggtgtcgcagaggcccagacacaccttcccgtggtagctgctccttctcgggttcccagcggcctgaggaagtctgtcttcacactgggtccacagagctcaggctgcaagcagacactcggaaggccagggatgctcactgtcagccatgagtctgcccgacaggtgtagagagctgtagtttccagttccagaaatgttaacaggagttaatcatggcacggcatattttcatctaggccctatgagtactgctgtacaaggacaagcaccctaccagaaagggctggccacacccaaaagccacgggagaatcacctacccccgaaatgaataacctgactagccttgctcctctgcaaactgagtccttgtggtggtgagactcaggttgctcagcagatctggggcaaagactatgactacagctcagacagcaccccctgcccctcccccacacacagacacacacataaagaaagagtggggaggagaaagagagaaagaagagaagacttgaaagtatgtgctgtggaggctccaggtcacagtggcccaccagaaataaccaaacccaagtcctgcttccctagaagaccaagcggcagctctgtgaccctacccacagccactgtctagtgcaggcaagtgcaccctccctcaccaggctggagaggcagcagggccccagcagcagccgtaggctcccagaagtccctgtgcagtccacggcagcctcttgaacaccatgtgtggaatgacttgtggcatgtgttacagtacagcactcagggctgcggaagacagtcacagctgaggaacacacagtggttctactctcaagtgttaagtcgtgttagtgggaagaaggcagaaaccccagttactttgttacatgtccccatgtgtcacctgaagctgtcctgtagacagagtgagggtgggtgttcctggtgaaagctggcagcacagactcctggggtggcaccggctgacctgccctcatgcctgctctctccttctctgtgctccagggctgccatcagcagagaccctttctacgagatgcttgcagcacggaaaaagaaggtctcctccacaaagagacactgagggggcaccagggcatggccagcccatgaggctgtggccctttctcctgcctcccctgagggcgctgtggagccaagcagaggagagcagagggcttctctgccagttcctgccgttccgctcctagagacttgcttcagcttttgcagttttctaagtgggagaagggtgggcggcgagggataggctggagactgcggctgccctcatggctctggagtcgctctcagagccagcagctgccagcagctggttcacagcctcagctcagcagggctgaggcaccacagggagctcgctctttacctctcagtgttcctggccaagggccttcgcctctgctccgagaatgcctgtaaggatgtactctgtgtactaaggagagagggggaaaggaagagaagccacgcactataaagatttatttttgttttttttaaagcaaaagtgaacgtagcactgtactctgccctcctgtgccctgcttcccctaaaaaggggggccctggggctgcgggcaccccaggggctgcgggcactccaggggccgctgcctcatgactgtgtgggcaagacgggcagaagcaggactgctggcagggcctagcagacacaggaggcctcagggccccagcagggcagcaggcaggcagtatgggcagctcccacccagtgcctgggggacagagtgaaggtggttaatcccttgctggccctcagtgcccaggcccactgctctttaaagtggaaagtctgcattttcctaataaccaaaactgtgaggagctcacccatggtgctgggtggcgactgtttcatagctggtttttctttctcctccccaagagctccactcctcgttctagaggaaggagcaggtcttacctgatccccttggggcttcagccttttctgcctcaaaagccgcccctattctggactattctggtgcactctgtggtagcctccaggagcaggggcctttctcagcaggttgcagtgcagtcaggcaagggtaaggtggcctttttgtcccctgccctctatggcatggcataccacagcacacatgtgagtgaaccctggcctcctaactcagtgagaagggagccatgaaacgcagcatctcctgccgttctctcagggactctcaagggcagctcctgttccttggccagggctagcatgccagtctaggcagagcaggtggcaggcggtgtcttggcacactcctccacgtggccaaggccttggtggcagaatgctgcctccaggcaggtggaggagccatgggtccccgctgggctgtgtgagctcagcctctctgatctcagaaggaggtcaacatctctggaaatagctttgcagagaagggtgggtgtagggggcggcactcgcccctcctggggatacagcaggatccggcctcaagaggcttcaggtgcttgacactcgagtgtgaaggtgacagtgactgctaagggtccaggctggaaacctgagcctcctgccgcagaaccagtcaatgcctgcccaggttgtgtggggagtcaggcaagtgcagagccctcccttcacaccggttctcacaggtgtgtcctgggcaggccagcacctggctcagtgtcagtctatttatcagaggtgtaaataatccacacatagtttttctccttttagattattttgtatttgtttaaaaaatatttgtcaaaatacaaagaaatgactgaaacttgttgacagggtttttaaaaatattattattattattattgttttgtttttgccttgtaaactagctccaaggaactgcagcaaataaactccaaatctgcccacatcacttcatgttctgctctgctgtggggtcatctcttgtcaagcctgggactgggggctggagcatcccgtggcatgggtgtgccccaaactcagtggggctgtgattaaaaccaggggttgggtaggggctattttctgccacggatggcataacaaggaaagaggggcttaacccttacctctctttctgaggaagaaactcagcctcaaggagcaaaaattgtccacgcgagcagcctcctgcagtgtggcactacatatccttgtgaggcaactgagcaggaccaggaaacggaaggttgctgggcacacagttaatggagcagaagttggcctctgtgcttttcttgcttccttcttttttcattgactgatttttggagacagtatctcacgtctctcaagctggccttaagctccttgtgcagctgaagatggccctgaacatttggtctgcctctgcctccctcgagtgctgggattacaggtatgtaccatgcccagtttatgcagtgtgctagggcttgcccccaaggtttcctgcatgcgagataagcactctaccagctgagcttcacccaggcctgagaatcagctgttcttagtacatcattgatgaacaacatagaacaggaggtcaaggagacaacttaggggctggggggtgggtggttcagtggttacaatcactgggtactctgaaagtttcaaaggacccggtttaggttgccaatatccacatggtggcttacaaccaccagtaaccccagttccagatgtcccaacagcttcttctggcctttagggtcactgtacagacacgtgcacaggcacacatgtagactaaataacacacacacacacaaataaaactttaaaaaaagaaaacaattctatttattgccagaaagaatagagtacttacgtgttttcaaagtgcaagagatacatatacttataaaacattgaaaagcaccatagaagacctaaacaaaaatctcatgtttggagagcaaaatttaatagtgagatgatccagcgaggagtagtggtgtatacctttaatcccagtgctagggaggcagaggcaggctgatgtctctgagttccaggacagccagggctacacagggagaccttgtcaaggaaggaggaaggatgtccacaacttgaacttaggaagtttgctccctaccacatggcagttaatgtttagaagtatgagatgctgctgtgaattcagctcttatccctctaagactcaggctgaaacagggtcacctgctgctggttgtagaggcaggctcagtgaacagtgtttaatgtcccaacgttgggtgagaagtaggctttgccctgcctgccttttctctagtgtttcctaacctggctctgaggtttgcttataaagcattcctggggagctcatggaggtactggggcttggaaggctattttgaaaggttctagagtctttgagaggtgagtccttgaggaagtaggccacagaggacctagttcctgagactgtcttgtcctctctctgcctcctgtgtgccatgaggtgagcggcctcctccacatggtcctgctgccgtgatgctccgcctcaccgtatcaggatcatcagatccaggaaccgcggatgaaacctctgaggctctgagccaatgagcagcactgaggctctgagccagtgagcagcatccctttaggtcccaggcattcagctcacatccggggagagctcacagagacagaccactgagctgtgacttccatcagagctgacagcgtgaagatcaaaggtggtgtgcactcagcgtcagaacccgtgtcctgccagacaggatgcaggcatgggcaggatcagccccagcagagacactgttcttgtctcctttaatccaggcctctgcatcttgttccttgacatttcacgacatttacttacctccccgtggcttaaatttttgtgcatatttgatcaaaccgaatccgccgatgtgttccacttggctcttgctgtttacatggctgtatctcgttcataagcatgaagtcaggatgacatacagaacccctgagccctgggttcttgccttctgctgctcacatttaaccctctctgctccgttaggtggactcaagccctgttctgagccttggtccttggcctgagccgagtcacagcatcttgtgctgcagttggtcaaacatgctctgtcccagagctcttaccttcttagagtggttgcattagggttgctcttgccactcctaacccacttcttcattcactcatgcattcattcaacaaacactgcctggggcctactatgtccatgaactgaatctgaaagcttgtttactgctgttccacctgaggctcccctgtagcagaaatagagcaacctcaggatagcactgccactgggctgggggcagggcggggaccacaagactgtagagtttagggcagctgtgacaggcaagtatgctcccctcttcctgagtatttattacattgagcactggtgcctgtcagagagcatcctggaggagtagattatggacagagagcaaatagctacgtttctttttcgtgttacccataggctgcgatgcacagtgtcctaagcagaaacaatgctttgggaagctaggtggcacaggctatctcactaccccctgtgctgtgctggtcacaggaagtgacctcatcactgctggccaggatagtgccctgtctccggaccccttcctaggccccagccggctgaccttgggctgtgtactcccccacccccaaaccccgcatggcttgtttgtcagttctgagcctctctccacagcactgtgaatgtgaccctgaacacgacagctgtactcagcaatgcaagctctctgggcccagtggaaggtaaatgcgaaaagtctgctcttctctgaaactaggcagagtgagaggatgcccagggagggccaggcttgggcccagctcaggtcccacctgtggttctggtcttcttgttagagaaggaatcccagtcctggagaaacaaagttgatcttcccagtatccgatgcttagcaacccagggccaagtgccatccctcttagcctgagtctaaggctgagacctgtctcaggctggagcaggagtgggtattgggagtacaggagcagaggctcactggccccgtctccatgccaagttgcctcatcacatcagaatgtggcacagacctctcaagtatgtgtgtgggaacttggcaggactaacaggacaagtcacagatatgtcattgcttattctatagttctgtgcatccatgtgtgtgtgtgtgtgtgtgtgtctgtctgtctgtctgtctgtctgctcataccaaagctcagcttgtttggctttgttttgtttttgtgtgtttggttctgattttagttttggttttgtcctttaagacagtcttactgtgtcgcccttccatgtaaaccaggctgacctcagacctgagcagaacagtccttctgcctcctaactcccaaatgccgggacaataagcctgtgccactatactcagcctccggtcccgtctataggctttttgctaattaagaatctcactttaaggagtcagaagagaatcatctctgagttatcaaaccagaaggaagcccattgctagagagcctgaggctgggatatacctgtggcctagctggtcaggggtagtaagttaaaggacggaggcaacagccttaataactagacacagtcacaccccggcggagtaagaacacagtgccaccagggtttcccatccaggtgagtaagaacacgggtgatagagatggaggtaagggtgttgacagactgctagcccaaagctgtaagcagacagccttgtggggagagggcaagagggagaaggatggtgtgggctgccaggtggatgccccatgggagggtatcagagggaagagacggcaggaagtactaaggtgaagacccgcagagacctgcagcacatagctctttccaaggtcatatcacccatgtatgtacaagaagggcctgaccaagggcaaggccaacctctccaggaatgggttcatttcaccaagggccaaagcagcccagcgtggacaggattagcatgactagccaaatccctgggacttctaataacataataacacctgggcatggcttagctgtggtcataccaaannnnnnnnnnnnnnnnnnnnacctcagcggagtctcagacacacatgcccccatggactctgtcagaggacaggagtgtaagcacgcagcattctgccgtcagtgagcagctggggccgagcctgggctccattcaggtgagcacctggggccagggtgctgcaggggtgcccaagtcattcatttacttttatttgtaggtttttgtttgtggcaggctctcactctttagcccagaaactgttgcctgggattcactgtagcccaggttagcctcagacacacggctgtcttccttctccaaccctgtaagtgctgaaattatagcttgcgctcccatgtccgacctgagtggtccatattgtagtgccacagtgggaatgtcgaatggatgcttaggagaagtcccactgagacacctgcctgtgcattttaatgagtgaactgtgggaaattagaagccaggtatttcccaagcagtcagaagataacctgatgtcagatcctgacagagtgacctctgaagagctgctgagagatggtaggcaaaggatccgaggtttccccaatcccaggaagccgctggccagggcagttagaagctgcatctcagacactgagcgttgggctgtaaaggagtcggtgttttaggttcctgccattggctccttgtggaaccattgactcaataaattctgcatgcttataagtcggtacaggtccacagaggacagtgagtgcttttcctctgttagatgaggcacactgcataattatctaagcaaggaaaattgtgaaaaaattggtctggctgaccaagtccaggaaggaagtatctttccaataaaggaggggtttttttaaaaattatgtttatgttatacgtctgagtgttttgcatgtgtagatgtgtataccacgtgtgcctggtgtccatggagaccagaagagggtgttagatcctctgatgctggagctacagacagttgtgagctgctacatgggtgctggcaattgaataactccgcaagagcagcccgtgctctgaactgctgggccatctctccagccccaggactttgtttgaaaaaaaagttatgtatgatgcacatgtgaatattaccatgcagataaaattgacctaagattagagacctagaatgttctcagacctccacaaaccctttctctctttcttaaaaattattttttgttatcttatgtatatggttctgtgtctaggtaccaaatatatgcctggtgtccatggagaccagaagatagtatcagatcccttagaagtggagttacagatgattgtgagccatcatatgggtgctgggggttgaccctggatcctctggaagagagccagtgctcagaaccactgagccatctctccagcctcacacaaattctttcttgacttaggatgagaggaggttgtttgagagcttgcaattggagcccagacaaggcacaggcatcctttctcctccaaccacaagagaataattggtacaggcttgactttcaggaggtggggtagcgggctgagataaatggtaccaggtgctagacaatgtaacagctgtggttccgagagtaggcaagccctgaggtgataggcacggaggcatttttgtgaagcctgagagaggggtgttcttgacaggatggagtgggagcatccggtgtcttgttctatcacagtgactgatgttttcaatctggatcatagagaaaaggtctggaagcctggaagcatccttgctgtaggtttttgtttgaggtctgagctatgagctatgcagggactagcaggggtatccgagtcctgggaagcaagtgtgctgttagaagtctagctattccagaggaggcaggctgctcagctgtccaccatctatctgtccaggcccagtggagaggtgcatcaggtgtggccccagaaatatgcatcagaacttttccccaagaccattttcaagcccaaaatagagctcctaaataaagaattgaggaaacccaatgagatcacacctcaactcttaacaggaaaacagcctagcctagagcctctcatgatgtccacactgcttgccacattaaaactagtgagacatgtacagagctaggaaggaccacacaactgaagggcaagcaaaacagcaaacaaaaacagaccccatggtaagctaatgatgaaatcttatcacttagtgcccaataaagtcaccaaggcaattcagtggggacagcaatgccttctcaacaagcagcctgggaaccaactgcaggaatccaaaatattccaagatggagcatggcagtctccaacataaaactgagactctcctaaatgaaaacataaaagcatatacttatgaccacacagtcagcaatggcttcttcaaggtggagtttagaagatcctggaccacttttggacattagtgagtgctgtggtggggttttggccagcccccttcatgggttctggaacctggtgcttcctgtaaagaggacagccacagcaccttcccagggagacacacatatttaatcctgcttctactacctactgtgggcattaacttcaagtggtgctggagatatgtgcaagagagcctggttccagacaagacagtttcttgcaagccagtacaacacagacatgagtaagaaaagctgccgtctgccacttcctcgggacaagttagaactccttacatgagactaaataatggatgctgagacccattcaaaacaaaactcattccatgagaaatactgagcaaagaaccttgagacctgtttttacaagcctggaagtggaggacaattaaggggaccctaggtctctccaactagtgcagtaaaataggcctgttgaaataacttgccttgtgttacaagaatcgtttgagaaacacaatgtatatttatgaaacccagggggatttagaactagactaaatggtgagctcagtgctcccgctcacgaggaatgaggaggctgagacctcggaggtgaaggtccctgtaccaggtcccctggcagcctgatccagccttaggaagcatagactctgctgggaaagctttccctagagttctgtgctgagctgagagacgcctgctgaggtcagtgtttttgttttgctggctgaattatgcagacgtaagtgagattgtttgtggttacatgccttactttagcaacaaattattctaaaactaatgacgcatgtggcttcccgctacagtagttttgctttccttcctccatctcaaattagtgagaggtgtcttttcccttgagagcacaggggtccctctgggatgctgtggcccttgtttaacccctcctgctggggttctcagaaaccatcttctcttagtttgctacaattggctacattagaaacaaggatgtatagcagggcaacagtgtgctactcatgttggtgttccagggcttcagggccctgccaacctgccaacactggttctttctcctctttgtcagtctgtctgtctgtctgtctcatgccaagctcttctctcaccctcatgttcctggtcccatcactgtaaccttgactttgcttttgaccctaaagcccatcctcactgtagcatgatacagcttgtagtttccacagtgggctcatcacccaccaccccccatctacagagtgcctgctaccacatcagcatactggcaatactataagaatgtggtgttgatttaatcccaggtgtggaatgtgggctgctcaaactgtccacagcagctgattgtgatttgcctcatgctctagtagaggcatggttttgccaactgcagatagtttctgagattgtgtgccctttggaattctgggaactttttggagggtatataaatgctagag

SEQ ID NO: 338 - DNA, 1180 bp, Mus musculus
gcagtccccagtgacctgactgcagaagagcgtcaagaactggagaacatccggcggaggaagcaggagctgctggctgacatccagaggctaaaggaagagatagcagaagttgctaatgaaattgaaagcctgggatccacagaggaaaggaaaaacatgcagaggaacaaacaggtagccatgggcagaaagaaatttaacatggatcctaaaaaggggatccagttcttaatcgagaatggcctgctgaagaacacttgtgaggacatcgcccagttcctgtataaaggggaggggctcaacaagacagccatcggcgactaccttggggagagggatgagttcagcatccaggtcctgcatgcgtttgtggaactgcacgagttcaccgacctgaacctcgtccaggccttgcggcagttcctgtggagcttccggctccctggagaggcccagaagattgaccggatgatggaggcctttgcccagcggtactgtcagtgcaatactggggtgttccagtctacagacacctgctatgtcctgtccttcgcaatcataatgctgaacaccagcctacacaaccccaatgtcaaagacaagcctacggtggagagattcatcgccatgaaccgaggcatcaacgacggaggagacctgccggaggagctgctccggaatctctatgagagcatcaaaaacgagccctttaaaatccccgaagatgatgggaatgacctcacacacactttcttcaatccagaccgagagggctggctgctcaagctcggtaagtggcagggtaaagacctggaagaggcgctggttcattctgactgacaactgcctttactactttgaatacaccacggacaaagagccccgcgggattatccccctggagaacctgagtatccgagaagtggaggactccaaaaagccgaactgctttgagctttatatccctgacaataaagaccaggtgattaaggcctgtaagacagaggcggacgggcgagtggtggaagggaaccacactgtgtaccgcatctcagccccaactccggaagagaaggaagactggatcaaatgcatcaaggctgccatcagcagagaccctttctacgagatgcttgcagcacggaaaaagaaggtctcctccacaaagagacactga

SEQ ID NO: 339 - protein, 280 aa, Mus musculus
AVPSDLTAEERQELENIRRRKQELLADIQRLKEEIAEVANEIESLGSTEERKNMQRNKQVAMGRKKFNMDPKKGIQFLIENGLLKNTCEDIAQFLYKGEGLNKTAIGDYLGERDEFSIQVLHAFVELHEFTDLNLVQALRQFLWSFRLPGEAQKIDRMMEAFAQRYCQCNTGVFQSTDTCYVLSFAIIMLNTSLHNPNVKDKPTVERFIAMNRGINDGGDLPEELLRNLYESIKNEPFKIPEDDGNDLTHTFFNPDREGWLLKLGKWQGKDLEEALVHSD

SEQ ID NO: 340 - DNA, 128668 bp, Homo sapiens
  misc_feature (1)...(128668): n = A,T,C or G
attaattaccctgtctgctcccgtgtctcactcttcccttaggaacatgttcaggcatctcccatcctaaaaagcctgtgtgtccttgtgtcccctctcagctgccctctcctttggttgacattcattttgctctgtgttgactctctgtggttcttagtctagcttctgccatcatcacttctcagtgacctaattcccactcttgccaccgacttcttcccaggatttgacactgttgacctccgcaccctggagagctcctctaagatgtgagcctgttgcatttgctgcatactctagatcaagcccagaatcaactgatccagtcaatacatcccactgaacagccgaccgatccaccctctgtcaggatctctactgtagacactgaaagaggtgccccctcagtataggatcctggcctcaaataatcttctcgccttggcctcccaaagcattgggattacaggtgtgagccactgtgcctggcctccaggacaatcttttaaggcaagaaaccagaatctaatcattccccaacataaggtttctcactcctgttcagagaaaatagtctcctctattttgtgatccagatcccccctgcctcttcagccttccacagccccctagaggcctctgggcagctgtccagcccgttgttctgggatctcagaaagcactccaggcattgaggaaattgccctgtgagaggggcctgagattaaaaatgtgcttgttcttagcagaatctgtaccaaactgttgcttcaagttgctttctcaaggggaaactgctgtatatttttgctgctttaaagggattaaagtagggtcaggctggagtcaggtttgaatcatgacttcctataaaaagaaggccagggccgggcacggtggctcatgcctgtaatcccagcactttgggaggcctaggcggggcggatcacctgaggtcaggacacaacatggagaaaccccgtctctactaaaaatacaaaatcagccgggcatggtggtgcatgcctgtaatcccagctacttgggagggtgaggcaggagaatcgcttgaacccgggaggtggaggttgcggtgagccgagatcgcaccattgcattccagcctgggcaacaacagcgaaactccagctaaaaaaaaaaaaaaaaaaaaaaagaaggccagattgggaatcaagacctgtgttctaaggggtctgccatgagttagcatcatgaatttgcttttctcctctaaaatgcaaaggttagattcaaattatcatgattgtcagctgtcactctcacgatacatgtcttgcatgcgtgttttcattggttttctcccttactgcttcatttaggagggtgttgattagaggaagcaacaggacatggctgccaaatatccattagacattgagtgagaaacaggtcacaagattgccactcccttaagcaggatctaggtatttaggtagcttcttaccatcatgagaccagatttcaacacacagtctaagtacatggcaaatacttgctgcgaaatgtgtgtaggaaattcaagttcttttacataaaccagtgatttttttaaggccattttaaaatgaatgtgttggccgggcgcagtggctcatgcttgtaattccagcacttcaggaggctgagatgagaggattgcttgagcccaagatgtcgagaccagccaaaaaaggccaggcatggtggcttgtacctgtagtcccagctctttgggaggccacggcagacagatcacaaggtcaggagttcaaaaccagcctggctaacatagtgaaaccctgtctctactaaaaataaaaaaaaattagccgggcctcgtggcacacgcctgtagtcccagctactcgggaggctgaggcaggagaatcacttgaacccaggaggtggaggttgcagtgagctgagaccgcgccattgtgctccagcctgggtgacagagtgagactctgtctttaaaaaaaaagaaaaagaaaaagaaaccatatctccactaaaaatacaaaaattagccaggcgtggtggtgggtgcctgtaatcccagctattcagggaggctgaggcagaggagtcacttgaacctggaaagccgaggttgcagtgagctgagatcgcgctattgcactccagcctggatgacagagcgagacttcgtctcaaaaaaaaaaaaaaggtattattctgccatttttctgtcttatgtggctacagttctcttggcaaggcctagcacttaccagccacccggtaaatatttgttgaatgagtgaactggagcagctgctgaaggcagcatactttgtgactgcattcggaccctgctcagaaaacagccagcccaccgtccatcaaagtcagtggctccgcagtccacactgcactaattccccttcacattgccttccctgagccctacccgcaccccctttgtttttctgcgtaagtgaaaacattttggtgaagtctagcaggaactagagcactagctcctctatttgaagtgaacgcccaaaccgtggcacgtggccagctgtcttttgggtggcacagggaacagttggtgacagctggatacaatcaagttccattacaaacagattttaagtgtcatttacacacagaagaaattgcaagctttagcaaaataaaatctgggggttttcaaagcaagacaatgccccaatccaagcctgtgtgagcagttcgctttgcagcctcttgcggggattaacaccccttcttcaccaggctccaccctctctgcaaggtctatgctgcaaaattagcaagtccaggaggcttgctccctggcagagctgctgagtcctctgtcttctatttattcactttttgaagaaccctgaattaaaggcctgtctaaccactgttcagcctactccttctgggtgggaggggtcagaggctggcttctagaaaagctgctacctctagatcatacctttcgcttggtctcagggcgtacaaatcactcacacagtgattgggcaagtgaaggctggcatgcccagctaaacctcatctcctttttttttttttttttttttttgggaccaagtttctctcttgttgcccaggctggggtgcaatggcgcaatctcgactcactgcaacctctgcctcccaggttcaagtgattcttctgcctcagcctcccaagttgctgggactacaggtgcatgccatcacgcccggctaattttcatattttaatagagacggagtttcaccatataggccaggctggtctcgaactcctgacctcgtgatctgcctgcctcagcctcccaaagtgctgggattacaggcgtgagtcaccgcacctggcctcatctctctttcgtgaagccagcattgtccccagacatctcagtcctcagtgtccctcccgtccccacctctggcaagaggcagcattctggccttggtggaggggaatgacatcaggcagtggctgacaattctccccttggtggaggggaggccgtagatgatgtcctggtgtctggtgttctgatggcctcagcaatacctaccccatggacccgagtccctccacatctcgtccttggcccttccttccttcatgccttctagcagatgcgggtgggctgtctgttgttcctgtagcacacagggtcagggtgggcatcagtcctgcctttcttctgagaccctccagcttgcaccttctggaagctgggcacccccactgccccaccaaccagctgggagaacataaaggtaacgaaatagaattacttgttttagaaaaaggaaccagggccgggtgcggtggctcacgcctgtaatcccagcactttgggaggccgaggcaggcagatcacgaggtcaagagattgagaccatcctggccaacatggtgaaaccctgtctctactaaaaatacaaaaatcagctgggcgtggtggcgcatacctgtagtcccagctacttgggaggctgaggcaggagaattgcttgaacctgggaggcggaggttgcagtgagccgagattgcaccactgcactccagcctggcgacagagtgaggctctgtctcaaaaaaaaaaataaataaataaaataacctatgcatatgcaattttaaacacaacttgcagagcttcatgtactcgcttcctgaggctgccataacaaaggactacaaactgggtggcttaagacaatgggaatgttctctcacagtgccagagagagaccagagtctggaatcaaggtgtcctcagggctgtgggggagaatccagcctctcccaggaattccttggcttgtggccacatcactccactgtgcttccatcttcacgtagccatctttccgttctgtgtccaaatctccctctttttgtaaggacacaagtcctgtttgattaggtcccaccctaatgatctcatgttaacttgattacatctgcaaagaccccacttccaaataaggtcaccattcacaggtactggggcttaggacttcaacatatcttttgttgggacatgactcaacccataacagtatggaaaggttctcttctcagagttaaatgtggctcccaatctctacctcacagatgatcaagcggtgctgattcacgagagtggaagcctccagagcttggggctttctggctgctcttcattgacctgtgtgttcccagcacacgaacagtgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttttgaagcctgtgggtgcttccttgtatgaaagtatcctaatatagttaacctgtttgctattgataaactttgaggtggttcctgaagacattttaaaaccatggtatagggccgggcatggtgactcacgcctgtaatcccagcactttgggaggctgaggtgggtagatcacctgaggtcaggagttcaagaccagcctgggcaacatggtgaaaccccgtctctactaaaaatacaaaaattagcagggcgtggtagcgcgtgcgtgtaatcccagctactcgggaggccgagacatgagaatcgcttgaacctgggaggcagaggttgcagtgagcctgagatcatgcaccactgcactccagcctgagcaacagagcgagactccgtctcaaaaaataaataaataaataaaataaaaccatggtataagcataggaaaaacatattttgggttacctctgcttaaaacctttctaattctttttattaggcaaagcagggaagctgaagggggaatgtttcgggaaaaactctcaaactatggtctgctctcacctcacaacaatcttcacagaagactgctctgcccagaggcgtgggggtttatccccacacaccaagcagcagacactacctgggggtcctctcatccagtccaacttggactcttatctggagtgaggtcagatctcacaggctgagggctcagtccccaagactgcatttgtgacagcagtcacaagcctgggcctctggaagttctgagcgaccaccttaaacttgggatttctatgacccccgctctttgggtttgattaatttgttggagccactcacagaacttagggaaacacttacatttagtattttgtttgtttttaatttttttgagacgaagtctcgctcttgtcccccagtgtgatggcgcgatctcagctcactgcaacctccacctcccgggttcaagcgattctcctgcctcagccccccgagtagctgggattacaggcacccgccaccaagcccggctaattttggtatttttagtagagacggggtttcactatgttggccaggctggtctcgaactcctgacctcaggtgatacaacagcctcccaaagtgctgggattataggcatgagccaccacgcctggccatttagtggtttattataaaggatattgcaaaggataaagatgaagagatggggaagggcccttgcacagagcttccaagccctccctaggcatcaccctccaggaacctccacatgttcagctatcctagcccagtctttttttttttttttttttaatggaaatttttatggaagcttccttccatagggcacagggcaggaccctctctggggagggtcttaagacccacaatcagaaaggtgggcaagattaaagtcctgccttggggcaggtgaaagaacaagagaaggccagagagattgtttcctgaggcctaaaccaacattataacaaaagactgtaacaagagctaagggaggtatgtgccaggaacagtggaaaataccagagggtggccaggagcaggctcatgcctgtaatcctagcactttgggagactaaggtgggtggatcacttgagcccaggatttcacaaccagcctggacaacatggaaagaccctgtctctaaaataaataaataaataaaatattagctgggtgtggtggcgtgcaactgtagtcccagctacttgggaggctgaagtgggaagatcgatggagtctgggaggtggagtctgcagtgagccatgagccactgcactccagcctggccaacagagtgagaccctgtctcaaaaacaaaaccaaaccaaaaactgtcaaataccgcagggagctaccaacttaaaaaaattagttgtcaagtggatcaaccactaaggacttagaaaccacagcgaaacttgcagagagcccacacccagtttaaaggttctgtgaagaattagtggatgtgggggaagaggtctgggttagaatccacagctggagtggagtcctgtggttcctgtctccctgccgccggctccttctcattacgctccaagggctgggggcacaaatacaagatacgagagtgaaactgacttaactcctgcttgcaagtaggctgcatttggatgtctattagcctcggcttccaaatgtcatgcaaagataacagctaaaggacctctctggctgggcgcagtggctcacgcctgtaatcccagtgctttgagaggcagaggtgggcggatcacctgaggtcaggatgtcaagaccagcctggccaacatggcgaaaccctgtctctactaaaaacacaaaaattagctgggcttggtggcacatggtggtaatcccagctacgtggaggctgcagtgagccgagatgtgcaactgcactccagcctggatgacacagtaagaccctatctcaaaaaaaaaaaaaaaaatctctgatcatgaatgtgatctaatggagtagcttctgtgtttctttgacagtcatccatggtcagggatagccctacccagtggacacatgcatgcattcatttgcaaccagaacaaacactgtctctgtattatgtgtgatagactacaattttttaaaaattctattttcttttcatctaataagtatttgtttcataaccattaagagtcatgacccgctgtttgaaaaacactgttcttttttttttttttggaaacagggtctcactctgtcccccaggctggagcacagtggtgcaatcatagcttactgaagcctcaacttcccaggcccagaggatccctcccacttcagcttccagagtggctaggactacaggcgtgtgccgctatgctcgacaatttttaattttttgtagagacagggtctctctatgttactcgcgctggtcttgaactcctgccctgaagcagttttcctagcttggcctcccaaagtactggggttataggcatgaaccacttcacccagctgaaaaacaccagtctaatggaacaatataagggaacagaatttgtaaacagtcatgttctctgctaatctgtgattagcagtaataccagtatccctccctctccaaatctattcagttggtgagttcagctaagaggtctagagtgctgatagtaagaattaacatgccatctgaatcgcttttcttctggagttctggtctttgagcaagagctgaggtggtctgggacttgcatactgataagggaagaaagccagctcgaagataccttgaaccttctggtgagtctggggttagaagtgaagtagggagtgaaacagaggatggcaaatactgggggagaggctcagtgctccattagcccatgtgacagatggtttgagaagatttgccaggtcaatgtggggtcaattctaaaagtgtcctaagtctaggccaagaggaacaaaatgcagctgggtctctgacctcacacgccgaagcccaaggacacgttagggccaaaatgtgactctctaaggtcacctgtaaaactggacaatctggtaaagtcagtgaaggttaagatcatgaatccagccaggcgtggtggctcacgcctgtaattccagtactttgggaggccaaggaaggagaccaaagagaaaggatcacttgagcctaggagttcgagaccagcctgggcaacctagcaacctccgtctctacaaaaaatacaaaaattaaccaggtatggtggccggtgcctgcagtctcagctactcaggaggctgaggtgggagaactgcttgagcctgggaagcagaggttgcagggagtcatgatggtgccaccgtactctagcctgagcaacacagcgagtgagactctgtctcaaaatgaataaataaataaaagaaaaagaaaaatagtaaaactcaggacaggtgggcccacaaggaaagagttctgtggcttttactcccgttttttggttggtccaaaaaattcccagcagtccagggatctctgtggagttctcagtgagtgttctgtgtagggtgcaggagccacaagtgactgcagggggaaaggggggttctggtgctggcattctgcagcagtgggattgtcctctgtcataaagaaagagaaggccgagcgcggtggctcatacctgtaatcccagcactttgggaggccgaggcaggcggattatttgaggtcaggagttcgagaccagcctggccaacatggcgaaaccccgtctctactaaaaatacaattagtcgggcctggtggcacatgcctgtaatcacagctactcaggaggctgaggcaggacaatcgcttgaacccgggaggcggaggtttcagtgagccgagatcgggccactgcactccagcctgggcaacaagagcgaaactcgtctccaataaataaataaaatccaaaacgctgggacttgaagtgccctcctttcaatcttgacccaggtaaaactcaggacaaataaaaagaagtagaagcagtaaacttaggacatacagcatgtaaaggttctgaacgcaggagtaaatgacttcaaatagcttttgtggcctttcgccaaggaccgggccctccctggcaagctggggccgggtctgaccttccaggttggcgtcagcaaggaccaccctgcccttcagtggccggacacgaccttgggctttcgtgcagtagcctggctgcaggccaggtcgagtccgccaccccggggacttgcaccgcccttcagaaaccgaaacctgctcggccccaggaggcggaccgggagaaggggggggggtgtgtgtgtctcgggacgggggcgtggtctagaggcgggggcaggggaggagcctcgggtggacgcgcgtgcgcaggccggagcctcgggaggaggccgggtacccggggtgcggcgcgcgcgggaggaaggcggggcctcgggcgaggggcggggcctcgggccgggggcagggggcgggcgcaggcgcaggcgcgggcgggcggggcgcggggcgcggggcgccgggggcggggctccgagccgggctgaggcgagcgggggcgcgggtggcgcggcgggacgcgagcggcgagccggagcgcggagcccggctcccgcaccatggaggaggacgacagctacggtcagtgcgccccggcggcggacgcttccccctcgctgtcccccagtcccctccgggcccggccgtccggcagcgcttgcggcggctggcgtttcccggggacactggtgcgggacgcggagcccggggcgaccggcgggcgagcggtgcgcggggccctcgcggggcgggggtcgcagggggttttgagggatgagggtcgccggggccggggtcgctggcggcgctgagggatgtgggtggctggggcgggggtcacaggccgggctcgcggtctcgcggggccaggggtcgccgcgagctctgaggaatgagggtcgttggggtcgcggggcaggatctcaggggctctgagggatgagagtcgttggggtcgctggggtccccggggcaggggtcgcagtccgggtcccggggggccgaggggtggaggtcgctggccctgccgcccctctgcggggctcggggcggacgcgcggatggccgggcccgcgttccccgcagtttccggccgctctcggcgtcagcgagttgtgcccggtccacgtctttgttcagaaatgagaacggggagcggcgccgccggcgaggcgcgggctccgggacggccctgcccgcgggagtctgggcccggtagccgccggtccggtgcgtcgccgcctgccgagacgcgggtgtggagcccgaggggcaccgcggtggggacgccgctcctcccctgactggggacttggcaagcggagccgctgtcccgctcccttcgctcccgcgcgttgaggctgctggcccaggccaggggtgcctccctccaagagtttgaaattgcaagggttgcaaaaggttgtttgacatgctgtagttaatttattaagtttgttcatgaggaattaaaaggaagaatggcaaatagaacaagtggtgaacttttgtggtttggtagcaaagtacaaataaagcagaactctgtggccaaatggaacccaattctagtttaataactaatgggacatttttcttttttttttttttttaagagacgagatctcgctctgtcacccaggctggagcacagtggcgtgatcgtagctcacgtcagcctcttgagtggctggaaccatacgcacgccaccatgcccggctaattttttattttattttattttattattttattttattttattttatttttgaaacggagtctcactctgtcgcccaggctgtagtgcagtggcgccatctcggctcactgcaacctcggcctcctgggtgagctgagcgattctcctgcctcaggctcctgagtagctgggactacaggcgcgtgccaccacgcctgtctaattgttgtatttttagtagagacagggttttgccatgttggccaggctggtcttgaacttctgacctcaggtgatccacccgcctcggcctcccaaagtgctgggattacaggcatgagccaccgcgcccagccctaattttttacttttttaaaagatggggtcttgccatgttacccaggctggtcttgaactcctagacccaagcagtcctcccacctctgcctcgcacagtgttgggattacaggcctgagccaccacacccagcccacttgttaccttataagtaaacaagtaaaagcagcttgtgcatttttttgttgtttgttttgttgtgtttttgagacagggtctagctctcttgcgcaggctggagtgcaggggcgctctcatagctcactgcacgctctgcttccttggctcaagcaatcctctcacctctcttctcagcccctcctgtaacctggactacaggcctgggctaccacgccctgctaattatttttatttctttttgtagagagggaggtctccctatgttgcctaggctggtgtgaactccagttcctatcttggcctcccaaagtgttgggattacaggcatgagccactgctcccagcctccttttgtgattaaaagaaaaatcacccactggctggccccaaaagattgttcagcccctccagatttcactcctgcccactgctgagaagccgacagcagttttgcctgctgctcttttctctgcctcctcttgccatttaatttccctcagatcccagtgtcctgcctaccaggcttttgtggcctctcttgtgttcttgcctgctgccgtgggcaggaagctattggtctggttgcttttaatacagtgactgctttgccaccaggcatgacatgaacttgtacttgaaagaggtaagtggaagcagggcgtgttagtttcctatacctgttatattaccacaagcctggtggctcaaaacaacataacatttgttttagggttctgctgtcagaagtccaaaataggtctcactgggctaaagccaaggtgtcggacaggctggttctttctggaggctcaggggagaacccatttccttaccttttccagcttctagaggccacctgtgttccatggttcatagtcccctttccatcttcaaagccagcaggtagcatcttctcatttctctcgacctcctacctccctcttattaagatccttgtgattatagtgggacccacctggataatcaaggataaggattagcaaccttaattccatctgttaccttaattccccttctgccatgtaaggtaacctattcacaagttctggggattagtacccggacatctttaggggctgttattctgtctgccacacacgaagatgagaaagtttgtaagtttattcttcccctttcttttttttttttttttttttttgagatggagtttcactcttgttgcccaggctggagtgcaatggcgcaatctcggctcactgcaacctctgcctcccagcttcaagcgattctcctgcctcagcctcctgagtagctgggattacaggcatgcgccaccacgcctggctaattttgtatttttagtagagacagggtttctctgtgttgtccaggctggtctcaaactcttgacctcaggtgatctgcctgcctaagcctcccaaagtgctgggattacaggcatgaaccaccccgcctggcctgttcccctttctacagttttaaatatcatccttttattttggaggaactaaaaagattgaagattccccacccagagggtcaccacacaaaaagtacctgatggtgtaagatgatcatatgaagaataagactcccaagttctttaaggtttgtgttagtctccagaactgtccatttccctcataggtttcacagagaatttaccttgaccagatcccacattgtaaaaggaaatgtgtgtgatggattcataaagcatataacatgacgtgttcagacgtcacctcagaacttccattgttttcttttaaacaaactttttattattattattttttaaatagttgcagagtctcactatgttgcgcaggctggtctaaaaccatcctcccgccttggcctctgaaagtgttgggttgagtcactgtgccaggcctaattaaactttttctttcttttttttttttttttttttttttgagatggagtctcactgtgttgcccaggctggaatgcagtgacgcaatcttggttcactgcaacctctgcctgctgggttcaagtgattcttctgcctcagcctcccaagtagctgggattacaggcacctgccaccacacccggctgatttttgtgtttttagtagaaatggggtttcaccatattggccaggctggtcttaaactcctgacctcaagtgatccacctgccttggcctcccaaagtgctgggattacaggcgtgagccaccacgcccggccctaaataaactttttaaaccttaattttttttccttttttttttttttttttttttttgagacagtcttgttctgtcacccaggctggagtgtggtggcacagtcttagctccctgcagcttccacctcctgggttcatgcgattctccctcagctttctgagtaggggttactacaggcacatgctatcatgtctggctaatttttgtatttttagtaaagatggggtttccccatgttggccaggctggtcttgaactcctgacctcaattgatctgcctgcttcagcctctcaaagtgctaggattacaggcctgagccaccaagcccagcctaaaccttaatatttgattttcagaataatgagaaacatttcttgtggtgttaactttgtgtgtgcgctgttttcaacagtgcttcctctgtccctgtccctgtccctgctgcgtaagttggtaacgttttgtgaatcagcctaggacaggtaccactgtttttagaattctttctttttttttttttttgtatttttaatagagatggggtttcaccatgttagctaggatggtctcgatctcctgacctcgtgatctgcccgcctcagcctcccaaagtgctgggattacaggtgtgagccaccgcgcccggctttagaattctttctggagggaaatgcattgtaatttcctggctaccttttagtattaaaaaacttttggaacatagctcattgataatatgctatagaaagagagtcttagagtttctctgtccaattaaagacaatttcaaaaaccaacaaaaaggctttctcagttccagtactcttttgtattcattagatagggacagtttggttcagactacacctgtgtgggatatatctttactggtttgtttatttatttaatttatttatttttatttatttatttttgagacggagtcttgctctgttgcccaggctagagtgcagtggcgcaatctcggctcactgccagctctgcctcctgggttcacaccatctcctgcctcagcctcctgagtagctgggactacaggcacccgccaccacacccggctaaatttttgtatttttagtagagacggcgtttcaccatgttagccaggatggtctcgatctcctgacctcgtgatccatccgcctcccaaagtgctgggattacaggcgtgagccaccgcgcccggccttatttttttttttttgtgagacagagtttcactcttgttgcccaggctagagtgcaatggggcgatctcggctcaccgcaacctccgcctcccagattcaagcaattctcctgcctcagcctcccaagtagctgggattacaggcatgcgtcaccacgcctggctaattttgtatttttactggagacagggtttctccatgttggtcaggctggtctcgaactcccgacctcaggtgatccccctgcctaggcctcccaaagtgctgggattacaggtgtgagccactgcacctggcctattggtttctttttttaaaaaaaaaaaaactgtttatggcactgtggagtcccaccagacaaaccattaacttaagaaaatactattctgctcaggaaaaagaaaaaaatcgtaaaaattaaattttgcatacattttctttataacatgcatactgtgtgtacttttttttttttttttttttgagacagagtctcgctctgttgtccagcctggagtccagtggcacgatcttggcttactgcaccctctgcctcccgggttcaagcgattctcgtgcctcagcctcctgagtagctgggacaacaggcgtgtgctaccacgctcagctaattgttttgtatttttagtagagatggggtttcatcatgttggccaggctggtctcgaactcctgacctcaaatgatctgcccgcctcagcctcccaaagtgccgggattacaggtgtgagccattgcgcctggcttgtgtgtactgttgccagtatatatttctgtgtaataatgttcagggttgtaaacagaaaaccacatataatgcactttaagggagtatttgcgggattttccagagagtatgttcatcctgttgctctgtaatggtcatcattttggggctaatgactgcagttgccgtgattcaattatgaacttcctttttaagcataatttcttttttttgttgttgagacagagttttactctgtttcccaggctgaagtgcagtggcgtgatcttagctcactgcaacttctgcctcctgggttcaagtgattctcctgtctcagcttcccaagtagctgggattacaggcatgtgccaccacacccggctgatttttgtatttttagtagagacgaggtttcaccatgttggccaggctgatctcaaactcctgacctcaggtgatttgcccacttcagcctcccaaagtgctgggattacaggtatgagccaccgtgcctggcctttaagcataatttctatataaacatttaaaatgaaagttgctggagtctatcatgttcattatagcaaatgcatgtcttatttttgttcctttcaagaagttagcttcaattagggaagttgtcaacagagaattttaaaataatttttaggtgagttttcaaatgaaaaggaagagacgtctgcaaatgtcctttacttattcagcttctgaaataccttactttttatttgcctttgatgtaatttttacattgagttcccagattgattatctaaagcaggaaaggtagaactaattcattatctaaaacaagaaagaacaaatttcaagttaaaatagcagtgttttcagcaagaattaaaaaaacgaggtttcactttctctgtagaggaagagtggtggggtaagacattcaagaaagttgttcattcgcatatttcgagaagcattgaggtccaattgcataaaaacgtatctgctgtctctagctttggcctttgagggaaggatataagggaatactcaggacaggggtaaaaagaaaaaagacccttagcacccgaggctttcaagatcactcttaattagtaacttccttccatctctcctcttcccctaacccccagcggcccccccaatcttcatgggccacaggagactgtcagggtgttcagcctggtttctgtgccgggttaggtgtggtgtcataacacacagagggacctcaggaggactaaccctgtggtctgtggatggtgtgatgcctcgggagctggggtgactgcaggggtgggtgcctagtggcacagagggaaagcaggcagcaagtccagggccgttatgccagccacaggtggtgggctgtctgagggagcagtgccttgcggcagttctaacccgatttcccatgccgaatgccctggtgggtacttcgggggtttgataagaaaagagagtagtttcttctgtgttttcatggaaaggagttttctcacaggcataatcttgagtgtctactcaagatttgggaacatttcacatgtatgtattacggtttgtgaccaaagactctggataaaaggaggatttatatcagaattataggaagagctgtcatgctgtaccatggagacctgtgtgtgggtggtgagaagattcaacaagaaaaataaggtctgggcactggcatgtctgggtgctgctgcgggctggggagaggagcctgttgcatttaagaaagatttgccttttcatcaccatgtctccagaataggcatggtgcctggggccctacagaggcagctcagcaactgtggagggaataatggattgaaccaagttccatcttgtaaaaagttaatatgtggtgagtttgagtttttttcctcaactctccatttcaaacagaaaccagaacacttctgtgcatgtttgaccccatgcagaacccgttttctttgtttttctatgatatggatgacttccattattctcaaacttagttactaacttactgatttgcctttattgaaaagaacacaattatttacagtgaacaccttcttagaaaatctggaacataaggttgccataattatacacactttgtggtctttaagatatattctcagggtgacatgaacatgtcagagtataaacatttttagaattcttgatgtctggtgccaactttttccaaaagggctgcaccaatttactcttttcttagcaatgtatcagtacacgtacctgtaatagtgcaaatgtgccctcagtgaggatcaacattttaaaagtttttttttaaaacaaacaagcaaacaaactgaatttggtggttacaaaatggtgacttattaaatctactgatcactagctggattgaaaaaaatttttattttgcatatttgtgtattatgaactggctacatcataagaaatgatggtttatttacttaacttaggttaactcttttctatcaaataaagtgatttacaggtttttgtcactgttttaagcatggggaaaatgtgtatcagttttgactggggtttaggttagattttggctaattgtaacagtcgtttacctttcttttaatttttcttttaaagatgaaagatctctcaacccatatattgtcttctggccaactacaaaatgtttccttacgagaagaaattgtgaattaaatagatttttagaaaatttaatttaatttaattttttttttttttttgagatggagtcttgctctgtcgcccaggctgcagtgcagtggcacaatctcggctcactgcaacatctgcctcccgggttcaagcaattcttgtgcctcagcctcctgagtagcggaattacaggcgcacgccaccatgccctgctgatttttgtatttttagtagagatggggtttcaccatgttggtaaggctggcctcaaactcctgacctcaggtgatccgtccgcctcggcctcccaaagtgctgggattacaggcgtgagccaccgctcccggccagtagattttttttttgaaactataatttttcttttaattaaatagagcagggtctcactgtgttacccaggctggtcttgaactcctggcctcaagtgattctcctgccttggcttcctaaagtactaggattacaggcatgagccaccacaccttcctgtgaattaaacagattgtattggtctgggttataatgataaactgttcagtttcaggctgggcatggtggctcatgcttgtaatcccagcactttgggaggtcgaggtgggcagatcgcttaagctcaggagtacaagagcagcttgggcaacatggtgaaaacccatctctactaaaatacaaaaaaaaattagccgggtgtggtggtgcctgcctgtgatcccagctactcaagaggctgagtcactagaatcgcttgaacctgggaggcggaggttgcagtgagctgagatcgtgccactgtactcctgcctgggcaacagagtgagaccatgtctcaaaaacaaaacaggccaggtgtggtggctcacgcctgtaatcccaacactttgggaggccaaggtggccggatcatgaggtcaagagatcgagaccatcctggccaacattgtgaaactctgtctctaataaaaataaaaaaatcagctgggtgtggtggtgcacgcctgtagtctcagctattcaggaggctaaggcaggagaattgcttgaacctgggaggcggaggttgcagtgagccgagatcgcgccactgcactccagcctggcgacagagtgagactccatctcaaaaaacaaaaacaaaaacgaaacaaaacaaaacacttcagtttctggaatcttatggctcatacctgctcctttctaaatgttccatgtgttaatcaaaagagattatgtcaaacagattttttcttcagtatttcttgcattcacgatcagttaggacacttattctatagtaagaattagaagattgccttcttatttcaagtatggggggcacacatcataggtcatttggaacaggagagatgaaagggatgaaacatctctgtgtattgtgctggaccggtggaagacttcaacttgagagccgtgtcgagtctggtcgagtctgctttcctgttattgttccacacctttcctgctctcctctccaagatgaaagtcttcagagtgggcttctaaagaaaagaactttgcctgaacctgtccatttgctccgttgccacactacttgattgtctctaattattgttgcaatttagtttcagttgcaatcatagaggcatggaggaggtggaaaattatttagaaatgatcaagaagtgaatcccacatcctctgaaactgctggtaatgttgttttgcttctctgtttgcattaacttcagaaaaacacaaaagcagtgaagggtatgtaggggatttctatgactcctcattatccaggatagcgtgacattgtatatttctgcttttatggtagtgagatggttattagctgctttctttagtgactgaattttatagtaagggccaggataataccttccttatccaagtctttatattttccaccttttcttttctttctttttttttttttttttaagatggaatctcgctctgtcaccaggctggagtgcaatggcgcaatctcagctcactacaacctccaactccctggttcaagcaaatctcctgcctcagcctcccaagtagctgggattacaggtgcatgccaccatgcccagctaatttttgtatttttgttagagacagggtttcaccgtgttggccaggatggtgtctatctcctgaccttgtgatctgcctgcctcggcctcccaaagtgctgggattacaggtgtgagccaccgcacctggccttcttttttctttgagacagtcttgctgtgtcgtccaggttggagggcagtggcgtgatcttggctcactgcaacctctgcctcctgggttcaggcatttctcatgcttcatccacctgagtagctgggattataggcatgtgccactgtacctggcttatttttacatttttattttattttatttttcagacagggtcttgctctattgcccaggctggcatgcaatggcataatctcagctctcttaacctctgcctcccaggttcaggcagtttacctgcctcagcctcctgagtagctgggattacaggcgggcaccaccatgcctggctaatttttgtatttttagtagagatgggattttgccatgttgggcaggctggtcccaaactcctggcctcatgtgatctgtccacctcggcctcccaaagtgctgggattaccgatgtgagctactgcgcctggccagtttttgtatttttaggagagacggtgtttcaccatgttggccatgctggtcttgaacccctgagctcaaggaatatgcctgccttggcctcccaaactgctgggattacaggtatgagctcccgcacttggccattttctaccttttcttgagtcttcaaggcttctatttcagaagcgtgcccttacctggcattgttaaatctatgttgtaattagtagtgttaggtatgaatgatggaattggctaaggctattaaaaaaacctattttcagtcgggctctgtggctcacacctgtaatcccaggccgaggcaggcggatcacaaagtcaagagatcgagaccatcctggccaacatggtgaaaccccatctctactaaaaatataaaaattagccaggcgtgatggcgcacgcctgtagtcccagctacttgggaggctgaacaaggagaatcgcttgaacccgggaagtggagattgcagtgagccgaggtcacaccactgcactcccgcctgggtgacagagtgaggctccgtctcaaacaaaacaaaacaaaacaaaacaaaaaaaacccgcctattttgtagtaatatcacagatttctttgttttttttttttcttttcttttcttttcttttttttttttttggagatgggaattttgctcttgttgcccaggctggagtgcagtggcacaatttcgactcactgcatcctccacctcccgggtcaagcaattattctgcctcagcctcccaagtagctgggattacagacacccgccaccatgcctggctaatttttgtatttttcttttttttttttgagacgaagtcttgctgtgtcgtcaggctggagtgcagtggtgcgatctcggctcactgcaacctctgactccctggcttaggtgattctcctgcctcagcttcccgagtaactaggattacaggtacacgccaccatgcccagctcagttttgtatgtttagtacagacggggtttcaccatgttggccaggatggcgtctatctcctgacctcgtgatccacccacctcggcctcccaaagtgctgggattacaggcatgagccactgtgcctggccaatttttgtatttttagtagagacggagtttcactatgttggccaggctggtttagaactccgaacctcaggggatccacctgcctcggcctcccaaagtgtcagaattacaggtgtgagccactgcatccggctcgcagattggtttctatgagtagtttgtaatggtttattcagtcaacaagcatgagtgatcatttcataccatgtagtccctgttgtcaccgatgctttgagtctagaaggaggagacaaacatggcagcaagctgtgaaggagcgtgtcacagtagatgtggcaggtgtgtgcatgaaaaatgtaggtaaaccaaggagagcagtgccagttccactggcgctgggatggcactggattggccaggggagagtttgtagaggagctggcccttgggctggattgtgaaagatgagttagtgccaagtaggagaacattgcaaagaagtatatatcaaagcaaagagaatgagaggacaggaggtgtgaagcagtttcgccacttggggagctacaaatggttctttgtgcctggagagtaggctgtgagcagagggaggaggccagaggcagggttagagaaatgggggacagttatggggggcttcagtatgtgttgttacacaggacttattctgtgggacacggagctatgagagggtttaaaccagggatattttatgctgattattttgctttttttttttttgagacatagtcttgctctgttgcctaggctggagtgcagtggcgtgatgtcagctcactgcaacttctgcctcctgggttcaagtgattctcgtgcctcagcctcctgagtagctgtgattacaggcatgtgccaccacacctggctagtttttgtatttttagtagagactgggttttgccatgttggccaggctggtcttgatctcctggcctcaagtgatttgccaacctccatctcccaaggtgctggtgtgaggcactgcgcccgttcttttttttatttttattttttatttttgccaagagggggaagggagagagaaaggaagcaggtggaggcaaggagagggagaagcagagcattctgttgcattttagaaagattcttctgacttagtgtggctcagattggcagtggagagacccttaaggaatttttggagataggtgagctaggtgatgagggcttgaattcaggctgtgggagtaggaggtaggagagaaaaaatacaggaccagtgaaggacatgaaattgatggatttggttgccagtgtttgggagggacatagcattgaaaggagatgaaagagacagggtgacgaaggtgagcaccaggtttctgtctttggatgactgcttggagagtttccatactgagaataggacttcggttttggacgtaatctctggagttttgtggtacttgtacagtgtccactttgagagacccatttaaatagttgaatttgaacctgcaactccagagatgatcaacgcaggagtgggagtggaacccagggagtgggtgatgccacgggctgattgaggagtccaaggatgtcgtcttggaataccaccactgaagggctgggtagaggaagagatctgaaagggaaactttgaaggcaaatgtatataactcttcaggtaactagatggtaaatggaaagagagagagggcaggagctggaagttgcagagtggagagctttttgtatttttctgggggatattaagagtatttatagactcctttttatacctttggacaatgattccgagccagtcttgaatgaaaacattcatatgtgatgtgttgtaaacctccaggacgatcggtctcacatttcattttgtctgttctggcttctgtacacagcagctgcagactatatgtgtttttgaaacctgtttaacttcctttcttttgtgttctctaattctctgaaatattatttccaacagccctaagattgaaattaagagaacgtttgaatcttagctgcattctggcattttcaagtgcttcctgcacatttccccttggatatcccatcattgtccaagattcagcatgtccgagacttgctcctggccctttcattctggtgttacctctagacctctctaatttttaaacttttatcaccattcacttatcactgcaatcattatggcttgaaaaaaacactggattctttttcttgccatttaaattgtttcccatctatccaaccatccgtttgttcatctattcaaccatccgtttattcatctattcaaccatccatttgttcatctattcatccatttgttcatctattcatccgtttgttcagactttttaaattctttgtgtcagggtatttgctttatgctcaggctgtgaagaattttaagatataggccctgctttccagaagctcacagtgtagggcggttcacgtggaaatttgctatggtggaaataccaacaaatgctatgggagcctggggactttcagctttcactgtgttctgagtgagatgtactttaaaaaaaatggttttaaaaaatttagacatggggattcactatgttgatcaggctggtcttgaattcctggcctcaagcagtcttcccatctcggactcccaaagtgctgggattacaggcgtgagacaccatgcccggctgagacgtacttttgagcaaacccaacaggcagttacctactgggatgaagtgagatgggaacatgccagagtaggtgtcactgctctagctgttcccacactagcagttaactgcttgctgcacatgaagttcattgctgaacatttttcgtaagttctcattgaaccctcacagttaccctgtgggtggcaacaaatactgtactgattttataggtgaggaaatggagaagtagagagattctaaagggacatagctgctgagtggttgagctggcaccacaagctagatttctcaggctccatgcacaggccatgctttgaatgggctttttctatactggctgctcattcacacccccctcttcatttttatgtcttgtacttttacataccttatatgctatttatgtcttttcattgttttttctttttctcagacctctcagagatgaatttatgtactttctaaacgttctttcttctgggagtggatacagagttttgtatcttgatatagtttggacagagttttggttaaacctgtgttgctggttattaaacacatttacattgaaagagccattgttaatcttagggttgaaatttgaggagtttgtaggatcatgcagtaaaggcagtatctttttccttaatcccccgggtagcatttagtttaggggctgctgtttccttccagggactctggtaaactgggtttgatgttgtggcaacaagaattactcagcctggcctttgatgattccctggagccagaacatgttttgtggttgggccactagaatttatgagaaatccaggtaaccaggtaaaggttaacgaatcttactgagcttgtctctcagccattttcaggggtcttttcatggcttctcttagcctttttgccctttatgactaaataaaaaggctgctgaaagaactcatttaacagtgagacaggagaacactagcagaataatgtttcttccagggagttacagagcagctcccagagtcttcctgcccgaagtcctgacttggaagctttgtctcctgctagaggaggggctggcttttttttttttttttttttttctgtagagatgggatctcactatgttgccctggctggtctcaaactcctgggctcagacgatcctcccacccccaaagtgctgggattacaggtttgagccaccgtgcacagcctaaggctggtttttgacagggcctcattggaatgtgagtactgtggtagggtcaccaaggatctcaagacaagaccctctagctttgcaggttcaaaaatagactttaggacttggatttgtgccactttattcatgctattgcaggatttaaaaaaaatcaagttgtgatcatttgcctgctctcagctcagctgtggactctggttcttggggagcacatccagggagccctggaaacaccactgtcttgtgctgtggcacctcttggtgtttgtcttctgggggaccatctgggggaccatcctgactaaaccttctgtttagtcaggacagcaaactgacaataaaatagagtcagatacagcttttgagggcttgccatttgttttgcttggcattgaaaccctcttggacttctgaatagcccacttcaggcttgtctcctctactccacactggcttttactgatttattgaagacggagacttcttcaacttgttctctaactttgacaaagacttctgcgatttctctgtgtccagactgcagtgacaaagcatggaggaaattaaattctaaaaagatttttagaattataattgaaatatttattttatgggtttatgatatcccaaaagaaatagggattccaacctagactttggggtctacctttagaaggagccccgttttctgggtgtgttccatggtccactgaggaaggcttctctttgagtctactgatgcctcagggagggcctcccggtgatcctgctcctgttccttgggacccatcagggatacccatgcccctctgctcatgcactcagcaaactccttgcggtgcttggtacacaccaggcacgctccccagctcgggcctttctccagctattcactgtgctagggatgcttttcctccaaataacctcatgctcagttcccgcactctctcgacaagacttcccctgtttgcttgagcagccagtgcccccctcctctctgcttgccacccttaccctgcttgactcccaataatgctcatcccccgggaacctactcattatgtttattacgcatggtcagtcttctccagctgaagtggaaactccacaaggcaggaatcttcatcccttttgttactctcccctatcccatgtgcatgccagaaacagggcctggcacattgtaggctctcagagcttgttgactgaatcattaaatccatgctcccccactccctctgcttttgatatagaaacaaaggtcactgaaattgctcatggaaacttgggagttgcagttaaaatagatccctcttacctcgtgcatacatctaatttcattcttccattattttggggtttatatataagcctggttcttgctgaaactgcttatgttgataaccagttagtgagttcctcactgttgacttgctgggaagtttatagagacattttttatgcattcagagatttcagtacaaatcttgaaaaagggacatttaggccgggcgcggtggctcacatctgtaaccctagcactctgggaggctgaggtgggtggatcatgaagtcaagagatagagaccatcctggcaaaaattagctgggcgtggtggggtgcgcccgtagtcccagctactcaggaggctgaggcaggagaattgcttgaacccaggaggcggaggtttcattgagccgagatagtgccactgcactccagcctggacaacagagcaagactgtgtcttaaaaaaaaaaaaaaaagacatttagatggaaatattattttatggtattagttgtgagcttataaaaagaagaaaatgattattctatgttttgttttttctttgagacagactctcgctctgtcacccaggctggagtgcagtgatgggatcttggctcactgcaacctctgcctcccgggttcaagcgattctcctgcctgagcctcccgagtagctgggactgcaggcgcacaccactgtgcctggctaatttttttatttttggtagagacagggtttggccatgttggccagactggtctcaaactcctgacctcaagtgatgtgcctatctcagccttccaaagtgttgggattacaggcgtgagccactgcgcctggcctattctatgtttgaaagatgagtgtagcaaataaattctttaagaggaggctagcatactttcccccttatccatggtttcaccttccatggtttcaattatctgcagttagctgtggtttgaaaatatgtgagtatagtacaaggaaatattttgagagactacattcacgtaactcttattacagcatattttatagaacaacttattgttctttattatttattataatgttctttattattagtttattattaatctctgcctactttataaattttatcataggtatgtatgtataggaacaaacatgttgtatatagggttcactactatttgtggtctaggcatccgtggggggtcttggaaagtatcccctgtggataaggagggactactctataacctacagtaaggtgatttgtggtgtgaatccactttattctaggaagtattaaggtgtttgacaaatgtgtatataaatgtgtgtatcttgagagggattaaaagtcttttttttttttttggcacggcctcggctcactgcaacctctgcctcctaggtttaagcgattctcctgcctcagcctcccaagtagctgggactacaggcatatgccaccactcctggctaattttgtatttttagtagagacagggttttaccacgttggccaggctggtctcgaacccctgacctcaggtgatccacatacctcttcctcccaaagtgctgggattacaggcgtgagccaccgtgcctggccaaaagtctttttttgagattaaaaacatccagaaagcagccggacggacatttccattgtattagtttcctgttgctgccataacaaattatcacaaatttagtggcttaagacaatatacattattatcttacagtttggaggccagaagtctggaatgggtctcactgggccaaaatgtatttcagcagggttgtgtttctttctggaggctctagggaaagatctacttccttacctttccagcttctaaaggctgcccacactccttggctcttagctccttcctgcatcttcaaagccagcagtggctgattgagtctcacctctcatcactctgacactgattgtcctgcctccctcttccatttggaagaatccgtgtgcccacttggatactctaggataatctccctcttctaaagttggctgattaggagatgtaattccatctgcaatcttaatccccttttgccatggaatttaacatgttcacaggttccagtgattaggacatgtatatctttgggaccattatcctgccgactacatctatacatctaccttagtgcctttgcccatggaatgtttcttgtgagaatgggcagtttaatccttcctgcatatcattttcttcttatggaagtgtgcctcatgggtattaagtattgcagtactttgtagactttgtctgacttcgtgaagcatttctagttttagaagagtgctcctaattcaaaggtaggggaaggcatgtgcaaaaaagccgccctttccactctatattctgctgatcagcaacactatttgtcatcaaattaccggaacagagactatcttgagtcagaaggttatgttgttgctctctgttcttaggaatgtttttgtactctgagagtaaagataatttttcctgttgtcaggtaatggaaatgtccctgaacaatggaccttgataggaaaaagaagtttattattctagaagatgttggcacaacattatttggtaattatttttccagaaatctgctgttttcccccatgtcacatgatggacacctcattgtatggaggaagcaggccagatgctgttactctttcaaacgtttatgttaaaggctcatttggtttaatttccactcagaatagatgttaaggatacaaaaccaaatgtctagctgactactactgttctttccctttcctgctcttgctttggactactgttttctcaaacgtataaatgtgtgtgtatagcattctaataagaggaatttaagctttaaaaagtttttaaaaataacactcttttttttttgtttttgagacggagtctcgctctgtcccccaggctggagtgcagtggcgtgatctcgtctcactgcaagctccgcctcccgggttcacgtcattctcctgcctcagcctcccgagtagctgggactacaggtgcccgccaccacgcccggctgattttttgtatttttagtagagacggggtttcaccgtgttagccaggctggtctggatctcctgatctcgtgatccgcccgcctcggcctcccaaagtgttgggattacaggcgtgagccaccgcgcctggcccctgcctcttgatttttaaagaggttttaataagctttgagtagtgtgagtgcttttagttccctgtattatcacgttcccaaggtcaattgattttaacacaaaaataggttacacatcaccccattccagcctagagcaggactagaaaaagcagttcctgtgagaattagttccccttggagatctgaaacttgaaatctgaaaacaagaacctcttgagttgggactcagaaggtggggaactgctgttgtgtaccagaatgtgtgcacaaggnnnnnnnnnnnnnnnnnnnnacttgtaaatctcgaggctgggcgcggtggctcacacctgtaatccagcactttgggaggccgaggtgggtggatcacaaggtcgggagttcgagaccagcctgaccaacatgttgaaactctgtctctacaaaaaatacaaaaattagccgggtgtggtggtgcatgcctgtagtcccagctactcaggaggctgaggcaggagaatcacttgaacccgggaggtgggtatcccatttatcaagaaaatatatagagactgtctctgacttatggttgactttacgatgggtttattgggaagtaaccccattgtaagttgaggagcatctgggatatattttgattttgagaagtgatgtcatcagacttacttgatacctgtaacttttagaaagataagtatatgatgctttttgtgtaaaattactttttcacttctatttaaaagtcttaagttctgttgtaatgcgatttttgattttctagtgtttagaaaagagggttttaagatagtagaatgttgttgctttcttttaaactatatatatacatatatatacatatatatgtatgtgtatatatatatacatatatatatacatatatatgtatgtatatatatatatacatatatatacatatatatgtatatatatatacatacatatatatacatatatatatgtatgtatatatatatacatatatatatgtatgtgtatatatatatatatacacatatatatatgtatgtgtgtgtatatatatatatatatatatatatatataaacctgctatttggatagaggccagaattaaaacatcagtagtcaaaagagggaattcagtgtttcttgagtttttagctttatatgtctaaatttgtaaaattcaaccatgtattttccgttccacatgggcaccttttgcaattgtggtagcagatgtcctaggcagatgaacatgcagaagtggtttgtttagccttcccttttaaagttcgtaatctagtaaatttgggttagaatggtggttcccatacttgactaacccgcagaatccctggaggaatctttcaaaaaagccatttattctggttccttactctagccataccaaacgtaccagggcagatccaggaatgagtgaatgaataaatacgtacatacatgcacatgcttgtacacacatgcacacaaatatacttctaatgcccctaaatttggggaccccaggtgtggaaactcacgcttcagaacctctaactgttctctccaaggtcacatcacacaggcaggctctggcttgagttggcctggccagagatgcttcccttcatttcccgtgttgagtgtataaaatgatttcacaagaatttgtgcgtccatgattgtaggaagggatggctgagtgttgaatgcatttcctcagctgtaactatctaatttatgtggttttgctttaagccattcagtattccgcttggagggttttgaacttacagaggtttttaagaagaggctcaacagatgaaagaagcaagaataaccaaccttggatttttgtttttactcctttattatagctaccaagtatatagctacctacccactttagcttccccatgtgtctttgtgtggttttctgttttgttccttttaagagataccgtctctttatgttgcagctgttgctaggcagccagtggccaggtgccagttttagagccctgatctgtacaacagtgaggaagcaacctaaaaagacccctttgcctaccccgttggatgaaagagaggcttggcgctgggatgtagactgctaggcgcatgagacctacgaagaactgaggctgcgtccacttacccagagtgtctttggagagtaccttttagtccttcctcggggcagttgccatatagtctgaaaatgaagccacctcaggcagtgggcttcgattggctacaattgtgcccttcttactttagcactttggcaaacattgagaaaattattattatggaaattttctttctgttttgagacaggatctcactctgttgaccaggctggagtgcagtggtgttgtcatagcccactgcaacctcgatctcctatgcttaagcaatcctcccacctcagcttcctgagtagctagggccacaagcacatgccataactccgtggatgccgaaagtagataacgagacctactggatcagaatgaggcagattagtacacatcgcacagcaaatagcaggaatatcagcatgaaagtgctggtgcccctgacctcaagtctcgtggggtgacatgatgggcccagatgatgtctatgcatgaattgggtttgcctacagctgaggaaccaaggaccaccaaggacttagcactttcctttctttttttctttcttttttgtttttttgagatggagtttcgagtttcactcttgttgcccaggctggaatacaatggtgcaatctcggcccactgcaacctcctccgcctcctgggttcaagcaattctcttgcctcagcctagcgagtagctgggattacaggcatgcaccaccatgcccggctaattttttatttttagtagagacggggtttctccatgtttgtcaggctggtctcgaactcctgacctcgggtgatctgcctgcctcggcctcccaaagtgctgggattacaggcgtgagccaccacaccgggcctgggcttagcactttttatagcaagtgatagacaggccaggcttcttctcctcaatgggggcatgtcatgctacagtctccttgaccaacttcatgtcgccagctacaagaagacagaccttgcagtttggcactctcagcaaggacatgcagggatgcttggggcctcggccaaaggcagcatgatatagatggagcatagtttaattaatcatcctgtcttgttatttagaagtttccactttgttcctgtaagaaagaatcctgtaacattcttgtggataaagttttgctcacatttccagtgattttcttaggctagattcctgtaagtggacttactgggttagggagtttaactttgtagtctcttgatatgtactgccaaatgggttttcagaaagtgtgaatcagtttacacctcataccagtatatgatgatacttgttaatttatccttcctgacattgaattactatttttttaaacttttttttgaatttttttttttgaggcagagtcttgctctgtcacccatgctggagtgcagtggtgcgatcttggctcactgcaacctccacctccctggttcaagcaattcccctgcctcagcctcccaagtagccatgcctggctaattttttttgtatttttagtagagaaggggtttcaccatgttggccggactggtcttaaactcctgacctcaggcagtctgcccgcctcagcctcccaaagtgctgagattcaggcatgagctactgcacccggctgaatatttttttaatcttttgggttgctgatataattaaaattttttcctgcctctctcagcattggcagaatgaactttgttctaagaacctcggctagtgtttacatgtattagaatgggaaaattatagcagcttctttcccaggtcgttttttattcatctattcaacagatacttattgaacacctataatgagctggacactctatgggccttgcaatttagacatgaatagagttctcaggtaccttacattctaattagaaggagaactttgacctctaaccaagacctgtttaattcataggagggtttcttttcttttttttaaactgcactcacggtcatccccccaaaggatgagggtttcttaagttatgttgaaaattcaaaccttgagtccgggcatggtggctcacgcctgtaatcccagcactttgggaggccaaggcaggtggatcacgaggtcaggagatcaaaaccatcctggctaacacagtgaaaccttgtctctactaaaagtatgaaaaaattagctgggtatggtggcgggcgtctgtagtcccatctactcaggaggctgaggcaggagaatggcgtgaacccaggaagcctgggcgacagagcgagactccatctcaaaaaaaaaaaaaaaaaagaaaaaaaagaaaaaaattcaaaccttgaaattccgccttgtgaataatcttagtctaatttttgccatgtttattggaatataggccagtggttgaactttgtgttcctaacctctcagcatccttgtgtctcctggtgattatgaaggcttttttttttttaaatgagatcttgctctgtcaccgaggctggagtgcagtggcatgatcatagctcactgcagccttgacttcctcggctcaagtgatcctctcaccccagtggtattttctaatagacatctgtgtccccaaaatgtgttaaagacttttgaagatgagtccactcaaataatgatttagttctgaatagacagatttttaaattcttttttgttttttagatggggtctcactgtgtcactcagttctctgaaggacttcaaatagcctcattagcaaactaggggtactaactgacattttcagcacctttaattggtgatgatgagcacattaatttccatttgtctatttgctgcagacttttcaggttccttctccttgttttaaaaaaattattgaggtataatttacatggaataaatggtatccatttaaagtgtacagtttggctgggcgcggtggctcatgcctgtaatcccagcacttcgagaggccgaggcgagtggatcacttgagatcaggtgttcaagaccagcctggccaacatggtgaaaccctgtctctactaaaaatacaaaaattagctgggtgtggtggtgggcgcctgtaatcccagctactagagtggccgtggcacaagaatcgcttgaacccagggtgtgacggttgcagtgagctgagatcacgctgctgcactccagcctaggtgacacagcaagactctgtctcaaaaaaaaaaaaaaataaaaataaataaataaataaatagtgtacaatttgatgggatatattcaacagttttgtacaccagtgaaaccactatcacaataaagcacaatattttcttgacctgaaaaagatgcttcatggccctttttgttttgtttttctttttttgttttgttttttttttgaggcagtgtcttgctctttctcccaggctggagtgtggtggcatgaacacagctcactgcaacctcaacctcttgggctcaagcagtccttccacctcagcctcccaagtagctgggactacaggcttgcaccaccatgcccagctaattgtttatttatgttgcccagactggtcttgagcttctgggcttaagcagtccccctgcctcagcctcccaaagtgctgccaccgagcctggccgccgcttcatgtccttttgctgtccattcctccctctaccccggccccaggcaaccactgatctggtttttgtgactacagatgagtttgtatttcctagaattttatgtaagtgaaatcatacaatgttacaatgtatattctgtgtctggctttctttcctttttttttttttttttttttaaataaacccactgccaacatcatacatgtctggcttttactcagaatgatgtgtttgaggctgggcgtggtggctcacgcctgtaatcccagcacttgggaggccgaggcgagcggatcacttgagatcaggagttcgagaccagcctggccaacatggctgtctctgctaaaaatacagaaagctactctggaggtggaggcaggagaattgcttgaacccgggaggcggaggctgcagtgagctgagattgcgctattgcactccagcctgggtgacagagctagactctgtctcaaaacaaataaataaataaataatattatgtttgagattcattgttgggggtatcagttgttccttttcattgctgagtaatgttccactgtatggctgcaccacgtttttggtctcttcacctgttgatgaacatatgagttgtttccagatttgggctattgtgtataaaactgctgggaacattcatgtatgagtcattatgtggatatgttttcacttctcttgtgttatacctacacatggaatggctggattgtgtgacagaccattttccccttaaaaatgttttattatatataaaatataatagaggttagttaggaatggaatgtacaaatgatatgtaactagtttcaaaataaggcttagaagagcttttatttaacataagtataatatgcaaagcagttaaagatttttataagtatgttattttgcataaatttaaaaatggatttaccttaaaaaagtgacataaaacttcagtcacaaactaaatgcaaaaatttattttatattcttgtactaaaaatcacaattttgggctgggcatgatggctcacacctgtaattgtagcattttttgaggttgaggtaggaggattgcttgagcccaggaatttgagaccagcctgggcaacatagtgacactctgtctctacaaataaaaaagaaaaaaattagtttggcacgttggtgcacacctgtggtcccagctacttgggaggctaaggtgggaggattgcttaaaccagggaggttgaggctgcagtgagccaagattgcaccactgcactccagcctgggcaacacagtgagaccctgtctcagaaaaaaaaaagaaaacaaaaaaccccacaattttctatttccttaaaattgagggaaagtcacgtaaaaactagaagtataaattcttatgggtgggcaaatctgcgtaagagggtttgtttttgaagcatggcagatcagagaagacagttgctcttggaaagttctgtcagcatcacacgcatgcctttcctttccgagtttatctagatgcgctgcttctcagtagccggtcgctttgtccacgacggtcctgacacacaatgtgacatagcttcacacaacggccactttgaccctccctccctactccacgtgtatctagaggagaggatcctagcatgccatcagccaggtgtttgcagtacgctggattgatgatgtcattaccactcagtggtgaatcattttaaaaaaggggtgaggtgggggacttcttatattttttaagggattattttaaaaatcattttagaacaattctgcaagggttttttggtgtttgaagtactagactagacaacatactttggaactaagattttaattaaaggttactctaaagaatcagtgattgatgtccccagatgagatagatggcaggagttaaaagtaattaaagtttgcagaagttggtgttttcataattggagtatggcaaatcacctatttagtccatttagtaccttattatacactgtcttctgtcctaactgttattactgctcagttaatgtttataatctactgttagattccctaagggcagtgcacaaaccccatgtaattagggatgtcagcagccctccgattctttgttgttatctttatttatttatttatttatttatttatttattaagtagagataaggtctgaccatgttgctcaggctggtctcaaacttctgggctcaagtgatcctcccgaaagtgttgagctaacaggcatgagccactgcctggccaagagcatgagtcttctggggaggtttggcacttgcctgtggcaccggccttgtgacttgtttttattttttctttcttttttccttataattaaattagagatagggtctcactatattgcccaggctggtctagaactcctggcctcaagcaattctcccacctcagcctcccaacgtgctaggattgaaggcatgagcaaccacgcccagcctgaccatttattgacagtctgttagctgtgctggggtggcatgagaggcttgcctctgattgtcctcatgttcctggtgactctggtgcccctctcccaccctgccctacactcactcatacatgtgccttaagactttgggaaaaggaagagtaaacctttgggggagatttggtaatcctgagtgtactttttcttgctttatgtgttcttgtgtgtcctgtttcccaagattatgaatgtcttggcaggactagtcttgaactaaacaacaacaaaattcatgcgttatagtactacctatggctttgtatttaattaggcattttaacattttcagtatcgtatttaatctgtataatcacattgtgatatgaggtgtgtgaccttacttatatttacatggttaagattataaactgaaatacgttgttgaagttctctctcttggccaggtgcagtggctcacgcctgtaatctcagcacattgggaggctgaggcgggtggatcatgagctcaggagtttgcggccagcctggccaataatgaaaccctgtctctactaaaaatacaaaaattagctgtgcgtggtggcgcgcacctgtagtctcagttactcgggaagctgaggcagaagaatcacttgaacccaggagacggaggttgtggtgagctgagatcacaccactacactccagcctgggtgacggagcaagactctgtctcaaaaaaaagaagttctctgtcctgtctgagatgatcggcagcattgtttatccctgtagccctggtactctttattgatagtagagattttactccaattaggtactttttaaaggtaatttctatgaaaatctctataaaaatgcttattaaaaaactcctttacagtggaaaagagtaataactaacatttccctttttcctcacaagctctaaacctactagaaatagaaaaagaaatctgaacatggagatcatatgatcagccttgtaactggcgaagagagggagatggaggagtccttatttcaaacatctaggaaatatgttgcaaattagtaaaataggttaaatttctccgtttctttcccagtaataggatctttgaactagactatttgaaattatcatttgaggccgggcgcggtggctcacgcctgttatcccagcactttgggaggccgtggcaggcagatcattcgaggtcagggtttcgaaaccagcctggccaacatggtgaaaccctgtctctactaaaaatacaaaacaattagccgggtttgcagtgagccgagatcatgccactgcactccagcctgggtgacacagtgagactccgtctcaaaacaaaacaaaaaacaaaaaagatgaaattatcatttgatataaccaatagcagagagatacctgtactctgattccttcttcgtttatgcagtcaatccttgttatttgtggattttgtattcatgaattttcctactcactaaagcttatttgtaacccgcaaatcagtccaaaggtagtcctttcgtggtcatttctggacattcacagagcagtgaaaaatgcagtttgctcagtgtacacatttccagccactgtgaaacaaggtgactgatttcttgtttcagccctcatactgtaaacaaatgacctttatgtggtctatttagcattacattttttttttttttgtatttttgtgcctttgctggtgacttgctctttaaaatagcccctaatcataatgctgaatttctgtctattgttcctaagtacaagaggccatgatgtgccttatggagaaaatatagtatgttagcgaagctttgctcaggaatgagttacagtgctgttggccatgagttcaatgttaatgaatcaacagttggctgggcatggtggctcacatctgtaatcccagcactgtgggaggctgaggcaggtggattgcttgagcccaggggtttgagaccagcctgggcaacacgacgaaaccctgtgtctactaaaaatagagcccatgtccccccgccatgcgcccatggttccagctattcaggtggctaaggtgggaggattgcttgagtctgggaggtagaggttgcagtgagccaggatgtcaccactggactccagcctgggtgacagagtgagaccctgtcttaaacaaaacaaaacacaacaatatatattaaataagccatctttaaacagaaacccatataaacaaggttatgtattgttcagttgacaaaagtgtgaccagaggtctgtaggaacctaacctgtatttcccctaggagcaacggtttagtcttttccaattcagtgttagcaatgactatttttgttttttttttttttgagatggagtctcgctctctcgcccagtctggagcgcagtggtgtgatctcggctcactgcaacctccacctcccgggttcaagcaatactccctgcctgtagctgtagctgggattacaggcgcccaccacctcacccatctaatttttgtatttttcatagagatggggtttcaccatgctggccaggctggtctcgaactctgacctcgtgatccacccgcctaggcctcccaaagtgctgggattacaggcatgagccactgtgcccggcaacagcaacaactttttaaacaataactactttgaatagcaagaatcagctatagcttagccctcttcctacccctaaacttcaggctgtgacatcccagtgccacatttgacatctcctgggggatacctacagggtctctcacagttggcatggccacagcagagcccctggtgctgtgtccctctttattcaccccacctgagaaatagcatatccgctcacataggtgttcccatcaaatgttttgaatgttttgatatcagccttccctttctcttgttctgcctatccagttcattagtagtatggtttattctacttccaaaacgcatcttgaagtaatctgtttttctgcatctctgctgctgatgtgctagtggaggccactgaattacttgcctggatgccacatgagcttcccgtagctgatgccactctgtgcacccatatctcatgttcccttccttctgggcacgtggagaagcatattctcaccccctggccattgatttgctatccttttcagacccagagggagcaggctaagaaatattttgtggaataagtatgtggtattattttaggagcacttggtatttctttgggtaatagtagtttctgcaatttgaggactgcttctaaacctgttaggaatattttttgaactgtaagggaattttttttttagggcagagaaacatctgaacaatgtattaagtaaaagcttggagaaaatcttgggaaaaaaacacttcaaaaatagattgttttagagttctttttttctgaaaccacctgccttctaaagcaagataattagattttaaacaatggtttctgcttagttaggtttttttttatttttttatttttatttgttattattatttttttgagacagggatctcaatttgtcacccaggctggaatataatggcatgatcatagcttactgcagccttgacctgtgggctcaagcaatcctcccacctcaatctcctgagtagctgggaccacaggcacacccaccaaacttggctaatttttaaatttttttttgtaggggggatggagtctcaatctgtcacccagactggggtgcaatggcacaatctctgctcactgcaacctctgactcctgggttcaagcaattctcctgtctcagcctcccgagtagctgggattacaggtgcctaccaccatgcctggctaatttttatatttttagtggagacggggtttcgccatgttgaccaggctggtcttgaactcctgaccacaggtgatctgcctgccttcgcctcccaaagtgctggctggtctcagacttttgggctcaagtgatcctcccaccttggcctcccaaagtgctgggattacaggtctgagccactatgcctggcctagtttgtttttaaatcaataacaggtatcaagaagtttggactggctgaccttggtggtcttactgctgccacctttgctctgcctcacacagtatgtgggtgtgttgggcccttctcgcaagctcctctgtcatgtgatggttccgtcttcagggctgtggcaggaccgcgctggttcagtttgctctgtgtcagctgagtaaaggatgggtggagtacaccaattttgtaacttgtaacatttggtcttgtggttttgcaaggaaggggtgatatataattagtaaggcaggagagcaaaggaaacaggaaggggatctgcagtgctcctgtatcaaagtagatctccaaagcaacaagggacaaaagcaagcacactcctcccgcccacccgtttttacttactcttatttgatcagagaactttgctttcataaacatccttgaattaaggctggaattttttggtaaaaattcctaactgaatttggtttagaagtatacagaaaacccaatgaattaattgaataatctcccttacccccttcttcagacaattctcctgtattctctcaagtaataaaagtactagaaagatcaattgtatttatcattaaatggctggtgcttataatttattccttgaatccagttaaacagtgagctttcctgataacctaggcattgttgtcccctacagtaacctgggcctgttggatgtgtaaacattttcctttgacccaggactgtgttgaaactatttgttaatcacacagcaggatgatcaatacttacaccagctgacgggacacctggcatgactactcagtgatccagtaaaaccacgccaagctggttccatagagttttcatttttgatgataggactcgtagctctcagaatcagagaatgtttagaggtgaaacttaccacaaatgtgggtcagcatctttagtttgtttccggtgtgtggggtgcagtggcggacagtgagagagccatgtgatgggaggaggctgcagagctggactttgaataatgggtagggttcagaaaagtagaaaatattgtgaaatttattttattttgtttttttgaatgaagcaacaaaaacagagatttattgaaaatgaaagtacactccacagtgtgagagtggacccgagcataggggctcaagggccaaaaatactgtgaaatttattttaatcaaagtggaacatagatatagttttaaagatcctatacaacacaaaattttacgtgcttatagcagcagttttcataagaaccccaaagtggaaacaaccagatgccatcagctcatgagtgggtaaagaagatgaagtctgtccctacaagggaagattctttagtcataaaaaggaatgaagttctgacacatgctgcaacatggctgaacatagaaaacattgtgccaggtgaaagaaaccagtcacacaaggccatgtattaggcaaatctgtagaggcagaaagtagattagtggttgtcaggggtttggggatgcgggaatgggggtgactcctatggggtatggggttttcttttggggatgatgaaaatgttctagaattagatagtggtggtggttgcataactttgtgaacatgctaaaatcactgaatagtattctctaaaaatgtcctgcctctcccagacagtgcctcctccccgcagatgttgacctctagatccttcaagattgggaccgcagtgcagtatttgagtctccccagatctcttcctaaataccagagaatgctgctgagagtgtgcattttcttaaaagtcactcccctcgttagtatacctgtgccactatcttcccacccctcccagggactttttctattcttactctacgagcctggcatactctgggccttcagagcctgatccttagcatgccatgtagttttttctttttttttttttttttttttttttggcgctgccattacctgtgtcctccaatgaactcttgtgttttgaagagggagatactttgttttcttgacctttgtaggtctagctcttggctaacatagtgcttggcacagttcaacagacatcatttagaatgaacacatggtaaagagtcaaatctttttttaataaatcagtgtacacttttattattattatttttgagacagagtctgactctgtcacgaagactggagtgcagtggggtgatgacagctcactgcagccttgacctcctgagcccagatggtcatcacctgcctcgccctctgaagtagctgagactacaggcacgcaccaccacagccagctaattttttagttttctgtagagacggagtctgtttatgttgtctaggctagtcttgaactcctgggctcaagtgatcctctcacctcggccttccaaagtgctgagattataggcacgagccatcacacctggcctttcaaattattactctgatgagtaaatcaatatgtgaagagcagctagaaaatgggagagtcggcattctaaaagtgttaggctctttcagatggaaagtaagagaatctcaggttaccatgtagtgatacttttaccctaggaagacagaggaagtaggaaactcggtcgccgcactgtcactgtgggtcttggagctcgggtctccttgtgggaaagtggcctttgtaataaaatcttgcaggtgttgcgtaatttcattagtctacatggtgaggaatagaggaggttcagagaagaatatacatgtattttgtatacctcagaattttagaaaagagaatcctgaatatttttttggaggagttgaggaagaagtaactgaggtttaaattttatctttgcagtgatgcctgttctgaccgtcttatttaaaacttaacaatacctgaccccaccccctgccacatacttctcttttccccatagcacccatcactttctagcatgttacttattatttattgtgtatatagttttttgcctatgtctgcctgtatagtagaagcctattatcactatccctcaaattagccagtgtgtgtggacaaagggcaaaccaatgttgatattaacaaagccctttcaggaaatcagtactggtgaatatacacataggaactggcacatgcgctgggtagaacatgaattgcctctcctctccctatatatgttcaaaaggtaatgaaatttttttttcttttttttgagacagagtctcgctctgttggcaggctggagtgcagtagcacaatgtcggctcactgcaacctctgcctcctggattgaagcaattctcttgcctcagcctcccgagtagctgggactacaagtgtgtgccaccatgcctggctaatttttgtattttcagtagagacggggtttcaccatgttggccaagatggtctagatctcttgaccttgtgatccacccgcctcggcctcccaaagcgccgggattacaggggtgagccactgcgcccagccaggtaatggaattttttggtgcaatttctatgtcaatcttttaacaatcttttcatgtagccagcagagggcagcacagatggaatttatgacattcagtatttttgactttattttaaagggcgtttaaaactactgtagcaaccacttctaggagtagtgtgaagtttatttcaatttcaggtttcttcttattctttctcgcttgtaaattgtgctgtttctgctttgtctttatggaggaggttatttctgtttaccttatcatcatgaatatgtcaaattaatactttccaaagtctttttgacatgtttccagatgcctccgagggctgtggtgaggttggcgatggtgggtcctgaaggggcactgttcttttgcctccagaaagtagcaattacttgaaccagagttcttcgaggtcttcccaatgctcccaggctccacggtgcacaggagactgcagtcctggctcaagggtcctctctgagcatctgaccaatgctcttgacccccttctcagaaagaaaaatccccaaaatgtacatactcaaaaccacacagtttttcagttttgtggcaagttatggaactggtcatggattttcttgatagaaactaaataagatcagtctttgtgatgcatacctctcttattttttttcttgcaagagttactggtccttaggcaaaaattgaagtaaatgcaaattgtgtacataaaacaaaggatatggtttaggttttctttttttttttttttttgacatctaatcggttttgagtttttcttttgataacaaaagtgctaaaaagtctgtgtcatgaaggtatgtactagcaaatgtgatcagaaatcccatagcttgctttgctaggtacaaggtaagcctatgtcaaggaatggcaagttctttgaattcttgttgacacattacatatatcctttgccatcaactcttttttcccccaaggtctaatagatgcatttatgtcaatacacaaaaatagtatacctctatgttttttaggtaaccaaagtagaaggaacctttgaaagaattgtgcagtgtgtccaggtgtctggatttctgcctgcagaggctggacaagtctttgttatgctccaccccaccttgcagatgttcttcgggactttggaggacacttgcgtgattgtatgccctaagctgtctcccatttggcagcttgttaggaaaggtctaagctgcagagagaggataccaggaagcaaaatgatttacccccaaattccagaaaggctgcagggtacccagcacctctgagaatggagataaggaaacgagggtggtttgaaagtgttcattgttggcagttaagatttccaggtctcctctccatctcctgcagcaaggcagtttctcttgcacttctggtaaacatgaaggtttaatttctgaagaaggctgtgaagatacagagagcgagtgaaaatctatatttattttaaaaaataccaaccaagaagcagcaccgaaaaagcccgtatatttaactgtgagattcccatcctttcttcctcagtgtagcccccacaaatactggtggtcagttttacactccacacagcccaggtaggggattggagaatacttctttgggtaactagtctaagcaaaaataagctaccgagccccacatgtggggtctctacacattactgccttatcatattacattgccacacatcaatctataggccatgcctaccacacggcttttaaccaggttattagtgtgtcactcttaaatgagaagaagtagactatgcttgctagagacttaaggaaaatcttcagtgttagcaagcaaaagagcaaatagtttaaggaaacaggtcatgggacatgtagaagaaagccttaaaaagtatatacttaagagtctcagatattaaatgaatgaaacaagaataggctgctatcaaaaaggactatgggttgagtatttcttatctgaaatgcttggaaccagacaagttctagatttcagtatttttttggattttggagtacctgcattgtacttgccagagcatccctaacctgaaaactggaaatccaaaatgctccagtgagcatttcctttgagtgtcatgttggcactcacaacgtttaggatttgggcatgtttcagggatttgagatttgggatttgtgttaggtagacagcttcagaggccatgacacgggagcgaagctggaaagtaagactgctggctggagaccagtgtggagtctggtgtactgtggacgagaacagagaaggaggggctggtgagtggacggagatgatgggagaattctctaccatcccaccgcccagagataatgattgttaatgtgtttagtatatattcttcctggcttatttcttttttcatttttatagtctatgcatttttgttacatgattttttcatttaacagtataacatagacatctttctgtctctacaaaaatagttacgcaacattttccaattactttttttaagtgccaaggaatacttttaagtaactcacaggacaaatgcccacactaaataaatacaacagaagctctgacaccaccacaccacagaagcgtagacattaaaatactacattatgtctgtctagttggcgtgtgttttaaatgataatccacactgtgcatttagctgtggctaggctagcactttattttttattttacttatttatttatttattgagatggagtcttgctctgtctcccaggctggagtgcagtggcaccatctcagctcactgcaacctctgcctcccaggttcaagtgattctcctgcctcagcctcccgagtagctgggattacaggtgcgcccaccaccacgcccagctaacgtttgtatttttagtagagacagggtttcaccatgtcggctaggctggcctcaaactcctgacttcaagtgatccacccaccttgtcctcccaaagtgctggaattacaggcgtgagccagcacacccggcctatttatttttgagacagggtctcactcttgcctaggctggagtgcaacagcacaatcatagctcactgtggcttcaaccttgcagattcaagcgatcttcctgtctcagcctcccaagtagctgggaccacagacatgtgccaccacgcccagctaatttttacattttttgtagagacagggtcccaccttctctcccaggctagtctcaaactcctgggctcagtcagtcctctcacctcagcctcctaaaggcctgggattataggcatgagccactggcccagcagggcagcatgttagaagacagctggtaaatgaaaacagttattttggaaatcagtttcatagcagtgtatagtgagccttaaagtagttcgtatcttttgaccagctcttaagcccacttagagaaatttagcctaaggaactagtaggagctgaggaggcaaaggttacaaggatgttgcagcattttacaggatataaggaaagaaaaagattaatgcccaacagtagaagtggttaagtaagttacaacatatacataatgcaaccattaaacataccagctccttcaattccattccaaccttagggttctttctagccttcccccttttcatgtttccaaattccttttcctgacagtgggaaacctggcccccaggatctggcttgagggttgcacccgacaccttccttttgcctccagctctacttcctgtccggctccatcctgctgtctgccggaggctgtcctggagggagtgtggttcctggttgggtttgaccaggagacgcaagggtgagagaagagtgaagtcaaggtgattctctcctgctggtaactgaggcttgctgaatcctctactgacactcttgccagagagctcccatttgccacttttagcagcagtatgatgccctcgcaccccgtcttgacttagcagtgatgggggctgcccctgttgctagtctggggggctttattactccttggtgtcctctctaaactctgccctcacttttataggtggtgcctatcttacctttctgcacactcccactctaggaatgtttctgtctctgggataatgattgatatgggtattatgctttcaaaaaacaaaccttccctagaatattatataaatattcacgtttttttttctactgtcatttatttaatttttttgtagaaataggatcttgctttgttgcccaggttggtcttgaactcctggcttcaagcagtcctcccaccttggcctcccaaagtgctgggattacagacatgaaccacaactcccagcctagttttgaaacattttagaccattacatgcttgtgtattcccacctaatctattgctggagggggtgaggctaaaatctatttaagggatttattaattaaaaatataaaatgtcttgaatcaacaacacttgcatcaaaatggcctaatgtgtgctttttaatgtgaatgacgaacgagtgttttcttctactttgttgatttattgcttttcatagggcctgtgctagctcctgtatgtttccgatatcatttgttcagacactgctctgaggccctagattattgttctggttttgtaatgtgccattatttttttagttattttaaagtgtactttgaaactttttaaaagcttccatttaaataaatacgtagtaatctaacactctgtttgggattgatgttatagatatgcctcatgagttgggttattatatgttttagtttcccagagacaatcccagtttatgctgactgcctgatgtaattattaatagtacccatttgcaatctcaaaaatatctcaatatggatgataaattatatggtcacttatgagtgagtgaaacatacaatttggtgatgcagtggttaaatgtctattttaaggaattggagacatgagattcattatttccttttttaacaaacagtggtaattgttgtactagagatgacagtgtggtgttgagccaggtatgccttgccatgcttccagctttaagggacgctgcctggccaggagcctatgaggtggcctgctgtgcccaatagggatgatggctattaaacgagccagtcagagtccctcttttgagaatgtgaactggaagtataacaagaatgaggcattgaatagtgggagcagaagctcaaagtcaaaaggtctggaggagcaggggacctgtgaggccatgggtgggtggaaggaatgatggggcctttaaggcagaggctgtggggagtggagatgggggacctggttggcagcatatcagaagatagcagctccaggcctggtgcaatggctcacgcctgtaatctcagcactttgggaggccaaggtgggtggatcatttgaggttaggagttcgagaccagcctggccaacatggtgaaaccccgcctctactaaaaatacaaaaattagctcagcatggtggcaggcacctgtaatcccagccactcgggaggctgaggcaggagaattgcttgaacccagtaggcagaggttgcagtgagccgagatcgcgccactgcgcttcagcctgggcaacagagcgagactcagtctcagaaaaaaaaaagaaaagaagatagcagctccattctttcacttgccaggccagaaagctcggagtcacccttgacttctctcttttacacctcacgtggactccattgggacatccttggctgtaccctgaaagtaaatatagcaagaatatggccacttttatcaagtaagccgccaacccgtctcacctggatgactatagcagccccccaactggtctccagctcctgtgctggctgtctccagtctgttcttccccacagccagagtggtcttgttacaaaggaagccacaaaatgctctgttgctcagaaccctggcagcagctatgcatctcacccagaatggaaaccagagtccttaaaatagctgccaaggccccatgcagttcgcctaccaccctcctcacctctgcgaccatatcttccactcctccctacactgttcttcctgctccagccacagtagcctcctggcccttctcagcagaggccttccctgactgcacttccacttcccccactccacagtacttattttctgacatactgcatattttacttacttgtttccccacctttcccatctcgttagagtggagacgccacgagggcaggcattttgtctctttagtcctctgatgtctcactagtggctggcacttaatgtgctcagtgaatgttgaacgaaacagataagacaaaagatacaactatctttgtaaaaactttttaaaaacaagtgactggttatgacaaaatatttgtaacatttcatacaaaggatttgtaatctacaaatcatttaaaaaatgataagcaatagaaaggtgggcaaaggctttgaaaaagcaattcatgaaagaggaaatacctcaaacttacgaaaagataatcagcatcatcagtaatcaggtcagtgcaaatgaccaacaacaacgagaaaccgtttcccactgtctgactggcagaagttaagtttggtcccatcagggacgtggcaagcactttggcagcatctgtgaaagctttaagtactcaggcctcatgaccagcttttctgcctttgggtgtctattccagagaaacgctataccatttgacagtagggagaaaatagaagtgacctgccctcttacaagttgggatcactggctgtgaatcagacctgataccagaagatagaaatgctgtttgggaatcattaaacataggttttgaaatggtgcaggctgggacttacaactgtgattttgacatactaaaccaaaaggtgacacgttgggtttatattaattgcctctacaaaacaaagtgttttttttttttaaatatatgcatatgtatttattcaactgttattaggcaagaaagaagagaatgtgatgaagtctttgccctggagtcatgtcagcaccttcagagtctgactggagacagcgccccgttgtcttgctgtagatgtgtgtgttcccagctccccagtgagacttggccaaagtctagcacttcctgcaaagctgctgcaggtgtttgcatttacaatgaagactaataggagaggggtttgggagtccagcagagagcagggtgcggaggatgggctctgcagccaggtctcgtgctttggcaagccatgcaacgtctctgggtgctagcatcctcatctgtgatctggggatggcgaggacactcaccccatgggatgttttcaggattagatgagttaggtcacatcaagctaggcacagagtaagcatgcaataaatgttatctattacgatgatgaggtgggaagctatgtctggatccagcagttctacttgtgagaatttttttctatggagataattaaagagatgtgccgaaacgtgtgcacacgtgtattgagatacgtagaagaattggaaatcacttagaagtcttacaatatgggactggttaaatattatgtctagactgagaagaataataaatgtgatagatgtccatttacagtcatgaaaaaatgttataagtaaaaataagtagctataaaacgacatataaaatatcgtgtgtgtgtgtgtgtgtgtgtgtgtgtatctatagaagagagagagaatatatataatacttataacaaaagtctggaaaatgtctaccaaaatgtcaccaatggctatctcttggtgataggattaaggtgttttttttccttgttactattttctaatcttcaacaatgaatatgtgtcatgaacatgataggactgtgcaggcaagaatctttgggtgcagcatattagaaatcataatggagatgaaactgaacttagattgggagtttggcccttggattttttttttttttttgcctctaatatctgctttctgcttttagcctgtgacctcataacatgctgtaatgattacgatctcttagtcatgctcttgggaaatgggctattatctcattgtgaggggaccagggattttaatgattccattttaagaaaatgtagtcggctttccatgggctccccatccatggatttaacctattgtggatggaaaatatttggaaaataaaaaaaggtcacacctgtactgaatacatacagacttttttcttttcattttctttaaacaatatagcataacagctgtttacatagcagttacattgtatttggtattagaagtaatctagagatgatttaaagtatatgagtggatttgtgtagcttatgtgcaaataattaaggactcaagcatccgtgggttttggtgtccatcggagttcctggcaccagtcccccttggataccaagggacaactgtacttgaaagtgaagagaaaaacagcagtgagtcctggctatgactttggttgagtttgagaaaagactagaagtgtggctactaaactagtttgactccagtgtaagattgctttcagggaagcagatggttaacacactcggaaggtgcttgagctcgacttcaggaactgggtggtggcactgactgggagtgccgcttctttggaggctggaggttgattggcccaggcgtgcagccagccattgcctgtctgttcaggaagcagctctgagctgccctagtggctggacagcttcacaggtatccccggcccctcccagtcagaccccacaggaaaacttggctcccagtaagttaccgctctcctggaagcacagaacggacttttcgtgtcccgctgtaaggaaacaagatggtccttaaaaccgaagaggaggacggtgagtcaaagccgcagcccccggccgggactgatgcggcttggggtatatggagtggagttttaggtatctcttttcattagtatgtgaaatcctgtgaggatagtttactgagccttttggggaggagttaaggaccaacctagactctggtttttatcttactgttttcaggagaaagactgcatagtctcttagtggttaggaagctgaggctctctcgggtgtgtgtgtgtgtatgtgtgtgtgtgtcagagagtgagagagaggagagagagagaaagagcgagaagagagagagatattaaggtaactcagtgtttttaaaccaaagaagttctcctccaatctttgctttcgttagagttccgccttgggtgtttcttggtagattccacttcatacttggtgattgtgtctacttcctgtatcaaaataacagttggtcagaacttctgggaattccacaaatatccagaaagaatctgatactaaaaagtaaagacattagagatcggattgaaagaaccagtgagatttgggataaatagtacttgttttgttaaataaaatgtgtctaagggaaaagacgatgtggtcttctccctttggttgttaggtgaggactgtttgaagcctgggagggcagggtctgtagaacttcctttatctgctccacacctgtactgtaaacagtggagctatgagtaatgggatgacaagctgtgccttctaaatcccaagagattctgctgaagagctgtgtcttaaagccctgggtcaacacaggagttgtgtttgtggatgtgtgtgtgttttattgtattttattgtggcaccttatcagatggtggtgttgtaatgctgcaagacaaaatagtaaaatgcgtactgggttgtagctggtaatgtgtgatatttttaagtttggaataaatatctggctatgtttcaagtggattttgtgaaagttgtaataaaacttgggtgtcctctttaggcttttcccactctggttcactataaagcacatttgaaagccccacctctaagtgcaaatgatcctggacagtgtccacgggcgacactgaaagctgcagcacgcgtgggggacgctgggagggaagcatgcacaggtgtccataacgatacttctgtatctgaagaggggtcagtagtgaggggacgtgccaggccagggctgaactgcctgcttggtgcttttctaactgaaaggtgagtccacactagccaagatctagttccaaagggaacacttttgagagtggaagaggacactagtgactatgctgggacagcaggagtgagccgggcctggccatggtccctcacgcttacttgcttctggtccttccgggtgagcctagcttcagacccaccggaggtgctgtgtaatagtcactttttatcctggaggcttcaaaagtcaacataaactaccctaatcaacagtgggagtgatgggggtggggcatgaggttaggggccgggagcttagaggtagaattactgaacagctttgctttgaccaagtaaccttaaagaactggtgcttcttcgcttcccttaccccctcccatggtatttccttgtgttgtcacctgggactgaaggcagtgttgccctttaaaccactgctaaaatagatgcccttagacattgccgtgagagacagagtggcatttaggtaggtgtaaaaggagggggacaaatggagtttcctctggcaggtccctgagatcccaggggagggcagaagttaagagtcagttatgctttccatagagctgcttttaactagacttacgccctaaagaacacgcctaagaaagggtatgtgggggtttttgaaaatattctttaaggaagtcagactcttctgctgcattaatctcaaacccacaatttttaggttaaaaatattgctttctggctgggcgcgatggctcacactgataatcccagcactttgggaggcccaggcaggcggatcacctgaggtcaggagttccagaccaacctagccaacatggtgaaaccctgtctctactaaaaatacaaaaattagccgggtgtggtggcaggagcccgtaatcccagctacttggaggctgaggcaggagaatagcttgaacccaggaggctgaggttgcgttgagccgaaatcgtaccactgcactccagcctgggtgacagagtgagactttgtctctaaaaaaaaaaaaaaaaaaaaaaaaagcttttttttacctggtacattggtacattggtacatacattcgtcagttttcattctgtatatgtgtgttagtgagaattaaccagtttaattaattgggcactattttcttaactgccataagttattattatttttagctatttaatcttgttaatgtcagtcccccttgatttgcctttttttttttgagacagagtctcgctctgttgccgaggctggagtgcaatcttggctcactgcaacctctgcctcctgggttcaagcgattctcctgcctcagcctcctgagtagctgggactgcaggtgcatgccaccacacccggctaatttttgtattttttgcagagacgaggtttcaccatgttggccaggcttgtgttgaactcctgacctcatgtgatccacccaccttggcctcccaaagtgctgggattacaggcgtgaaccactgtgcccggccttgatttgcctttgaactctctctttggcatctctttgggatagattccaaaatctttggtgtgggacctgaggcccttcacaggcagacactaagcccccttcagggtgccagttcagccctgctgtgtcctgggccttgccctgtggtgtgcccattgttgctggcctctgtcacttccatacactttatcttgcttggtatacaccattctgttcttgtccatctggggaatccgttggtccttcaagttctggctcacaggttggcccctctgaagcctcttggcatcgcctggaattctgtgagtacttgctgcacttggccgctgtggccgggtgtgctgctgctacgggcttacatgcctgtccccactggccttcactttctgtgcaggccagggactggagctgtttaaatcccagctccaagcacaggctgcgcctatggcagatgctcagtaaacgctgagctgaagtgaatctgtgtatttcagtaagagaaaaaaaaaagagctgaggatgcagccggtgaccggaatgtgaattgggctctattggtagtgtacccgaggtagattatttgtactcattgagtctttatcttacctgtaaactgatgagaacagtgtatagttcattgtcaggaaatatgcagagttacagttgagctttgttggaaaatttaaaaaagtggaaatgagaaaacattttaagctgtaagatagcatgtgtgtataaactagtattatttgtaggaaaatatgccaaatagaatgaagtataggcttcctcagtgggacactggattttcagattgcttctaaaatgctgtccttgacgtgaactttccatgttatcctttttttttttttttttttttttttttttgagatggagtctcactctgttgccaggctgggcgtgatcttggctcactgcaacttctgcctcccgggttcaagtgattctcctgcctcaggctcccgagtagctgggactacaggaacgtaccaccacgcccggctaatttttgtatttttagtagagacagggtttcaccatgttggccaggatggcctctatctcttgacctcgtgatctacctgtcttggcctcccacagtgctgggattacaggcgggagccaccgcgcccggtggttatcccatgttttaatgcgtgccatgtgattgtggtagtctctagttggacaagttgctcaggttgtggtgtttgcaggaagacctgaggtgctgtaactatcaattcatatccccctagatatttctcactcccttccttatggattttgtattttgcagaatcagaaatggttacatctttatttttaagcaggagcatgtttggcattgtacaaagcacacatcatagcaagaaacctgtatcaccatctgctgtgacaagttttgaagaggattcactctggtttgaattttataggctttcctgttgagtacaccagagatgaatgctcacggtattacacagaggattagaactgccctttcttcttaatgaaggtgaatagaaacaagggcttggattctgcccctctgaagaaagctgacccttatccattatctgagtctttgtgtagcctcccaagttttctcttcattatggaatatgaaagcacaggactggctgtgggggatcaagacccaaagtctgattagacaggagggatgtggaaggcaacaggtggaattttctaagatgtcagtatcggtggagagaaaaggcaggtatcttaggtcttggtaggcacaggtctgggcattaagagcctttatcagcctgcagcgtggtcagccgaagggaggacaaagtcagggactgtagatgcagataggaggtagagttggagcaggagtggccctaggaaacagcagagattcccgttttcatccacccctccctgtgcttcaggagggttcgcaggaacctgtgtgtggctgcaggctgacagaacctgcatgcagtttactgctggttaaatcagagatgctgggctagacctcctggaaatttttagtagtatccatctctcatttttcccttggattttgataatcctgcaaaggcaactttactggatttatagtgttcttgtctctgcctttctttctgttttcagcctagctgagatttcctttttatttgtttttttttgtttttttttttttttttgagacggagtctcgctgtcgcccaggctggagtgcagtggcactatctcagctcactgcaagcttcgcctcccgggttcacgccattctcctgcctcagcctcccaagtagctgggactacaggcgcccgccaccactcccggctattttttgtatttttagtagagacggggtttcaccgtgttagctaggatggtctcgatctcctgacctcgtgatctgcccacctcggcctcccaaagtgctgggattacaggcgtgaaccaccgcgcccgacgagatttcctttttagaaaaggactcttaaaactgccaccatcttctcctgtttaccttcagaagaactttaacttgtggggaattcatatgggttttgtgttacggctggagccattaagtaattacctgggacagagtcactaacagtagtgtaatcacagactcttaaagccatgaggtgccttagaagttatctagtctagccctggtcagttctgcaaatgaaagccattgctgtggctcctgggaaggactctgaaaactgagtccaaatcagccaggattttaagtttcaacagccactgttgagttatgctgatctcctgccttcatatattccaagttacctttttgtttttctcctgactatgtgatgcgttgattctgtagccctaggtaatacactaggggaaaaatggagacagaaaagtcaaattctgctttcctgtagatcagctggtgtgtgaggactttccctagcacattcacttcttccttaagaagataatttcggcccgagcgcggcaattgcaaatggttaacctcttatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctgggcggacagagcgagactccatctcaaaaacaaaaaaataataataataatttcgtaacttgtatcatgttcttccttcctctacagaggaatcatggaagctcaatttctgacctaaaaaaagatgcagtgaatttctttttttgagtcagtgactgttgttttttttttgagacggagtctcgctgtcgcccaggctggagtgcagtggcgtgatctcggctcactgcaagctctgcttcccgagttcacaccattctcctgcctcagcttccagaatagctgggactacaggcacccgccaccatgcccggctaattttttttttttttttttttgtatttttagtagagatggggtttcaccgtgttagccaggatggtgttgatctcctgacctcgtgatccgcccatctcagcctcccaaagtgctgggattaaaggcgtgagacaccgcgcccggcctagtcagtgactattgacgcctttccttctggtgtctaaagtctctttccctttgtgttttctgtgaagaattgggattctgagtcacagaattcagacgagagaccacatacgaaatcacagcagaatgggtgtagttacaacaggcacttcatgggcattaaaacagaatccaaggatgtttcttctataatagaaatattgggccagtctgagcaaatataagtggctgggggcatttctgtattttctttgaataaaaacttcaacatcaaattttgtgttagttgtggatccagatatacagataggcagaagaggaagagtccaggcctcccccactctctttccacagtccttgctttgaaaggtgattcctgctagcagtttcaagtgtgtccttctcagaagctccctgtgtgtttagcaagcgtaggtgttacttgtgagaaggtattctgtgccatcctgtttcaccagatgtgtcttagagatcttttcatgttagcatttacaaatcacctcattcttttaaattaccaagtagtttttaggtagtttaaaatttttggaatttggggagcatatccactcttaagtggaatttaagaatcaaattcataagtttgattcaaatcaaatcaaaaggtgtgtgctctttatgttttgctagtgccaaaaggttgtaccagtttacactctcccagcagcacgggagactgcctgtgtagcccactcccctgacagtatttcgtctcatctggcattctgattcctgccagactaatggaaaatggtatgttattcatgttttaatttgcattaaacacatagtgactgtgagcatcttcttctgtgtgaccatttgtatttctctttttgtaatctgtcttttatatcctttgctcattgtattcatctttgctttactaatttttatgctgctttctttgtgacttaaataaattaaccctagccaggtgtggcacatacttatagtcccagctattctggaggctgaggtgggagtatcgcttgaggccaggagtttgaggctgcagtgagctatgatcacaccactgcactccagcctgggtacagagtgagaccctctctctaaaaataataagttaattaatttaaaaaaagatattaaccctttgtcatatgttttgtgaatttattgtcctagttgtttaccttttagcttatgggatattatttttcactcagaagcttttcattttcatgtcgcaaatgagcagactcaccaatattatgactatactaattcatgctctattctagaattattcaggttttattttacattaacatctttgattaagctagaattcatttcagcttagttttatcccaaatggctagctggctatttatttgctcagcacccttgactgaataatcctatttttctttaccgattcaaagtgctacgtgtgtgtttcagtatttcttgagtttgttttctggtctttttcttccgttgcagtttcaattaccaaagcctcacgtgctttaatctcaggtagctacaccctcacgttaccctttctccctttcatatttttctgactattgtcatatatattttttcccatgtgaagtttaatatcctttttattatatttctgtaaacatcatgttggtaatgtaaataatttttttttttttgagatggagtttcgctctcattacccaggctggagtgcaatggcgtggtcttggctcactgcaacctctgcctccctggttcaagtgattctcttgtaataccagcctcccaagtagcagggattacaggcatgtgccaccacacctggctaattttgtatttttagtagagatggggtttcaccatgttggtcaggctggtctcaaactcctgacctcaagtgatccacccacctcggcccccaaaagtgctggaattacaggagtgagccactgcacccggcgtaaataatgtttttaaacatcgtggtgtatgtacgagaactttgattactggggtctttctacctttgctcaggtcccctttgttttccatgtttctttttcctgtctagatgagaggctggccctgctgcaggaaccagcctggcttggggaggatttaccagtgtttggggtagaatagagtttgtccagagaaactgactatatcgtgccacctagaggtgggcatccatttgtcgtggagggaggccataggacacctgcatgatatcagggactcactgccctctcatgggtcagcacctcttcagctagttctggagtgggtgtgctgccctggatctcaaaggtgcagagcttggcctgccttctgctcctcctcactgctctccttggctgcccctgccataggtctcgtctttcttcctcctacagttctgccccctgcatgggcaggagataggggacggtccaagagcagcctcatgagagcagccaagacagagaagaagaagcctgccctcctaacacactgagttggcaccagaaggatgcactcgccaggaggcttgggtcggccgtgcctgctccagccttgccctgctggtaggtggaggcagggggccagtatcctggaccttcccgcgacttggaaggctggtgccctagtcagctccttcttacacctctcccaaacttttgcaaacccggactcggggcaactctggtaagggtgatgtctggaacagggagccagtttgtttctattttgaggtgcaggtagaaatgaccttcctttcaagagatcttcaaggacttctcagagcaggaacagatgccagtttttgcttctttgaagaagattttatgctcctagcatttactaaagaataatgaggcatttttaagtgtaaggagtggaatagaatttaaagaaaaaagtaaaaaaaaccccaggcctctgttttcatgggacacagaaggaggggagattgagaatgctgactcgcctaaaagctttatgcttatcatgtctgtggtgcttggagcctgtggcccaggtgatttggggtttggggacgcctcatgggcagagaggacctttgagcagcattgtgaattcgtgggtttgggatgctgatgaaactgcgagatttgaatgtattccttgtgcctcattttccgctttagaaataaaatgattgatgcacattgcccttgcacgcttgtcagagggtcactttctggttgcacctgtccttgagcctgagagagagaactggaaagaggatgggaagtcagtagtggtttggggaattagtgctggataaggatggtagttgaaggtgtgagttggagtagggcaaaaaaccacttatttctttgctaccgcttctgaacaggagtgcagaccgcggtgcagtgaagactacgcaaagcttccagtcccttttctttctcatggcgcctggctgccgcttcttgctcttccagaagagcttctttatctctcgcccaactcaacagcagaatagaatccacctgtctcggtgtcaaattcaaaggcaccacagtctgcctggagcttgctcttccagactctgtcccttgtgttgccctttccacctctgcctggactgccctctcccaggctctcgcgtggaaccgtcttggactaacctgggccctgctcttctctgagccccactccgcatagcaccttgcagacagcatttatttggcatttacgggctgcctgtttcttttttctttaaaaggaatagtaacacatgagctcttggagggccgaaaccatgtcttttcagcattgtgtcttccacagtaactgacagggggcctcttccacagtaactgacagggggcctcgtttccatgcagtgaactttttaaaagattgttgaggccgggcgcggtggctcacgcctgtaatcctagcactttgggaggctgaggcgggcagatcacaaggtcaggagatcgagaccatcctggctaatggtgaaaacctgtctctactaaaaatacaaaaaaattagccaggcgtggtggcgggtgcctgtagtcccagctgctagggtggctgaggcaggagaatggcgtgaacctgggagacagagcttgcagtgagccgagatcgcgccactgcactccagcctgggtgacagagcaagacaccgtctcaaaaaaaaaaaaaaaaaaagactgttgaattatgagtctgagaaattattttttaaaacgttcatgttttctgttggtcctgagattcctattctgtggccagtcgtttcctgtgattctctctgatggatgtggtttcataagcttgattgtgtggtatatattgtggcatctgttttgttcagatatgaggagggccacactgcagacttcttggttgcagcttttcttgtaacttctttgtccactgacatccttttctcatgttgtctgtgcctagaattaactgaaagtgcaggtttttgccacctgcagtctctggcctgggtcaagctaaagcctttgcctaggttcacacaccacaggtaaaccccggctgtgatccactctgtcggcgtagtggaagctggccatgttaaagagagagtcatagtgagccttgcacatgatgactgagtcttctgtagagagtcacgggtcagaactcacctgctgggctctttcaatccctgaagagagtgtgtatgtgtatatgtgtatttgtgtaaaaaccagtgatgtcacctcaaaataagacagcccttaggactatgaaaagtgctatgagaatatttacagtacaagatattactgaaaagcaagagcttaatctcacatgaaatccctgggaaacatggtggtagataaccagcgtggatagtccaggctgtcttcactgagtttgtttgtatcacgtaatttatcacctggttatttaccaagtgataaagaaggtcatcaggtgatggttaatatgggtaaactgagcagggagcatggctggaggaatctgagttctccctgtaggaggtaagactcgacggatggcggatggtgaggatgagcttctgaacaagaagaaagaagcaaagagatgtaactgagtactctggtggatcccgggaaagtggaatcttccttggactgggaggagaggtgggatggcttactagacagtgagaaggaggaagacaggggcccagggacgtgttgcactgggactctcaatatacattttgtagaatgtagaattttagaatttgtttttcatggacttagtatgattcttttaaataagtactactctcttgacactaaaagaaaattgttcacactatggctgtttcttgaaagacaagatacaacgcagagccagggtatttgggtcaggcctggtggcactgcctggtgatgaggacgtctgtttgcattccccagccagcccaacccccatggcatggcagtggaggcagggcttgcagaggggcgggtgccttccatgactgatttcctaacggcaggagactggaaaggagggagggtatgggagtgtttttaggatttccaccccctcttccattgtttatctagagcaatggttcttaaccaggacagttttgtcccgcaggggacattcagcaatgcctggagacatttttggttgtcaaacctggttgtggggaattgggatggggatgctgctggcacctagtgggtagaggccagggacgcagctaagcaccctgcaaggcacagggaagcccccaccacaaagagtgacctgctccctgtgccagtaatgcccagactgaagaaccctgctctagcacggtgatttcccttttactttctctccttggttattttagaattgtttaaaaaatatctcctcccttcttagtcaaaagctgtgtgtggtctgcagtaaccctgtattctgtgtcacttaggggcctgggtctctggagttcatgcttttgggactggggtcccaaatctgcgtgtttaacaggcgcccttggtgattctcgtgccctctgaggtttgagagctgctatcctcaggctgtagccatatttcttgtcaccagccatcttgtattatcatccccaaggttcgcttgcctaacattccaacctgataataggcaggtgtcctcaaaggcgatgccacagcctctggtgaagaaataaccattggtggctgcgagtgtactgagtaggaggcgagtccttcttggtgaaaaggctggagtgtccctcgtggaagtggagggcatgggatccctggaggaagggagcaaaggatactcctcctgaagcccctccaggacggtgttggagcagtctggtcagtgccactttgcctgctgacctgatgcggggcagtggaaaggactaggcttgtgcctttggggtgacagaacatccaccccctagatccagtctcttgtttatccatgcagaaaggagagggcatctggagtaaggttggcattcttgcagtgaaagcaggcattaggcttttgcttctgagggagagaggaaagcaagtgcagcctgtgcgcaaatgctggtggtgcctcccctcccccccgggaggccgggaatgggggatagtaggaggggctggctgtgactgcattcatggaaatgagcctggaggagcggagcagcacacactcggagcgtctgctagggctgcagctctgcgcgtccatctctgcgctctgcgccagccttccccaccgggcccagcgagtttccacctgcagggccggtgctctcagcttttgttttctctggacaccttcttctctacccctgctgtgctggcgcacacatgctgtccttgctccggctctccctgcacctacagctgtgggagctcccggcagcctggtactgtggggtcgctgcacggagccaccatggcctctgacgtggagagctgtgacctgccgaggctttgatgttgctgcccagggctggccaggacactggggccgcaggagaggggactcaccgtgggtaagaggctggtggatggcgtgtggagccctgtcagcagatttcccattatgcgttgctgcctgcctgcctctcccacccagcagccagcagtaggagctgatgtgtgcgtggctgtctctctgcatgtctgtcctttgggtctgcattctatgctctcctctgaaggtttttccactacacttttggataggtatccaggcattcagtgtcgtttcttctaagcctgagacttaggaacatgccagtagtcaatttccttggtccagcttccgtgaggtttgaaataggggggcagaaaacagcgggacagattcagggtgatctcccctctaggcctgccacccgtggagtttctgttttactcggtaaggacttgggaacctttcctgggcacgagtagtcctctttccatcaatacacatagaaaaggagttggaattgtacgtcgcatttaatgctaggggtcctttccagctgtcagactgagggagaatatttcaatgtacagaaaaattcagagcattacaaagggctagcaaacaaacagatctgagccactgagggtaaagtgagagagaattgacttccaagccaccaagcctctcttttggacacggaaggggtgtcgtggcccagctgtgcaagctgacagtggttgcagctggcaggcacggggagtggcagcttcacccaggggacaggagcctgcccccttgggaggaggggcgagcaagctgttttggcttgtttggaggaagagggaactccaggctttccctgggagtgaaggagcaggccacttggctcaaggaggctagggctagaaaatggttcttccctgtggagctctgcgcccagtccctgggatcctttcgaaacagcagtggagtgctagaaagaagctgctgggaaaccccagctatgtcagctatatcaggtgttgtcactgtgagcttttagaaaaagttaaggttcttaaaatggttgttttctagtttttagcttttattgaaagcggatgttaactttatttttctaaaccaaattcgcaggataaaattttgtcacttaggttctgttactaccttgaaatgcaagctaagtctttgagttctaggatttattaaattaaattttttgataccttacttttttgttttgtgagatggagttttgctcttgttgcccaggctggagtgcaatggcgcgatctcggctcgctgcaccctccgcctcccaggttcaagcgattctcctgcctcagcctcccaagtagctgggattacagatacctgctatcatgcctggctaattttgtatatttttggtagagatggggtttttcaccgtgttggtcaggctggtctcgaactccttacctcaagtgatccacgagcctcggccttccaaagtgctgggattacaggcgtgagccactgcgcccagccaataccttccttttataagatagttgagaagggctgggtgacatcctcattacataagtgaggaaactgaggctggaagaggtgattgtttgctccaggtcacaaagtagtgagtgaaagcccaggcagcatcgcctgtgaacgtgaggagctgtcagatgagacggctccaacactgagaagaggaccgaagtcttccctgaaaatgcagaatgcagtaataaaagcctttaatagatttactgttagtggggaaactgggtagtttttgcatggaagaaatttaaattagaatagtctaaatattcatattggcaatttgccggaaggcacctctgcctctatgttgaataccatttctgctagctgcctgctaatttaactctttttggtcctgggtagtgtgtgtaaatttttttatttttattttttgagacggagtcttgctctgtcgcccgagctggagtgcaatggcccgatctcggctcactgcaacctctgtctcccaaattcaagcgattttcttgccccagcctcccaagtagctgggactacagctgcatgccaccacgcctggctaatttttgtatttttagtagagacagggtttcaccacgttggccaggctggtcttgaacacctgacctcaggtgatccacctgcctcggccccccaaagtgctgggattacaaggcgtgagccaccacacccagttgtaaattcttttaacaaatctcttaggctgcaaattggtggtgagatacttattttaaaatgcactacgcaaaagtcaaatcatagtttcttgggaaaggaactaaggtaagcagacagagaagttagaatatgctgtgaaatttttgtttattttatatttttatttttttgagagagggtctttctctgtcgcccaggctggatgcagtggtgcaacctgggctcactgcaacctccacattccagggcttacgcggtcctcgcacctcagcctcctaagtagctgggactacaagtgcgtgccaccacatgtggctaacttttgtattttttgtagagatgaggttttgccatgtcacccaggctggtctcaaactcctgagctcaagccatctccctccctcagcctctcaaagtgctggggatggctgggtgaaattttaaagtaatggtatttataggctgggcgcagtggcttatgcctgtaatcccagcactgggggaggccgaggcaggcggatcacttgaggtcaggagtttgagacaagcctggccaacatggggaaaccccgtctctactaaaaatacaaaaattagccaggcatggtggcaggtatctgtaatcccatctgaggcaggagaatcgcttgaacccgggaggtggaggttgcaatgagccgagattgcaccactgcactctagcctgggtggcagagcaagattctgtctcgaaaaaaaannnnnnnnnnnnnnnnnnnnttgggtgacagagcaagactccattccaaaaacaaacaaataaaaaaacaaatcaaagtgccgggggtattataggcatgagccaccatgccaggcctttatttttaatggtggtaaaatacatataacaaaaaatgtaccatcttcagcctgttaagttcagtagtacattcatacgttcatattattgtgcaatccagtctctagaactttttcatcttgcaaaactgaaacccgccattaaaccttcattctcccactccccctctccccagcccctggcaacatccatcccactgtctgtctctatggtagtttgactactccaggggcctcttatcagtggaatccttcagtatttgcccttttgcaactggcttaatgtcctccaggttcatccgtgttgtagcatacatcagaatttccttcctttttaaggtactaagtttgaaaagtattactgtgtttctgactcagtgagtgggaaacttaattggtttcccaaagtagatagactgtgtgaaggtgtgaactcttcagtgtattattggcagaaagtgtcacctgggcctcctgctctagtcacacccctttgctacatccatctttcttcatcctctgatcctaacatttatcctgaggactgtctcaaaatttcaggcttccagtaaaatcctggtatcattacaactgtttgctttacatctctcttccgttacattttacctgaaagatacactggattttggttgcattcttatccctgccttaaagatctgaccccacatatttgtaatgtcagcatggagttttgtgaaagttgaaaattacttttctcagtgaggggaaaaaagttcccctaaaccaagccattctccacttgcagtaatgatctgtaagaactttatctttgactcctcgactgtttttttttcttgtttgctgccttacctgcagttgttagccatgcctcacagcactgccttcttatcctatagtttttaacttaccagattttgtattattgtgggtcatttgtatgttccccaagtgatataaaagctgtagtcattttaaacagtactctgctcaggaagcaacctcttagcttactgtttgctttgaggcacagatagccgaagtaacttgcccagggtcatccagctggtgagtgtggccccaagctaggcttaggacccaagaccactccctgtagagtggcagtccccggatccgtcccagaagttgggtgaggcacccatgctgtggattcatacagccttgtgcatgatccctcgttaacatgcacacctgaagtcatcaccttctcagtggatgcttccagggactgctgctcctgccggaaggaaccagatctgtctcttcagtgttgtacccccgctgccttccacctagtaggcaagcagtaaatgcaggctgaatgcgtcaatgatgacattgttagaaagaagcaaaagaggaagatgaattgggtatgcagataaaggaaagacatttggcatttgttgggcacctatttgtgctcacagctttatcttttccatcacgcattcctcacaacagtgctaataactgcagtgccattttacagctggacaaaactgaggcccagagagattagcagtttgttgaacattggtatgtctccaaagcctgagttgtttccagtattttgaagtttttcaaattataagtcactgggattttctgggagacaaagtgacttacacccatagggtagtgcagagggaggtgaacacgctggtttgtttaaggtctgactagtaggattgacacaggtatgtggcgagtaagtgctgaatactggaaccagtgctcaggatatttggagtttcttagccctcacgccatgatcactgtatctttggaggttggaggaacaagatggtttcccagatgcgcgcttttgagcccaaagcctggtttgtaaatagccagttgttctcctctgagcaggtggtagtttctgtagaggctgtagaaaagctgggtgctttatttcattactgccactgctgttttaggcagagcttaaggttaagagagaaggagcgtgtgtgtgtgtgtgtgtgtgtgtgtgtgtgtgtgtgtgtgtgtgtgtgtattcagtgtttatgaaacttccaggtctgtaaaggggtgtggccgtgattagcaggagggcacccgttggcagcaggccagctggaggggatgaaaaggaaatggcaatgacctccttggcctgggagcaactctgactaaggtagttaccttttgtatatttaccttctccgcaaatgagggctcactccttaattactttataaaatgtttccccgcattgttggtttaaatatggacctttttatccattgaaaggcagaggctgtaagaaggatgctggttaatcattatagtggaaaaaaataaggcaagtgatgtatttgaaagctaggcagaggggtctggtgccagctggatgacctcaaagagacatcctggtcctaaagcatgccttggacacgttcatttgacggtacccacggggatttaggacagtgtggtcctggcagctgctatgtgtctgccaagcagaacctgctgtcagagagctgcgttttccgtggaactttatggcatatccccgggcatctgcctgtggccggtggagcgcgggttgcaggattttagactagagcccgccgtgtgctcatgtatcgtcctctggcttggaaagagggctctgtccctttaagacagtcctcctttgtatgccactggctggaacccatttcagctctgggtttctgccgactgttaaaatctgcaaagcaacatttaaataaataaataaatgaaagcttcccttgtgtggctttcctattcacagccaagcacaatagcgccttgttgtttttgtcactttaatcctcttcattaaattggaaccctggaaaggaatggtgatggggctgatgctggaccgtccccctgactgccagccggacaccttgcagattaacctttgtgggcatggattccgggtgcccctctggcaatgggcgaggagggcgagcgaccgggtggtgtgtcagggcggctccccctctggtttgtctccattgtgctcaggctgccggcagggacaacctgctgccctccccagtggccattcttttaaagagcaaggggttcagccgcctccctggcacaccgcctccctggcacataagcatggctgcagcacgtggcagtgggggagggaggagctgtttgttgtgctgccatctggcccatctgagccgttcttttgcagtttaaccctaatggctacacaggagagaagcggcatgaatagacgggtttcccagggtgcggacggtgctttcccagaaactcccgggctgtgaggtagacatgggtatttctgaccaccacctttcttgttccagctgtggccttcgcagtgtcctgaagacactagccaagactgtaggaatcaatcacacctcagctctccagcaatagtgttgattcttcatgctgctaaatgaaattaagcattttgtttttggatgttttttctgtccggggcagcatgagaatgaaggcttgaattaaagatttgatgttgcattgttaagtttatgcagaggaaaatacttattaaaatattagattttgcctcatctcagaataaaattccactagaaaaatgaggtgtagttcagctttttaaaataaagttcttgaatgattggttgagccagaaggggagcagcattatgatttaaagttagtaagtatggaatggagaagtaatttagcagtcatgtggcaaatgtcaggagattggatcaaaataaatgtagataaatgtcttatttattctagctacaaattggccagaagcgttttctgtctgactccaaggacacagaagggctatcttttctagtgaccatagttgtacatttttagtcttttgttttcaaattgtcatagtacatatatatatgtattttaaagcaagtattcaggggcttatatgtcctgtctctctattcccagacccactccccaaagcagccactattaattcacttttttctgcttttaggtcttctagtgggtgctgccaagttcttaaattggtgattattttgtcaagatcaaaggttatctcctgccttctgcctatgatggatgaggatgcagctcacaccattctcttccttccttctctcactgtccatttttggtagttgatcacaattttcagttcctggatttttacctttggcatatttacagcgtgggtttcttgttcatgatccttatccatgcctctggtctctagtgttgtaggaggaagctgtggggaccatttgggaccctgctgccctctccactttgcttccctcaaactttggtcagctcttccttcaccttggtaacagatagctttgcttctccagcctgggttggtctttcatgctttgtctacagggtgattctgtaagttaactaccagcgaccagcaccatgacaggaatgtagataccactcaccgtagagccaggtgcccactcaaagggagctgttcctggcgtccctgatggcccagaggacaccactcggggggcatgtttcatttcttctgtgatttcctgtagttgagtttttcctgttgcccagtcctttttattctcttgagaggaaaccgaatgatgcctgttggtatcacacagttttctcagctgctttctccttcattctctggtttcgagtctgatttcattctttctgatggcattcctctggcagccctttggcttcctgctctgacccggtctggtggctgttggccatcacagttgatggcgcttgctgtcctcaggctcctgagtcagtcccgttccttgatccacatcttgctcctgaagtagcttcttcagaaggggtgcacagaagacaaactttctgatccttatgtatctgaaatgagtctgttttaccctcctacttgactgagaatttggggttcagataattttcatttagaattttgaaagttccactgcgctatctttagtgtgcgggctcttatactgacaccagcgagatcttccctcgtgggtggtctgattaatcactctccttaacctctgtggaggttttaggatcgtctttattcctggaacttctgaatttttcctatgagaatttctctgtgggatttaaaaatatttttattcaaccgagtttatttttttgcttatatttccaggtttgcttatattttcaaacctctttgttctacaggaatgccccaactttatcttttaatccttcgttgacttttttgatgtgggggacaaaagtatgtttaatttgcaaggccgtattctttttctgtaattgtcccttttccagagttttctgttcttttaaaggttttttttttctttcttttttccccctaattatctctgtttgctctagggtgagttttctgttccctgtcttgtcctttctcactcctggcataggtgtggttatctctgtaagtgtaagagtgaagcagtagacatgttaagcggaagctctgtgcatggctgggccttgtgggcagggaggcttggcttcagggcgagtgagccagagcctgcttggggtagggttctcttaggtgtccgctgtctacatatggaggctttaccctggacaccagctccacacttgtctgctcatgagaaagttggcttcgttcatgtgtgtgtgtttgtgtgtgtgtgtgaaatccttagtgtgctaggccctgtgctgagtaccacaaacacaacagtgtacaaggcatacggtgtccctgcctttgtggagtttttattctagaagatattagcacttagcactgtttctttcctttctctgttctggaaatttgttgaaatctcttctgatggcccttctctgtgtactctttgatattgtaggtttatggatgtttttgttcctttactattttttttaaatttttaaatttttttgagatggaggcctgctctgttgcccaggctggagtgcaacgttgccatcttggctcactgcaacctccacctctggggttcaagcgattctcttgtctcagcctcccaagtagctgggattacaggtgtgcaccgctacgcccagctaatttttgtatttttagtagagacggggtttcaccttgttggtcaaacgggtcttgaactcctggcctcacgtgatccacccttctcagcctcccaaagtgctaggattacaggcgtggaccaccgcgcctggcctattcctttactatttaaaaaataatatcttggaagatagaggactagaagggcattttgaatttataatacagaagctagattgtgtccatccagaaaaattgtcatgtgtgaatattaaacccagaatggttgagtgctcagattctgaaaagaaagcaacgatttagagtttccagtttagaatgatacaagttggcttctcagggtatatagcagtcttgagatagggatttcttttatacgattgctctgtttttcatcagcttcattatatggaccttggatttagtcttgcttctgctgggtagattgtgtccatccagaaaaattgtcatgtgtgaatattaaacccagaatggttgagtgctcagattctgaaaagaaagcaacgatttagagtttccagtttagaatgatacaagttggcttctcagggtatatagcagtcttgagataggaatttcttttatacgattgctctgtttttcatcagcttcattatatggaccttggatttagtcttgcttctgctgggtagagatacattgatgatctgattaagccagttctgtagcttcaaaatcaaatcccaattattgagcctcttgcggagcagctgtttttaaaaaatgaatgttgccttaatttcaaaaccatgttatattggaatgaatatgtatcttctagaacctgaagaaattaatttcttaaaggggtcttctacttggactagaaatttttctgggctgtgaagcacagaaaaatcagagtgaactgctttaaacatgcgtttctgtagaacggtgtacgcatcagtagagttgatgttgtttttcaaaacggcttttgctttaaccagagctcacttatttgtctgactttttcctgaagcagccattttaatatatatatatatattttttaatgttgggagaactgttcagcctgggaagaaacatttggggtggtgggtttggcgggggtgcagggttagaatccacataatgctgatggattgctgagctggagtcctgggtcttgacacaggaatgggactggagagcaggtgtgtaggtgaacttatttaaggctccgtcctccaatacacacacctgagtgatcacccttgagttctcagggacgcagtttaaggcccactcttgtgaaggtgacctgggttggatttagttggtctgttgggatctttagagtggctgtctcttccagcctctaaaggaagagtgtttttcaaaccacaggactcagtatattaggtaattatacgattacctaattgattatgaaataattattttttattttttatattattattattattatttttgagacagagttgtgctcttgttgcctaggctggagtgcagtggcacgatctcagcccactgcaaccttcacctcccaacttcaagcgattcttctgcctcagcctcctgagtagctgggattacaggcacctgccaccatgcctggctaattttttttgtatttttagtagagacggggtttcaccatgttggccaggctggtcttgaactcctgacttcaggtgatctactcacctcggcctcccaaagtgctgagattacaggtgtgagccaccgcatgcagccataaaatcagtttactggactaaaccactgttaagaaagctcacagtgaaataacagacatggtgagatattatttttgatacttttatgtatggtggagattgggtcatgatgtaaaatgcatttcttttctttttctgtttctttctctttttctttctctttctctctctctttctctctctcctacctccctccctccctccctccctcccttccttcctccttcccttccttcctccctcccttccttcctcccttccttccttccttctttccttctttccttctttctttcttgtctggctctgttgcccaggctggagtgcagtggtgcgatcttggctcactgcaacctctgcaccccaggctcaagcaatccttctacgtcagccccccgagtagctggaactacaggcatgtgccaccatgcccagctaatttttgtattttttttagtagagacagggtttcaccatgttgtccatgctggtcccaatgggctcaagcagtctgcctggtttggcctcccaaagtgctgggattacaggcgtgagctacaaggcctggactaaaatgcttttcttattttggattttgagatgtttaaaaaacacttttttagagaaggttggggaaaacctaggttaaaaaaaaaaaaaaaggaaaagtcggcttttctaatgtagctaattaacccactgtacacttcactgtagtctattgtttctaccctcttgtgatttttatgaaatatttggggaaagtaactgctctgtgaatgtagtagattaagttttaatgccatgggcagaaggaaagtatgtgtatcctaactgtgctctcaagcagagatgttaattccaactctatgctgtctagaaatataatatgagccatagatgcacttttatttcatactagttcctttgagatcaattaaaataatacatttcattaagttatatcaatgtgcaatcaatataaaatattattaaaaagtcattttcctttgtttttatagaaagtctggtgtgtgtgtgtgtgtgtgtgtgtatatatatatattatttatttatttatttatttatttatttatttatttatttgagatggagtcttgtactgtctcccaggctggagggcaatggcgggatctcggctcactgcaacctccacctcccgggtttacgccattctcctgcctcagcctcccgagtagctgggactacaggcacctgccaccacgcccagctaattttttgtatttttagtagtgacggggtttcaccatgttagccaggatggtctcggtctcctgacctcgtgatctgcccgccccggcctctcaaagtgctgggattacaggcatgagccactgtgcccggcctcggtgtatattttttacctacagcacatctcaaactgggtggtgacatttcaagtggttaatgtcacgtggggctcctggccgccatattgtacagtgcagctcaggctcacataggcacccactgaaggatagaaggaccctcaaaccacccctacccttgagagtgtgggtgccctttgctgtgccatggagggaacaagagccaacacttctgagcttctgctcagcaccaggcagggtttgaggcactttaattactctacatcatcttcacagcagccttatcaagtgggtgatggtgggaccacttcattgatgatgaaatgtgacccaagtgggttacataacttgtctgaagtgacctaatttgatatttggtagattggagctaggatttgaacctggtttgtttgattctaatgcttgttcttctcatttgcccacatggcttcccatagcatgcttgaagggtcattttagagggtgtctgtccaaatctcctgttggtataggtgggggagattgagccattggaggatggcagaagtattttgtggtgagagctgtgatctgggaattaagtaactttcttctgatgataagagcacattgtaaaacatcgaaacaatgaagaaaggtatgaagcagaaagagaaagtcccatagtcccagttcccagagttaagcactgattttaggtgtatattctagactttttttatttctcagtgcatacatagtctctttctccaaacccctcccagagatggcacaaaattgttcgtacacgttgctttgcctcttgcctcccctccccacctcagggggtcatggacatctttccatctcggagactctgtttttgaccatgagggagctgaggcctagagagattaattaaatgtcagcctgaagtctcccagctggaagggatgaaaatggccaggcgctcagctaatattcatcctttttcattcatagccaacctaatttaaccttcagtaatctcttctctctcgtttttccttccaagagtttctcagagcttttctgtgtgatttaagggccttcctttcttagaaatctgataagaattggagccataactatttctatcactcagtcatttctgaaactgacttctagtttctttcttgatatctttctccttttgtggcctctggatcttccttgatttttggcgagataaaagctttcttgtaacattgccctccatttttgtagttcccagtgacctgacagcagaggagcgtcaagaactggagaacatccgacggagaaaacaggagctgctggctgacattcaggtaggagagtggcatggtggtttcaccaacgtaagaaccacagtgacagttccatttgtatgaaagggtgtcctttgcagagtgtctcctcaagacacttttgacctgccctcactacagctctgcacaaagcgtaggtgttgataatcagtcacctttcctctacagctgaggagatgcagtgtcagagaggttgagtggcttgtccaggttcacccagttggtcggttgtcggagctggagatagcctgcaagactcctgtctcctgagtagtcctctctgctgtgtttgcccttgcggagcagagtggatgaggagaggcaatgagaatgtgggcttcaggcgaagctcggcccacgccctggctctggctctgccgcttactggctgaatgatttgagacaagagagttccggttccttgaacttcagtttcttcatctgtcagatcatgaaaacacctgctacacagttggaaggacttagcatgaaagacagcataatttctggtccctatagatgtacttagtgatagcaattttacaattacaatttttccaagttcctttttgtaactatcaagcttgtaggaaataagtctagaagccaatagttggattattttcgccctaagacagcaaatgttattctttcagaattcttcacaagacattaggagtggggttaaggagggaatcctgttgcccaaagtagcaaaatgaggaaagacttgactttctctggagttgatttaagtatattttgatagttctccctgatcctttgatttctgcttcactggtagatcgtgagaaagctaagcagctctccacttaagccccacttccccgtgagagcccatccattctgaccaacagtgtgctggaatgaggagggtgggtgcggatgcacagccgatttgatcagacattccctttgccagccgcttggtggcattgttgccctggcacagctactgcaggctctgcagcctgggctttgggtaggagactttgtcctctgaattttctggcatgcttgtgtttagtaagctgcagacttgttctgaaagattgtgatgaggcagccaggttttgtttttcacacagcatatatgcttataaactttcctagaccgtaaactccttgaggtcagaggctgtattcttttctaccttggtgttttctggaatgcttactgtttggtaggcactcaataaatatttctgaaacatgaattttcctaatttactttttgcatttttgtcatattttgtttcattttgctttattttgtttttggttggagggagttatgtgagattttagaagttttaatttgatctgcatctgcctttcctgctgactctggactgtctgttttatagaggctgaaggatgagatagcagaagtagctaatgaaattgaaaacctgggatccacagaggaaaggtgagtctgccctgctgccaggtggcttctgtggttgtaattccttaaagcacccaggccttaattatgcttacgtggcacattgaaggaaaaagtcagctttgtgtctttctaattctagcaagcacatacacacccataatgtctgccttccatccttcaccgcaaggcctcctgaacataggagcttcttccagtgtttaaaaaattgaactggaggccgggcgcggtggctcacggctgtaatcccagcactttgggaggccgaggcaggtggatcacgaggtcaagagatcgagaccatcctggccaacatggtgaaaccctgtctctactcaaaatacaaaaattagacgggtgtggtggtgcacacctgtagtcccagctactcgggaggctgaggcaggagaattgcttgaacccgggaggtggaggttgcagtgagctgagatcgcgccactgcactccagcctggtgacagagcgagactccgtctcaaaaaaaaaaaaaaaaattgaactggagaacttcaaaggtcccagaaagccttaaactgctcctaaatttttatgtgaattactcccctctgttgtccactgtcggtgtgcattttaaagtttctgtttttcctttgtgtaaaggaaaagcttaatgaatgctgctgatacgatttcaaagggctggagtgtccagtcatgtctgaggataatcgtgagcttatttgcaccttcctaatgcttaagggaagaaaatgtagaaatgcgatgatagtataaaaggacaaggactctgcttttttttttccttttattttcatgaaatgttagtgactttgagagtttagttttgaatggggttcccagaccgttttctgactgcttaatgcaataaatgagctgtttccaattcactacatgtctgtatttttctaagcctaagtcttcctgtctggcttcgtaggactgtttgatttgttgttttagactcctgtgggcagtgccttcagggtatagtgaggctgagtcctccacagaaggcagccagctcaccacggccagtctctgtattgtccatttggtattttggattagtttcccctctttccattttaaacactcgtagcttaaatgaaacggatacgttggacttcataaaaatttaaaacttccgcttttgtaaaagataaaactattaaaaactattaaaagaaatgaacaggcaacagattagaagtaaatatttgtaacaaatatatctgaaaaaggacttgtatctagaatatatgatagaaaggcagcccaaataagaaaatgggcaaaaaacttggacactttacaaaagaagccatatgtgtagtagacacatgaaaaatgcttaacatcattagttgtaggggatgtaatttaaaaccaccatgaaacggtacttcacatcccctatgatggctagaattaaaaagactgatggtacctcatgttggcaagtgctagtgagaataaaataatataaccatttgggaaagaagtttggcagtttcatcagcaattcaactcctagttacttaagagaaatgaaaacatgtccatacaaagacttgtacaagaatatctatagcattcttatataaaataaccaaaagctggaaataccctgaatggctgccagcaggtgactggataaacaggtcgaggtaatagactattactcagcagtgtgaaggaatgaactgctagcgtgcagcagcacggatgaatctcacgaacattgtgatgagtgaaagaaactgtgggcaccgtgtgcttccatgcgtgagcatctagaacatgcaaactaagctgtgctagtgtgctagccgaaatcatgacagtgctgcctccgaggtggttgctggggcggggtggggtggggttgactaggaagggccatagggaacttacagggatggcaggaatattctgtattaatctgagtggtgcttcaagggtatatgcactcatcaaaacaaattgaactgtgcacttaaggtgtgtgcattttgttaaatgtaaattttacctcgatcttaaaaatgtaaaaaaaaatggcttttttctgactataaaggtaatacacctttactgcagaaaattggtaaaatacagaaaagtataaaaaacaaatttctcataaacacttatcccagagataatcaggattcatattttggtacgtttcctttctgtatattccggtgtctgcacacacatattcagaattcagtgtgccctttgtttttctcttgattaattctctgtcagttaccatagaacagcaaggaaacgcagacaccaggaacgtgagtgcatccaaagtactcagccagtgaatttgggaagacttgtaactcatgaactgcatctgaagttgtgagtcaggaagtagtctttaggttattattattttttaatctggaacttaaaatggttttccggtatcgaaagcgccaagacggaagtgattctgcacatccctgaggatccatccatacgggtactcaggctcaccctgcatttgtttctcaagcaggcattacatttgctcggactttcttataggagagaattcatgtttctcatcgacgatctgatgcattttgtaggaatgatcctaaatactatttaatcaagcagaaataatatactcatgtagtacaggatttcactttctgaaatgtatacgcgtcagttaactaaggcgatccagtagcagtaagctgttttcctttggacaccttaactggggtgtcagacctgtgtaggctggggaaagccacttagagaagtagctgcctaaggcctagagctataggggctccaagtggggcagatagagaagtgagctggctagctaatgaaattagggagccatctctggtgtgtgtcccaggcagtcatgtggcacagactgtgactggcggatatctgggagtgtgcgttctggtggctgcaggaaagcctttggtgaggactggactgaggcccaggaagctgagcattcccaggagtttcaccccttgcttctgtgggcacctctgacgctgcctcaccacttacactggaaaccatgaaacaggccttccttgtggtatttgtttggaaatactgatcaaagtaatcttcctggatttagaaaaaaatgattagacaatcattttagttaaataggaatttctagatacctggtcataacccttcattctggctgaaattaaatggtgtttcccccatgactttgtttcctaaggcagctgttgacaggggagcccagattatcttacacctggaagttctgatactactcacagttttcaggtgttcctttcaaaaggtcaaaacagcctggatgcgatgactcatgcctataataccagcattttgggaggccaaggtaggaggattgcttgaggccaggagtttaagaccagcctgggttacatagcaagactctgtctctacaaaatattttaaaaagtagccagttgtggtagtatctgcttgtagtcctagttactcaggaggctgaggccggaggatcacttgagctcaggagttaaaggttgcggtgagccacagtcacaccactgtactccagcctgggtgacagagcaagaccctgcctgtaacaaaaacaaaaacacaaaaaacaccaaccctcaaaacacttaggaatattttcttccctccatggatttagctagagaacacatgtgttctttaaggcaataacattttatgattttatttccgagcaacttttttgctctcggagattataaaattactattgatattgatggcagtggttcttaaatttgggtgcataccagaattactgcaggaggttttaaaaattcaaattcctaggttctgccccttgtacttctgagttactcagccggtccagggccttgctactcagactccacacatgggatcatgttaaacatacagcagaagcacaggccccttctcagacatagagtcagaatctgttttgttgaggccccaggtgacgtgtatgtataaacgagcggagcgtcttcacgtctgatatgctcccaaggctgctggttggtggaccagactttgagaagcttggtctgtgaatctgcatttttcattctgatacagtcaagaaaactgcctattatttagcaacttcttaaaaagttaaatacagatgtaccgtatgacccagcagtgtccacccctgggtatctacccaaggaaaatgaaaacgtgtccacacaaagacatatatgcaaatgctgatagcagccttctgcataattgtcccaaactgtaaacagcctaagtgtccatcatctggtgaatggataaacagatgtggtttatccataccatggaagatgacccagcagcaagaaggcatgtagtactggcccacgctccagcaccatgaccttgacaacattatgctaatgaaagaagccagatctgaaaatccacatcttttatgattctgtttgtatgatatgtccagaataggcaaatctgtggagacagacaatagattaatagttgcctggggatggaggtagaagtaaggattaactgtaaaaaggtgtgaggaattctgtaggggagatgaaaatgttctaaaactggattatggtgatgttgcacaacttagtaagtatactaaaaattcaaatatgtacctacagtaggagtattataagtaaattataccctgataaagtttttttttttttttttttttttggagacggagtctcactctgtcacccgggctagagtgcagtggtggatctccactcactccaacctccaactcccaaattcaagtgattctcctgcttcagcctcccgagtagctgggattacaggtgcccaccaccatgcctggctaatttttgtatttttagtagagacagggtttcaccatgttggctgggctggtcttgaactcctgaccttgtgatccacccacctcggcctcccaaagtgctgggattacaggcatgagccactgtgcccggcctaccctgataaagtttttttaaaaatcatgttaaaaaaagaaaactggctgggtacagtggcttatgcctgtaatcccagcactttgggaggctgacgcaggcagatcatttgagcccaagagtttgagactagcctgggcaacacagtgagcatggtggcatgcgcctgtggtcccagctacttgggaggctgaggtgggaggatcacttgagcccaggaggcagaggttgcaatgagccgagatagcaccactgcacttcagccttcagacagagagagaccctgtctcaaaaaaaaataaagaaaacctctgttccagggtagaaggagcaaatgagcttggagcttggagccaggttcaggcttcaggtttcagttggcctttcatagttccaccagattatgcctgttgctttcctggataaatctttcaaaaacctgtgtaaatcagtggaaatcatattagtctttcaagcctttccgatggcctgaagtactaaaatggctgtgatggttgttttacaggaaaaacatgcagaggaacaaacaggtagccatgggcaggaaaaaatttaatatggaccctaaaaaggtaagtgagaaagaagcgggaagtggtccatattagatggggtttttttatagtgctcagatagaccctaaaaacgtttttttccaagcgttacagttcatgttgccgttttgtagagcaaatgttatgcactaagcccttgttcctaaactgtgactccccggctttataggtcacttagcaagtatttattaaatattccagtgcacccacacccatttcttcctgtgccctttccccttcttttcaactgtttcccagcaaagcatcattggcgtctttgttgtctttttctaggggatccagttcttaatagagaacgacctcctgaagaacacttgtgaagacattgcccagttcttatataaaggcgaagggctcaacaagacagccatcggcgactacctaggggagaggtaaggccttggggattatgcgcatgctagggaaggctgttcaggaacgacacaaagaaacaaactcccaaatactctgaagttcttggaggggtttttgccttaaagcatctgtagccccactggagttgaggggaggcttttctggggaatagtgatgggtcttttctgggggtcatggagacatcttgcttgttcagccagtcagcagagctagccagtcttcttgcggacagtgtgcacaagtggctgtctgggcaggagccacaggaccacaggacgcagtgtaggagacatggcctggctggagattctcagtgttggtgcctgactcctgctttctctcccattttttgtcttttctcgatagagatgagtttaatatccaggttcttcatgcatttgtggagctgcatgagttcactgatcttaatctcgtccaggcactacggtgagtattcttgaggtgagcccctttggaaggagtgggaggctagcctttgatcatgagtctgtcctggggggcattttattgaaattatatctttgggtatgatttgaatattttgaagtattttggagggaagaaatctattggtctctgactgggaatgactggatggtcaaggggaattcaattctgttacgttctggaggccgattctgtaacactcttccttgagtcttatatttgaggttttagaaattgatgaatacttaaattttgaaatttttcagtttagaaaatcctttaatttcttgccctggaataagtagttatacatttcattttggaaagaaaaaagtaaaccttaattttttattaaatctgttacctcatgccttttaagaaactgtcattctgtattttcactgctgtaggtgtaaataatgacttcatcttttgtgctatcatttagctggatggaaacaatccacaattaaacctgtcagctgtgggtctttctttctttgacttaaagggatcgattgttaatgctttgacaagacaatcttctctttttctgccacccatattgtttccggaaatagcgtttgtttaaaatgagcattatctatgtttcagtcttgtatattattctgaggagggaaaccactcctcagtagggattgtttccctcctaatttttcactttttcctaagaaaaattttacttttgattaaggtaacagtggtgtggatggcaactttgcatctgttcagagttacagtaacagaaggctgcagcccagcagggttccctttgcactttgatgttaaaaaatcattggcagtggtcaggcaccgtggctcacacctgtactcccagcactttgggaggctgaggcgggtggatcacttgaggccaggagtttgagaccagcctggccagcatggtgaaaccccgtctctactaaaaatacaaaaaattagccgggcatggtggcgtgtgcctgtagtcccggctactcgggaggctgaggcagaagattgcctgaacccggcaggcagaggttgcagtgagccaagatcacgccactgcactccagcctgggtgacagagtgagactccatctcaaaaaaaaaaagaaaaaaaaaatcattggcagtttaacaattcatagagaaataaattgcctccccaagttctggaacactctgtctttacccactcaggcagttcctgtggagcttccggctacccggagaggcccagaagatcgaccggatgatggaggcgtttgcccagcgatattgtcagtgcaataatggcgtgttccagtccacgggtaaatacgatcattcatcctagtttatgatgggcgttttacactggattattttcttggcaccagataatttctaaaacaaaagggctgagattcatgcctaggaacgtttactcaatgatagttataatagtaaaatgttggaaataacctgaaagtctgacattaaggcactatgaatttaaattgtggtacctctgaactacgaaatacacagctattaaaaaccatgttttagctgcatgcagtggctcacactggtaatgtcagcaccttgggtgggaggccgaggtgagaggattgcttgaggctaggagtttgagaccagcctgggcaacattatgagaccctttctccaaaaaaatttttaaaaattagccaggtgtggtggcttatgcctgtagtcccggctatttgtgaggctgaggcaggaggatctcttgagcccaagagtttacgactacacgcagtgagctatgattgcaccacagcactccaagcctgggtgacagagtgagaccctgtctcaaaacaaaaactaaagaaacccatattgttacaaagaatttttattgacataggagaatgatattaagattagcaaaaaagcatgtgtatgtatttgtttgtttccagttttgttacagtatatatctgtgagataaatatgtggtgagttatacatagtcatatttacgtagaggaaataaagcaaaataaattattgctagatagtgggattatgggtcattacaggtcattttgttttaaacacattgtgtttttcagagtttctacagtgtgtgtattctcctttccaatctgaaaaaataaacagctttaagtcttgaatactttatatactttttcgtgccttgctcctttcagacagcagtgtgccctggagtgtacccgtacatgtggattcatctcattcttttgagaacatgtttttttttttttttctgagatggagtctcactctgtcgcccaggctggagtgcagtggcgctatctcggctcactgcaagctctgcctcccaggttcaagcaattctcctgcctcggcctcccaagttgctgggattacaggcgcgtgcagccacgcctggctaatttttgtattttagtagagacgggttttcaccatgtgggtcaggctaggcttgaactcctgacctcatgatctgcctgccttggcctcccaaagtgcagggattacaggtgtaagccactgcatctggccgagaacatggttttttattcctgatttcatctgataccactcttgctcttgcgggtgggatgtttctgaacatctgagcatgcaacggctcccctttgcttttctctcatctttagatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccgggtaagcaaggaagaatggtcttcattcaagtcaagaaagagttcactgggaacaggatcgtcttttgtaggaaggaagaaaaaacatacaatttatcaagggtctcctcttttaattttttaaccatgtgaatttcattaagaaagtggtagtaaggcccagctagggaatcagggaggggacagtggtttgtaaacatgaaactaaaagcttgaatagaagtcaggctgcttctttattttcctaattgggaaggcttatttattttgtcactgtgagctgcctgaaagcagaaatggtcataatcttctagtctcagcatctagcaggcttggcttactataggcacatgaatgcttgtggaatgaatgaagagaaaggggaggaggaaaaaatatttctagaatcagagacataaattgtcatcttttatcccagaatctctatgagagcataaaaaatgaaccctttaaaatcccagaagacgacgggaatgacctcactcacactttcttcaatccagaccgagaaggctggctattgaaactcggtaagcgcacctctgagtcagggctcctaaagctgagacttaggaagaaaggcggtgtgtgtgcgtgtgtgcgtgcgtgcgtgtgtgcgcgtgtgcgtgtttgtgcgtgtgcatgtgtgcgcgtgcgtgtgtgtgcacgcgcatgcatgttcacacacattcatggacacacacgcaccatgtaggaaagggggtggcttatagaggactccagagagactttggtatgagttctgttctaacaaaggtcggcttccaaaagggaagtgacttcatagtcattgcccccatgggacacagagactactggggacagacttactccaccataaatattgcccacatgtgtctgtgctccacatttttacccttgaattggttgaccaggttttgtttcaaggcagttccctgagcacctggtccgtttgccttccctgtccccataaccactgggagggtggccgaccttgtccatctttctacttcccatcccacagatttgtacctggcgctcctgcccccaccccagtgcatcgtcacttccttctgcatctggctcccccacaggcagtgtgcatggcaagcctagagcccttggctgcagctcaatccacagcactcttactcattcttgggcagtggttttttttttttcttttttttttcccctccttttcaatctgaatcagccacattaattattttgttcatttagaaaagctgaaaatgcatttctcttccctttgccagaagtgatgagcttgtattgctgagatttgtggtcatgccttgccgtgaaggtgacagggtaatcaataggaaagactttagtagggttttcatacacattcatgtccacatgtgtttactttattaatggtttcagaacatagagctctagactctctggacataatgatgtcctttttttttttttttttttggacactagcagggtactttcctctgttgccttctgctttagcctttgatgagttgggttctcacattagcaggggctgttccgtcctataccagcccaactgcttgccccagtgattagaagtcagtactctcttggtcattactgacacatctgggaaggctaaaatggaatcctttatttctgactaggtcagatagcagtagactttatatttccttttaaagtcatatcccaagtccttgtgcttatacataatgacttaattcataaattccccttacagcaccacttcaccgatcagttttaaatatctcttgaattggccatcattttatatatctttaagccagcagaatctttgaagttaaggctctaaaattactaaccccataggcagccttcccttccacattcctattgccaagtggatggagttgaaaggaaacctactggaaacgtttaaagtgtgttcaagtttggatttacttccccctacagcgagatttgtttaaatgctaatactaagtgttagctttgacagcccagatactaaaattagaacagtacaaagattatcttggttcttagaccaggatgacatgcaaattcatgaggcatctcgtattttaaaaaagagaaaatttaaccaagtgtgggactcagttttagctcattgcattactttttctaaacctccatcaaatccttctagactctgaatattgtgttttcattgtagcacacttagtatcactctttgtgtttatgtgctgcagaaggcagggcttccagccgtctgtagctgtgtgtatatgtctgtgtatgcatatagccataagaatgtgtattcttgtgtatacacatcagtacatgtgtactcatgggtatatgtgtgtgcattcttacacacactttaaaaagtgacagccatctcaagaaagacatttaattttccctgaaataaccttagctttctttgctctgattctggatatactagtaaacattggctttgtaaaagccgatttgtggcatctttggggccaggtttccagtagtgcctcaaatcttgccttgatgaggtggaacgtggcatgtaagagcccctcgttcacgtgccagacagtagtgggatcatttgcccgttgagtgtttttagttcagctctctccccaggcaggcatgaatgtgactgatacattgcactttaagattaaggaatcgggtttaatttctttgttttaattttcttttctccctcatttgtatgtttccatgattttggctctccttttccttgccccaaactccaggaggtatgtaaccctcagcctgctcgctcgctctgctaggccactgtcattactgcagcattttctgatttcgttatttttggttattttgttttttaattgccggtggtagtgttaatgctgcttctaacttattgtacagtccctagggaactggtcaggatcaggggtttggagcaattttcgtttttcttttttggaggagtatatgttatattcattactgaatgcagtaatgcaagaaaacatactaagagtgggtttgtaaaagcagaggaagtttccatgacattttcacttggaattattggctaagacatgcgctatgtttgatattcaatttgacgtccattaatcagcctgattgaaagttaatctctgacgtggggaagaggagaaagaagagaaggaagtctttcttttttcttcttttttcaagctgagacttactccagagagaacaaagtcttgacttcccaaagctatggaaagcttctgatttaccatgatggaaaagcaaactagggaaagaactaaattagatgatacttaagacatttgcctttgcacgaaaaggggaaatggtatttcctaaactcaaaatgataccgagtgaaggtgaaaaaaacaagtccaaaccaaaaaaccctccctgaagtcctcgtgtttagtttcctggggatcagagaagggtattaacagcctcggctctgttgttatgttttgttttgctccctcgctttttcagcgagtcctcgttaaagccccgaatcggtctcctggttatggttttggtgtctcctctccatttgctggtttttttggggaaacatattttcttagcccaagacccctcaggtttgtgcctaagcattccctgagcagtagctacacttaaaaagaacaaccccaaacacgcacagttactgagatgcttcagggacttgtcaggttgttctcaactgtaggggaagatggcatccggccttgatgtctcggggaggtcacaggaggcctgaggagccgtgcagtgggaggtggtcctgtgagttccacagggactgtcctaggcgcacattgatctgtctgcttgtttcatgtctgcttttctttccacgtggaaatgttccccgtgggcccacagtgatgctttatggtagaggtctctgtaatgcaacaaattgtccaggcataataaccaagcttttgtaatcaggcagagaatttcttctggctttgctttttctccttgatttctttccatcttgtttcttttagcatctgactcgctttttccatgatctcctatgtccgaagggttccccgggtagtgtcctgtgatggagcgcatgggaggtcagcatgggttgatgttccctttgtgccgagcctccgtgggcaaccaatggcccgccaggctggaagaccaaagttctcagactctgaattggtggagggggttcctttttaagaacaaattggcttcaatcctgaatatagtccttgccttctttatcctccttatttaattctgcccgggctttcctgttttccacatgcatgtcatagtatccatttatggttttctcttaattcatgccatctaacctttagggaccagtggcaagggctcacatgaaacttagaagttactggagggagagtctcaatttgcttgatatagcacaggatgggcaggtggagggcacgtgcttgcttacagcaaattccctcgcataacctagatctgtgtcatttggaatcttggcaattaatgatcagtcacgtaagcccgcctagggttcagcatccaagcagggtgctaaaaactggcctgaaagtccagtggtccttttacttgtctgccaggacctacgctggacattttcttttcataacattatttgcatactccccttaggtttctctggtgtgagcatgcaggcaggtcctggcagttagaataatccctgtaaaaccattctcctctttgctcagctatttgtgatgagggcaagagagaaagcatgatcggaggtatgagatttatgccccatgatccttgctatttaggaagattggagaagcggtattgtctgtaggttaagtcttagcaaaagagcaggcacaagaagtgtttctagaatgccatgcatagcttcacaggtcaaggccttagggataagttttgagtggttcatgttcagaaaatgttcccttgatgggagagaggtggaggaagagaaagcctgtggtcccgatttgacagcaggtgtagcttcattcagataggcttggggaaatttttccttccttcatgtctgtctcagcataacttcacggccccaaccccaacttttttttttttcttttttttttctttttttttgagagggagtctccctgtgtcacccaggcgggagtgcagtggtgcaatcttggctcactgcaacctccacctcccagttcaagtgactctcatgcttcagcctcctgagtagctggaactataggcatgtgccaccacccctggctaatttttatacttttagtagagatggggattcaccatgttggccggctggtcttgaactcctgacctcaagcgacccacccaccttgacctcccagagtgctgggattatagacgtgagcccctgtgcctagccatgaccccagtgttttgtgctgagaaatactaaaaagaaccaagggaggcccttgccagcctcccagccaccaccgccagagcttgttttgccatggctgtatttgccagctgtttctgttataagctccaggtgagaagcccagaacggaaaaggctcctgaggccacctctcagtacgagttgattcttccttgatagaggaattctgctttgattctcacccaggacccgggagattttgttttcaggacactagcacataaggttaagagccagtgtagaagctcactgtaatcatgaaggtgaagaagagagtagaaccatggggatttacttcgtgttccagggaaagtgtggatttgaaggctcccagcatctcccctcctgcttcctccttccttcacttccagtgaaacactccttatgtgccgggctgcttgtcagtagcagagtagcctgcactaggtgctgacccttccctctttttctgttctttggcaatttctaccacataggctttttgctgactctggcaaatttgcattgtatgtcattattgccccgggttttctcgccacaaacccatgctcatcctgccgtcccgattccatctccgggtgtcacctagatgcgcttgctctgcttgtacccacaggctttcactttgtgaaagacgcttctgtttcagctctgtgtcttgttactgatgtcaatgttgtgggctccacgttctcctgatgcctctcccccaaccctctctgagaagagagggtgtcgtgtgtgtcgtggagcctgcacttgtctggttgtctcttgtcgaacgtgcatctctttttgctctgcaggtggcagggtaaagacttggaagagacgctggttcattctgactgacaactgcctttactactttgagtataccacggtgagcacctgctagtcggcctccagactagggatgggcaaggcctccggttccaagtgtctctaatcagacatggttgaggagaccgttggatttgcccttcagtatctgtgggggatgggggagagtttaagcaaagtgcaagaactgaagtaaatctcagaatggggaacccctgagaagaggtgcgtgccttaaagggcacgggctcagagcaggcacccggttctggtgggacaggagatacctggcctggaggagggggagcactagaaatgggttttggaactgggctagaaagaatgaatttgcattggttgccgagaaagagtatgtggccctaatcgaaagggagatgaaaagaaaaaggaaataatcgtgatttagaaaattcacctattctgggttagcagaaatgtgatttcagaagaaacagcccaaggggtaaaatatatagtgggggaaaaggaagtgaagtgaaatgggaaaagtcaatttgagattatctggagttttaagaagttttgttggtttttattcagtgggagagacttatagctgcaaatttgtgttttatatacgtatatctcttttgtaataatagccaaagaaagtaaaaatcataaattagctcttttcagagctccctctaagcaaggtacccagaaccctggcaagttagcacttggtgtggagaccgtggctcaccggactggtgatggggtgctttttcatttctgccacctttcttggtcattgtaagggcaaagcgggcatactcccatggcatcgaacttttgtcttaaagtaaatcaaggccgttgagttgagaatgctttgcttttgttctccaagtgtatcttcatggagcaaaagtcattgatcccactgagaaaattaagactcagaagtatcttttaaaatcagtttagagcaaaatggggcttaagtaaaacattgaaatcctgaccatattcaccagtcacttatttaggaccaagaaacaggtacacgccttggcattttctgctgtgaggtgtgaagatgggtttctgtcgtgtctaacacttagcgttgttctccatccccatggacatcatgcacatgcagcttctcacccagggaatgcacttcgtagcccatcaggctgcaggcaagagccgctgcttctgatggtttggtgactgaggatagtaaatcactgtgaagggaattctggccgggatttcatatgttgtaggggctcagctcatgccctgcaagttctgcactggctttgcttttctgttgttatagtcttttcatatgagagtaatacacttcaaatatctgcaaaataataaaaagaaagctgctttctgcttcacccccaaagtaccactgtgaacatcttggtacaattttttctgttttgttcacccttctgccctatattttgccttttttctgaagacacctacactaacgatgtctttaacatcgtgtctgaatttgtctcgctattttctgggtcaaaatgatacataagcatctaagtggtgtacttctaagtcctggacaatcctatagcaatgctacgagattctagaatcttgtggtttttcgtgatgcccaccgtagtggtgtcaccttaatccttaattcagcaatatttattcagcaaagtgtagcattttatcaagcaatggaaatacagagaaaaatacttttttttttttgagacggagtctcgctctgtctcccaggctggagtgtagtggtggtgtgatcttagctcactgcaacctctgcctcctgggttcaagtgattctcccatctcagcctcctgagtagctgggactagaggcgtgcgccaccacatccgtttttttttgttttgttttctgttttttaagtagagatgggatggggtttcaccatgttggccaggctggtcttgaactcctgacctcaggtgatctgcacccagcagtaaatacatttctttttttttttttttttttttttttttttttttttttgagatggagtctcgctctgttgcccaggctggagtgcagtggcacgatctcggctcactgcaagctccgcctcccgggctcacgccattctcctgcctcggcctccggagtagctgggactacaggcgctgctgccacgcccagctaattttttgtatttttagtagagacggggtttcactgtgttagtcaggatggtctcgatctcctgatcttgtgatccgcccatctcagccttccaaagtgctgaatacatttcttaagacacagagaggatgctgtcagaattaagatggtagattgaaacttccacacagaattacctaacagagcaaaagactagtaaaaaaataagtagggaaaaatagcaaccaagcaggggaaggggcagaacgaattcagtgcactgcagccctgggcagcagcggaagcagcggtggcaggggcagcagtcaggagcagtgtgcagggtttctacctcacggcccaggatttgaggagacccggcagtctcgctggtttctcaggtctgggaggaggcaaactgaacaggacttgttattttttcctccctgatcaaggagtagtaaaatcccctgctgggtggacattggtgaaatgggaaaagtgaaaaaagcagccgttatagacataagtaaaggctcaagactgtatattcactggggaagactgtccatggagggtctcccatgagcatgatatccatccccaaatacaggggtcctcaacctcaggccataggacggtaccagtctgtggcctgttacgagccaggccacacagcgggaggtgagtggcaggcgagcggtggaagcttcatctgtatttacagccagctgctccccatcactcacatcacctcctgagctccacatcctgtcagatcagtggcggcgttagattctcataggagcacgaaccctattgtaaattgtatgggccagagatctaggttgtgcactcctcctgagaatctaatgcctgatgatctgaggtggagctgaggcagtgatgctagtgctggggagcagctgcaagtacagatgaatgttagcagagaggtttgactccacagagaccataataatacatcagttgcttgcagactcatcagaactctatcagtgagtggcaagtgacaattagcctgcctctggtggcaggctttatagtggcaagtgagctgatgtacttcaattgtacagctgtatctggtggcaggctttaagtcagaatccaacacttatttcagtccgtgcatggcctgcccgttattttatttaccactgccatccacatctctttcccacactgtgtacttgtctcagccatggttttggtaagcccacccaccaaccctagccaaaatgagtaaaaaccaaacgtcactggagagcttctttgaaaagggggagagacccattgatgagacagcagaacacgccaagactgccaacaaaaataaagctgcattgtaaagaaaatgccaagagttctactcaaattctaggttcatttcaacaggtgatcacattcgccaagcccactttgtagaatatgtggtgaccaactacccaacaaagccatgaaagcttcaaaactgcctcaccgcatggagaccaagcaccctgcatcaaaagacaagcctttggagttttcaaaagaaaaaaatgtaaacatcaagaacagaagcaattattgaaggccaccacttcatcaaatatgtctgcgctgaaagcatcattcttcgtgtctaaccgcattgccaaagccaggactggctgttggtgaagagttgatcctgcctgctgctaaggacatttgtcatgcgcttttaggagaggctgtggttcaaaaggtggcacatgttgctctttcggccagcaccgtaactaggcagattgatgaaacagcagcagatattgaggcacaattgttagagaggattaacgagtcactctggtactcaatccaggttgacgagtctaccgatgttgacaacaagacaacaatgcttgttcttctgtgacatatttttcagggggatgttcatgaggatatgttatgtgtgctttagttgccaaccaacaccacggctgctattcaagtctttgaattattacatatcagggaaactgaactgttttgttttgtggtgttatatgcatggatggagcggctgccgtgactggacagctttctggtttcactactcaggtcaaagaggtcacttctaaatgtgagtctatgcagtatgtcatccatagagaagtgctggctagccaaaaagtgtcacctgaacttaacaacatttatgcaggatgcgattgaaattaccaaccacattaaagtacatggcctaactcaggtctgttcatgcagccctcggaggagatggacgcagagcacacacggcttctgtgatacacagagtgagacgctctctaaaggcacatcactggccagagtttctgagttgcaacagccacttcagagatttcttctagaaaaagtcaccactagcagcacatttcagtgacacagaatataggtcaggaaacttgtgtacttgtgtgacagattaaacctactcacaaactcaatctgtcacttcaggggagagtgacaagtgtgtcccagtcggcagatcaagtggctgctttcaaagccaaactggaattacaggggtgatgagtgaacactgggatttctgacatgtttcaaacattagagagattgtgagagacggagccagggccttctttgccccagcgcctcagctttcagaagagcttgagcgatacttcccaaccacaaaagaacctgaactggaaaggaatggatctgtgacccatttgagaataagccaggtgaatcacctttgccaatgctagaagaagatcaactgcttgagatcgcaaatgacagtggccttaaaagtacgtttgagacaacttcaaatctccatatgttctggattaaagttgaggcagaatatcctgagattgccccaaaagcactgaaagcctgcttccacgcccaacatcctgtctttgtgaagcagtgttttctgcagtgacagcagccaaagagtgattacagagtagactggacacaagcaacacatgttgggtgtcactgtctcccatcagccccagatgggactatctagttgcaggaaaacaagctcagggctcccattgattctacatcatggtgagttgtataattatttcattatatattacagtataataacaatagaaataaannnnnnnnnnnnnnnnnnnnnnnnnnnnnnnnnnnnnnnnnnnnnnnnnaaaccccgtctctactaaaaataaaaaatcagccaagtgtggtggcacatgcctgtaatcccagctaccagggaggctgtggcaggagaatcgcttgaacccaggaggcggaggttgcggtgagccaagatctcgccattgcactccagcctgggcaacaaaagcaaaactgtgccccccaaaataaaaataaataaattaattaacttaaaaaaatgtaatgtgctcgaatcatcccgaaccatcttccctcccctgcctttgtccgtggaaaaattgtcttccatgaaaccagttcctggtaccaaaaaggctggggactgctgcccagatagatggagcaaaccctgacgttggatacttacaatccgagaggaaagaccagaactcggggagtatcttcgatgagctctcccaccactcaccattctctacgagactgcataatatgctagaatgcagaacacctggccgcccaccacaggtcagggtaagtggttagggggacacaagcagatcagagattcacaggaggagaaccaggggtcactcacagatttaccagagccagctggaaggccagaaaagcaaggtttccgtcttcaaacaagtgagaacccaagcaatagcatatacttacagtgcaaccattaatatataatcatagaattataacttatttattcttaaaggtaagttaaaactttaaggagtggaacaaattagctgaaaatataatcatgtcctataaatataatgtcttaaacgcttgagccaatcacagagattatatctgaaaaagacaagtattaaaacaatgagagaaaagctagcagatgcagagaacagaagacgatcccaataataccagagtaattggtgtctgcagaatcaaagatacagtgtggcatgaggtgatttccctgagaaagaggaaaaagccctgaatctgcaaatcaaagaagacaccgtatttcaggaaactgttacagaaagggtcgctccaaagcctggccccttagaccattgaacttggagccaagtgtctggtcgttctgttggaaaaagcagatcatctccagcagcttttagtcccagaaattaaagtatcaaggtctgcacagttttgaagagaagaatgacccaagaccctttatccagccacgttattgtttaagtaaagcacagctggccgcactctcctgaagaaaacatgtgaaatgcggcactttggaaccttcttgaaaaaaaaattgcttgacagtaacatccagcacgtaagagaatgaatcacaagaaaggccctgggaagtaaaagactggtagtgagcattgaactattcatttaaatacagaactaatacttaaatatacaactaatactaaaatatgcttaagttcagaatacgaaaatatacttaagtatggaactaataccaaaatatacttaagtatagaactaatagctaaatatactcatatagaagtaatagctaaataaacttaaatatagagctaatactaaaatatgcttaaatataaaacaaatactaattaaccagaaattgtggctgcaggacgtaccatgaatgttataaacctggacaatgtaaaagtgaaataataaaaatcaggaggtgggaggaggaacaatgtgaagaattagaagattttgtactttttaaaatgcagagtcaagaaatattgttaaaatggaagcatgttgtattttttaaaagaataagtaaaaccttttttttttttttttttttttgagacagagtcttgctctgtcacccaggctggagtccagtggcacgatcttgcagtggctcactgcaacctccgcctcccggattcaagaaattctcctgcctcatcctcctgagtagctgggattacaggcacgtgccaccacatgcggctaatttttgtatttttagtagagatggggtttcaccatgttggtcaggctggtctcaaactcctgacctcgtgatctgcccgcctcagcctcccaaagtgctgggattacaggcgtgagccaccatgcctggtcagacctcttaatgttttcataaacttctttgtcttagcttgaataaggttatttcaggaactcttgtggtaaagaaacatttactttgaagttcaacaattcttcagtttctgcttccttttttccccctgttaaattctaaacaattaaaatagaatgtgttttatgaaaataataccactcgaaatatcccattttcataaaacctgtttttctccatctctctgcacacacacaaaatatcttcacctaatgtcagcaatgataatttaggagtgattggatttggagtatttttaaacctttcacctgtattcttttctacaatatttagttctttataataagcaattcgtatttttacagcaacagtgattgttcttaaagacaaatttaaaaagccaaagacgttggcctcggttatttccctcttcacaggggaagggagtggttattgggcacacacaagtcatcactgaggggtgcagcctgcctgttattaggcctgccagagtccagtgaaagttctaggcaggggcctttttaatatttgggattttacattgctgcccagcagcttaacgtttagttgtttccatcagtggttctcattcttctttcactccagcactgagggatagcgtgagcacctgtctgcgatgctggctcactcaagccaattctcaagtggcaggatgagtgtgctgagaagagcgaggagggccacgctctgcaggatggagcaggaaagagggggggccaggaaggataccagaatccccagtgggttctcccggtgaccaggagggtcttcttataacctggtccccactcccaggctgaagagcatgggtgtaaatcatcttggtttaaaatcatattccatcaagaatgtgcatcatgcatatgtaacctggatgccgcaggcctcaccagtcaaagagtatacattatgtcacatacttattgaggtccaaagtgtgattactcttagaccacccacctgctcgcctggtgatgcctcaacccagttaacccagcggaatcctcaaaaggtgcaggcaccaattaaaccctagaagtgagaatggggagggtaaaaaccagaagcagaattggctgagaactgtttaggaaacagaccagctgttgccctcacctcatgcccctgagggcctgtccccaccacccaggcagaagtctgagtgctcgctcacaggagagactgaccaagcatttctggatgagggactctaggcccagttgaaggtgggggcattttccccagacaggagtgtggggtaaatgcagccttctcgaatgctgaggacttctcccacccccagcttctcctcactcagctctcagaaccacaggtagccaggtctgtagcttgcagacagagtgggaaacttctctgcccaagaagagatgcgtgaggttatttagtcagattccccagcagacagcctagtgagagggcccttgtagatggtcacagtgcacaggcttcaggtcccagtcagctcttagtcttccactcttcaaatgggacaaccaaggagtcccagatacctgaggaattcctgccggctgagagcaggtagagaccaaagcagccgaacagccaaagagcaacttggatgagagagagggaggggtccaggaagaagaagggtccaccaccagctgtgaagagactcagccgtctcaggtgacatcacagctgcgaaacaagaacaggatcctgtatgaagccatggaacaaaaataataaaaaaaaatcctcctggaaattcaaagcatggtagaagtgaaaactcaatggaaaagttggaagaaaagcattaagaaaatctcccagaaagaataaaaaggcagagggaaaataataaaggaaagacttttattttccaaagaagaactagtccaggaggtctagcatgttccagagaagctgagaaaacaaagagggggtaacccttgacaaaataatttttttaaacctcccccaaacgatggatgtgtttccaggttggaaggcttactgaataccctgcatgatgactgaaaatgaatgcacgccaaggctgcctccttagggggcctcagaacactgaggacacagaggacggcagtcgtgtgcaaagcaccagcaaccagaacagctttgtgtagggtgatattgaatgctgaaggcaggaatgctgggcttcccagtcttggaggagggtcacgtccagcctagactgttaggcacagccagatagcagccaggtgtgagggtccaatagaaacattcttagccaagtgagatttcagaaatgttaccacccacacaccctttctcaggatgctggtggaggacaaaggccttggctgtaggaaaccagagatcttgaaacctcttgtttcaagagaggagggaagagtgctctggaatggagagtgctgaggttaaggatgaagcagtttaccgagtatcaaggcaaccagtccagactggaacaggtttcagaggctccaggaaggattacttcaagaaatgaaaattaataggatgcctgatacaaattagcattagcaaggagattttgataagaggttaaccatttgcaattggttttggtggtaaggtcacagaaatataaatcaaaggaacaacccacttctccaccctccataattttggttccagtggggaaggaagcttttcaggaaggaaaaaattaggaagttcactatatggcacaggtcggaagagaaacgtggtgttaatgaagacactgtgtatagccctacctcagatgaccagatagttattttaggaggacggggaatatgaatatgcccgggtaagaggagctcagtcctcttctgtagataacatctaaaatcaagcagtcaaaaggcagttctaatatggtattttggagatgtgtgagatacagaggtaaagaccaagcaggttggcttgaagaagttggaaatagttgctagccaggatggggaaatggctgaaagactctttttcgcttttagagaactcatagaactggttggttttttttttttttttttgagacagagtcttgctctgtcacccaggctggagtgcagtggcgctatctgggcccactgcaggctccgtctcctgggttcacaccattctcctggccaaatataaagactttaacagtgctaggacttggccatgggttggctggatatcaggggactgtgaaactgccgtcaggcgtgtgctggaagtgtctgcggtgccgtgccctctgtagatgagatgggactagttggcgggtgcagctctgttctggacaggagtcaaggtgcctttggaaatccaggtggagttgtcaggatggcagtgtctctgaggattgtactgtctggcggtggggcgatggacagaggcagtgagtggttaatggtcagacccacagctgcagtcccaggcatcggggcgctagggtgaaactaggaaaggcttcctggagttgttgccccagaactgaggcttcagaggtgagtgggagagccaggcaaagggaagagggaaaggggcccgcacactccctgcttgaggaccgtgcccgggtcactgccggccacactctcacggtgtctgttgaatcttctggtctttctactcgcggaggacttagcagttatattgacaatcctcagacatttttggtgttattcttgtttagaatgtaaggagttccctcaggctgatttatgaacttcatgtcctgggagaaagcaggaaagttcggctgagtcaccggcgaggaatctgacagtgtgtgtccttaaactgtgatcttaaacttcctctcttcaactgttctgtaggataaggagccccgtggaatcatccctttagagaatctgagtatccgggaagtggaggactccaaaaaaccagtgagtatttttgctgagatattttgaggggagaaaggggatgggcatttcaaagattttttttaaaaaactcaaaaccaaaaaactgaaaagcgtgatcaggcttttatttagtctaattttttattatattgttcaagccaaagatgagactcgaaatcacttcttcctgtgccgtctgtctgctttatcgtttcacttagtgaatgtcacatggggtgtagaagttgcccctcctgcaatggcagcggcaagcacgcaggagtgggctatgtagtttatacccttgggacacctcccgtttagttttcctttgttttgggctgtcaggatgttactggcttgaagttaaagtcgtgagtcacctgcagttctctccgcattttacgtacattgcaagtggggccagcttatatcaggccggtgtgtttgcaaacgagactgacttctatacaatttacagtctctagaattccgcttctaggcttcacttttccacaggaaaatatgtattccttgtattttgtgaaggtcagaagaaaggggttttggggaaagaaatcagcatgtttctcagttaacagcttcctttgctccactctctccctctctgttttgattctcagaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaagtaagtgactgctgagaaagggcagtgcgcgcctggtgcagccctcacctcaccaggtgttgatcatcttagtggttaaacatgccgcccgcatctcttctgtgctccaagttcttagggaagcttcgtcctggttcccagctgacggcttcccaggaggcctttggattcttggctattatagcatatgtaagagagcacgtcccatctgggttccccacgtgtcctcatagacccaaaataggaagaggcgagtgagctacccacacagatgccatctgctcaactggtctttctgtgtctgacgaagccgctctcattctcatagtgacagctcagaggagatagtagtcatgttctgtaatttgtgaatcctgtgagacaccattttcctagctacagatgaggaaactgaggcccatagaggttaagaaatttgctggaagtcacataccgtgatccaaggtctgggaggagggagaagcttcctcagggttccacagctaagaagtggagctcccaagtccaggcctctgactcctacctctcgggctctgttggctccactgggccacgccatgtaaggtctatcacggggctgggaaatttcctgatgtgacaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccggggagctgcggaagcattttctaatggacacactgtctcttgtgaataggttccaggtcagcccaggagagccatagcagctgctggtgccaccgttcagcaggggtgagtgccctgcctgcagtcaggaggcttgtgcccgagctctggaacaaatcatcacttaggatacagcttccctggaaagaaattaagtgtcaggacttttagaccataagttgcttgaaagtcgagaatggcagacatagggttgtggtgttgccagtccactgcaggtgctccagcccgcggcgcggcctgcgctgctgtctttgaggctgtagcacaagcatgagctcgggccccctccctgtgcaccggagacccagccaggtccagccggtctgtccatggtgccccaccagcagcatcgtgctgggcagtgccgcctgcagagtcatggagccttagttactgagcaggtgcacgtggggggcttggaaggccccactgcattaccatgccagctatcacacaccccgtgccagaggactgcatgtgacacggcttgattacgtggcactcgctgctgcaaagcaaagtcagatgtcatcatggaaactcaagcaccagtctttttctctgaattggaatatagctgtaagaatgtggtatgattctgttcctaaatgtgaattgattattatgttgaaacaggtaaaaaccccaaaattttcttgtcacgtgttcctgtgtctctttcgaagtgtgtcaccttaggtcactgtgtggacacagcaagggtggaggacgctaacttggcctttgcagtgatggtggggtgggacaggtgttctggggcacgaggggcccctgagaaacccctgcctgggtgtgtttcttctgattctgtccctcacgtctctgttttctcccttttctgtgctccagagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctggctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagccatctttgttgttcgcggtgtctctgggctcaggcggggccctcgaggtgggaaaggggtgctgaccggacacttgtgcaggagggtgttactccagctgcaccttgagttcagttgtaacaccttgaaagtgggaggagggttctgtcttctgttaagaagagcagagtcagaaaagataagtaacttagtctttgcaccgcccccacttttttagaagaaacgtgaaacatcagttttaaattaagatcaagaaatatgccttcagtcaatataatacatttttagtatgatttcagtttccagagatgacttcataatgccagggaataaacagggaaaagtctcaggtgggctagaacccagaagcaggggaaggcgcttggtgaaccggcaccgaacagagagacagcaaagcaccaggctggccccttctgtgggtccatctccacgggctggtccgcgttcttccacacagcagcagtcatgcctgatgtttcctccttgcttcaagcccccagtctaccctgaccattccccaggtgactgccccactttactgagaagagacgaccattaggtgtgaagggcagcattcctacctttccacatcagtcagagttgtttttgttccctcccatcgccagaagaagtggcctgcttttttcctgtctcccctggatccatctctgtcaattatcctttgtcttatacatatccccagtttctttccccattaatttctttccctcaaaccacagaaacgcccatctcatttgaaaactccctaagctcaggaacaagacagagatgtccactcttaccacttctattcagcattgtactggaggttctagtcagggcaattaggcaagaaatgaaaggcatccagataggaaagaagagagattacatttattggctggtaacatgacttcataatgcctagctgagccatgggaacggggccactcccaaggctccagaactgtgggaccaccagcttgccgccccagccgggagagctgtatgtaggcactagatgccatcctgtgacagctgcggcatgggcagaacccagcacagggtggggctgctcctggccttgggggatcacattaagatgagtcagagatcattctggagtcttaagatttaatgtctgccctattgggtttcagacttacttgggattggttattctttccttcttgcccttttttcccttttggaatgggaatgtctatctcatgcctgtcccccagtgtattttggaagtgcataacttgttaaatttcgaggctctcagctggaggggatttgcctcaggatgaattgttccttgagtctcactcatatctgatctagaggagactctggactttggacttttgaattggtgctggagcaagttaggacttttggggcagtcgggatggaatgaatgcgttttgtactgagactggcgagtgtgggggaaccagtggcagaaagctacagtgtgaatatctgttccctccaaaactcatgttgaaatgtaactgccattgttacagtatgaaaaggtaggacctttaagaggtgtttagctgaactaaggaaaaatcctgcaatagtaatacatccacgaagttattaaaacgccaataaaatccatttgagaacagttcatcaccccaaagcacaccctgtctactcatcagcagcctctcctcctcttcccctggtcccgggcagtcctaatggttctgtctatgcacttgcctcttctgggcatttcatacaaatggaatcatacactacatgggccttcgcgtttggcttctttcacttagcgttacgtttacacgactcatccctgtagcgtgtgtcagagcctcattcccctttatgcccagataacattcatcgtatggagaccacgttgttattcattcatctatgggcgtttgggttgcttccgcctcttggctgttaggaggcctgctgctgctgcctttctctgcagttgtttgtgtggttgcaggactgtagaaagtaaaaagtttcctcttcaaagtttcccttcttattaaagaataaatcataagtgttagaaataatagtttcttttaaagactaacttccttcaagcctccttgctttgtgctaataactctttgttaagccctatcctaggtagctgttagacatgctcaaggcacgtagtacattccatgtccttgtaccttaaccaagatatctgtgctcacatgctcataggcatgttccagctcacagcctatgctccttccttatttgagaataaattattagccaatcgggttttaatttagattgtgaggtccggctccagccaatggagacaggacacagcaatagaggcctcatgcatatagaatggatattctggcgtctctttattctgtgtgtgccctccccattgttccatctgcaagggacaccctttctgcagaaagtaaaaattgcctcgctgagagaactttttgtctgaatgctaatttttccttgtgacaccagggaacaaacattttgcattgctaacagggactccgacagttcctcgttgcatctatgtcctcactttcgttcactcctcagccaggggtccccctcctctctcctcttggctctggtggattagtctacctgggctctcctacctctctgacagctccctgtgcgttctttccctggcctctcctctctgcccacccgccagctgctggacatcccccaggattctagcccccagtgttcctaagccctcttccttgacagataatcagtcccgcgactgaccctgctgctacccgctgtgggcccctatgtgtgcctgtgcaattccggcccgttccaggctcccctttccacctctgactgcttgtgggacgtctccaccagagtggctgccgggcctccccagctcagcctgtccacagctgatagccccaagactgccccttgtcctggggactctgctgccaccctcagagagcctgtgtaggcttggagccctttctcatgtgtctccccctctctccctacacccaggcattcccaagccctccctgtggacctctggagtggctcctccagccactgtcgccgccccaagaccttcatcacaggcctggcccgcgggggtggcttccccactggtctgcggacctctaggctttgccatcttctactccgtgattgatgcggctgtggaattttcatctactgatcatgtcattcctccatttagtaaaacaagcaaacagaacctgtccctttgcttgcagaagagaacgtgaatctgcatgatgctcaaggccttctccaccaggctctgttcgccttatctctagctgtttctatccttaactgcgccctccctgccctgtgtcccaagctcttgctccacagccaccgtttaatagctaatagctttgctcatgagacttccttttgccatctcctctgccagcctgtttgtgcaaaaccttctcattcttcgaagccttgcgccgtccagattggcccagctttttccccaggctgaagggcctcctcgtgctcctgagcagtgagtccactcggttctgggatggcttatgcggacgtgcctgtctccatggttgtgttgggagcaggagccgtgaggcgtttgttccctgcttctaacctgatggagcaggtcccatgcgcccagcgctgggcttcatgcctgtcagtgcgcgtgaggctgcacgtcacagagagctcacctagtggggacatgactcatgaggacacaaataagaacaggaagtcccaaatgtgcgctccaggttgttcggctgccctgggatgtaacccggagctttcctcctcctccgctctcctggaacactcatattgacccggtcgtggcacagttagaaggaggggataccacatcctcacacagtggcactcagaaggaggagcagggagcgaggggcagccagggccccccatgcttgcctcccttcatcaaggaggaagtgtctttccccggattccctgcagacgtgtccttacgtttcagcatcaccctgggtctcgtctccacctctcagccaatcctccgcttaggcccatttgatgcctcactggggctgggcacacatcctgcagacacagttggggtaccgtgggccggacgccggcaagcagagggtggagaatggatgctaggtcggcagaaaggctgtggccgccaaaggtggagactgggagcagtgagaacccgtgtctggcgctcagagtctgggtagagcagacatgagaaaattgagtgaagtgatcccggggtgtggggggctaaccccaggagcaaacaggtgggcggctattggaaagagcaagcggaggaggtaacttgaacgggctgatgagggaaggccccactgagaagaggttgctgagctgaagaggaggccaccaggcaagggcccggggcgccgcttagagtagggtagctagtggtggggtggagggatcctgaaggaattgctgggatgggctggctaaggcctggggtggcaggggatgcagaggagaggtcagcaggggccagatggagcgggaccagggccatggtaggggacgtctgaggtggcgtggagcttgggggctggagagggactctggctgctggagggagaattgttgggggaggacagtgccagcacgaggctgtgacatgactcagttgggggtgatggggattgtactgggacaaccgtgagagaggtgtaggggacaattaaaaattcatgatgtgccttcgagggaggggcagcagaacttggaggtagaaatggagggagaaggagaaatcaggatgagtcctaagtgttgggcctgggcagccgacaaggacagacttgggctggaaatccaggttctcttctggaggtgtcaagaagaggatgactcttataatggccggcaggtggggagctggctggtcacattgggagctctgcagaaagatgagtgaccacctactggtcacatgtggcttcccaatggtccacctggggaagggcttgtggttcatggcctcagtaaaacttgtttagtcctaaacgggtcatgttaagaattcctttgttatttttcatgctttaaggcccaggaaaggcctgggcaaaactcttggcaggcttttgttacatcccagcctttgtataagggggccagctctctcagcttttatttttgttttaattttttttgagatggagtctcactctgtcgccaggctggagcgcagtggcatgatcttggctcactgcaacctccacctcccgggttcaagtgattctcctgcctcagcctcccaagtagctgggaatacaggtacgtggcaccatgcccagctaatttttgtatttttagtacagacggggtttcagcatgttggccagggtggtctcgatctcttgacctcgtgaaccgcccgcctcggccttctaagtgctaggattacaggcgtgagccaccgtgcccggccggcttttaatatttaacttcaccacgtggtcagtgctgaaacagttgttatggaggcctgcgttagtgagcctggcctgccacaaacccacaaacatctaccagtgtgatctacaccgttaacagaatgaaggagaaaacggggtgatcatctccatcgatgcaggaaaagcattggacgaaatgaaactccaccaggaaatacacccaacggggcaggcgcagaaggaaccctttcaacacaagcaaggcctactgcgggacacacttgagacagtatcgtcccctccttcccaggccccaaagaaggactggggcaagtccagcctggtgagtagcagagttgatggggacccgcacacagggcactgccggacagcagcaggacagctcgagagatccacgccgcccccatctctaggctgcttttacgctgattttctggctctttgcctactgtgtgtgtgtgccatgggacttttccttggcgggttctcagatcctctctgggctgtgtgggttctcagggacacctactccttggctgggcaccgtggcgtggactcaccatgtggccttcagggttcaggcagcagacatatgcccttaagtaacctggtggaggacctgtcacagtacaaggccatctatgaaaacaccacagccaacctcatactcaacggagagagattggaagcttttcctctaagatcaggatcaagacaaggatgcctgcttttgccacttctcctcaacatggtcctggatgttctagccagggcaattaggcaagaaaaagaaggtctccaagttggaaaggaaaaagtaaaatgatctctgtttgccatgccatgattttacatatacacacacacacacacacacacacacacacacacatatatacacacacacacccccacacacacaccccccacacacacatatatatatgtaaaaccctaaagattctacacacacacaaaaaaacggggaggtaataagtggatttggcaaagctgcaggatacaaactccacgcatgaagcggtggcctggggggaggagctttggccacccctcccaagcccaccctctgaggttcttgggaagtgtttctctgcctccatgtcaaaaggtcctgctcacgtcctgccctgggtggggcagggagccccagtgctcggggcctccccaggatgtttgggttctcagggacacctgctcttggctgtgctctgtgtccacacccaaacgcatcttgtagctcccataattcccacgtgttgtggaagggacccggtgggaaatgactgaagtgtggggacgggtcttccccgtgctattctcatgataatgaatgggtctcaccagatctgatggttttaaaaaatgggagtttccctgcgcaagctctctctttgcctgccgccatccacgtaaggtgtgacttgctcctccttgccttctgccatgaaggtgaggcctctccagccacgtggaactgtgagtccaattaaacctctttcttttgtaaatgcccagcctcaggtatgtttttaccagcagagtgaaaaggaatgaatacagctgggcaacatggcctgggctaaccacctggccttcagggttcaggcagcagacatacacccctaagtaacctggccctggggcccggctgccctggggccacacatactctctgcgttgctcaaccaacaatgagtccttgagggctgtctctggcagctccggcctgagtgcagcagcgagctgctggcgctaatcaaggcaccagcctgtctctccaccctcactcccagaccagcggccagtgtcacatctagaggatcaagctcaacctcccctccatggtgacacttgacaccaccccaaatgtgctcccagctatcccaccgcagcctcctgctgaccgaaatcaagactgttgaggcagaaataatattcttccttttttttttcccaatgttttttcttttttgactgctctggcagagcagggttaccccataggcagagagtagctgaggcagaaatactgtgatctggtttactggaaaccggaagtgaggatgaaccccggcagacatgccaacaaaggtgggcgtgtcctggggcctgctccaagctggaagccttttagaggagagtgtagagggggactcctcacattggagctgtccttttcactggacggtacaatacagaggttacagtcactgactgcagatgacaacatacaggctaaaatgtctgtgagcaagacagtcagtaaaacttcctggtttcagaatccatccttgtcctttttgatgtctgtggactgcacactaatcagaatgtcaacagcctgaggaagtcgtgataagattctctactgagggacaggatgccgccaggaaccacaagagcttccccgcccgggcaggttcatttggaaacccctttgcctttaaagtaaactgccacatgtgacccgataggttatcagcacgccacagggacggctttgaggaataattattcagaatgatgccttttttcttttctccttttaaatctccttgcgaggtctggtcgagatttagcttccatggctgttgatacttgaagggaatcaagccttcccaccaggctggtgcaggatgagatgctgggccccggcaggtgccagccctcttctaacacccattctctaactcagtcctcatagcagccccgagatgaaagcagtgctgctagggctcattgctaccacgatcacagccgcccgcagctctccccagccccttccctgcccagtggcacctcatgacttattcctctgtctccctgtcccaggatgtaaaatcagtgagggcaggagctttttttcacacctatattccctgtacttggaacggtgcctgatagatagtaggtgctcagtacgtatttgttgaataaatgacaatgtcatgaatgaatgcacgaatgataaagacaggaaaaccgaggttcagagacatttagaaacgtacgtatccaggggctcgcagaaacagggaagtcagaattgggccccaggtcagccggatccccaaacccaccctgtttccagtgtccaggtttctccaccacagattcagagatgggaactaagttgacatcattgttggacctgttccaaatgtcttgaacttctgagctaacaaataattattggagcaattgaagctgagggtggatttcatgtttcccggttcatgccctgtgtgatttaacacgtctgacggctgcagcgtcggaactagccgccatgagctagaggtgccccttgcgtagccttgtccctggtgccttggacaccacggacagccacgaacacccagagaggatctggtctcccgccccgggaccacagtaggctccacactggtttccctccagccagtttcccatggtgttgcctggtcttttcagggctcagataatgtgattgtgtcccaccagccacctcctggaaacccctcaaaacaccttcctgacaatggggtagccccaaactccttagagggggagactgcacctcccaggctggagtcccttttggcctccccattccatctcctgcagcctcccccgacagccctgctccagccatgggactgaggggacctggaatgctgctgccttagccctgctcattcccagccatgggtctcgcccacccctctcccagccaggtgagcgcctgctcattcttcaaagcgccttctcatttattggtggaacactgctctagtgcacaccagccccgtgggtacagagataaggacggcccgtgggagggttcgaggggctttacaccgtccacaggcagacaagcgtgcatgtatgtggatgatggccgcctcagggaatcacccggggccttaggaacccagcctagggccctccatcctaagctggggctgggtggcaaagagagatgccaggagggctcctggaggaggaattcccctaaaaccgggaccccagcttccttcacccgagagccccccgatgtcatcagctttgttcaggtgcttgtgtgacgcaatgctattaactcacaccgaaccgaatccactcacacctgtcaggtattcgcccattcatgctgatgatgtcttagagcagcgcccccgccccatgcttgtgctactggtttctgaactctgcacgctgccttgttcaagggtaacttgtgtgtgtctgctccatagcatctggtgcaccctttcggtcacaggaaaaggggtggagaccactaagttctcacattgtgctgggcaccgtcggtgacagcagacatcacacatcacagcccgagcccattggcctcactcaaggtgcagacaaattagccccctgttcagggcccaagggataccatggagacttgagggggcaccttcctgaaataccagtgcactgcaacctctgcctcccgggttcaagcgattctcctgcctcagcctcccgagtagctgggattacaggcatctgccaccacgcctggctaatttttgtatttttagtagagacggggtttcgc

SEQ ID NO: 341 - DNA, 3447 bp, Homo sapiens
taccgctctcctggaagcacagaacggacttttcgtgtcccgctgtaaggaaacaagatggtccttaaaaccgaagaggaggacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctggctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagccatctttgttgttcgcggtgtctctgggctcaggcggggccctcgaggtgggaaaggggtgctgaccggacacttgtgcaggagggtgttactccagctgcaccttgagttcagttgtaacaccttgaaagtgggaggagggttctgtc

SEQ ID NO: 342 - protein, 402 aa, Homo sapiens
GNKMVLKTEEEDVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 343 - DNA, 77834 bp, Mus musculus
  misc_feature (1)...(77834): n = A,T,C or G
ataccaattaactctgctttcccaacaataagaccccggtcttgccaagatggagtaggcaaatggggtgatggtgtgagtcccatactgccagccctgttggcaaggcaccagaccatggtagagccagaatgcaaatcatgtagctgaagccccctaaatagaaaatctgtgttgctgggggcagggggggtgacttggagcggtaatagttcacaatagcagcccaaagagtagagagaatgtggtagcctttcctgggatcctttggggcaacctgcccacacaggtggccatccccagcacggaaaatgtcatcctatatccagctggcaaatctaggcttttatgggtgctacatatatcggtaattctgtcactgtcctgggttatagatgagtttggatacattcctgcactaacaggaatttgaataaacgctgaggccagctgctttaagaaaatatggttttctccaagttgtacaaaattactgcatgactatcacatcttccacctaagagaaggggactgggtttcggaaggagccccgagggtatgaagacgtctttgctgttaattggtagtacacctacgagcgtgtgacctagttcctcagccgtgtctcacatttccataaaggaaactattgtcattttatctacaagggtacggtatctaggacttgtgcgatttttttgcttaacattatctttattccccgtgtctgttggtaaaaggcacacaccaagcgggacaccagggcctagtctgtgtgtgacgaaaacagcgttcagtggtttggatgaacgttcttgaaaagtttgtgctcaccaagtcacaagttcacaattgtggtgtggatggagctggatggggcgagacagcgcctccgtgcatcccaagcagtctgcaaacttgccaagtaaccaagggtcttcatttcttttcctgtttttgtgttaaatgcaacgtaaagtttacgttttctcccagttcaaggtacagtctgtcgtgatgggcaagtcaaggcaaccggaaattgaatcagccgaacagacacctgctgtcagggagcagggagtgaagactgctcctggccgctcagctcccccacacatgcagtccaagagcccagtcagggaatggcaccacccatactgggtggatcttcccacaccaattaatgaactctagataatttcttagaggtatacccagaggtctattccccaggtgattctagattctgtcaaattgacaattaacattaacctttacaccgaagatgacaacagggagtcccccactcgggccccaattctccagactccacctcccacgtaccaggattgcagatttatgctacaactctagttcaattccaagttttaaaggtgataacaacagctgagagttattggatcctcattctgtcagacacaatctgaataatgccccggacacagtttgtactctactcaactttgaattgggtgcttttctcgtctccattgacagatgaagacattgaagcttttggaggccagaagtagccagaagaggcaaaggtcacagcccagctctagtctagacacggctcatgcttgtcgcctgctactccacctctttgtaccctgggtggttgagaggttaatggtatgttccgcgcagtgaggacaccaaagcctgagagccgtgcttgtatgagtgttctgagtgtttgaaacccagggcatcttttggaattgtgtccttacctctataactcagttaagttcaattttaaaaagttctccaagggagaaagcattattagcgctaaggtttaggcatctacatgagtgctgggtcctttctgaaggggaatagtggatagtggttgccagccttctgatctctctcagtactgtggacttccctgaaagaaataagaaatgtctccattctctctctctctccctctccatatatatatgtgtgtgtatacatgtatgtgtgtgtgtatacatatacatacacatacacatacacatacacatacacatacacatacacatacacatacacatacacatacacatacatatacatatacatatacatcaatcacattatttagaattcctggaaaggattttctcctggaactgccacatgagagctggctgccttttgttctttcctaccagtcagctgccagctccccactcagctgtgctcctccctctcccaatgggtcccttggggtgcttcccacccaaggcccctttgtgaagaactcttccaggctggtttcccaatctcggggaacatgtgtttcagatccctgatgaaaagcatttccatgaggaaggaacttctggatggtttcttctttcttctctacctctcctctctggagttatcactctaagcccggagctcttgaacacgtgtgacttcacaagcttgacacactagaaggcaaggctttgcttctctcctcttcactctctccaaggaaaaaggagtttcagtgtgtgggagccaatcccgagggctgagcagagctgtacatcaatggctgtgttttccactccattctgattccatcttgaggctgaggcttggtgtggaggaagcacagctggttctccaaagattaagctagacttcacatctctctctctttgagcatcatgacatagcatccagcgtgaactgtgatatgagcaaagctgacatattcccttttgaggctggttttcatctgtcagttttacaggggtgccatattgggaggtacttgggaaatgaaaaaaaaaaaaacaatatgagtaattattctgatacactgacacactggacacctaaagttgcttttcaagatttatgtctctacatattcatggaactcatattctagacatacacacacacaccatctagatttgaagttattagtgttaattatgataaggctggaattcctgtgaattcattatgaaactgtcatgggactcactaagccagatatctgtggataactgtaggaatgtactcaaactgtgtttacttgttaggaccaagttcccagtatgactcatttgagtttttcttgcttttcggtactggaaaaagaaatgcaaactaatgtgtgtttgtccacaattcccgttaggacccatggatttcttggtttccatggctgaagattagccaaattttctgttcctacatcttggttatctacttacagatgcaaatagatgcagagagtgtgagtctatctccaagagagaggtcagccacctttccatgtccctgcgtgctttcaggctttggcagctcagtggctttccgtgcccttccccttcccaccctgcttcacacccggagcgagccttatcccatccaccccttcattcctttgtgtcgggatacctttacagaggttagcagatggagatgtctgaaaatgcagacctccctgtgggctgtgccttcctccttttcttaaagaaatgaaaacttgaagccattgcatgtattttctttaccttgaaagatatatatatatatacacatacatacacatacacatacacatatacatatacacacattgtactgctggtctttacagtggtccgtgaaatgaagattccgtttgagagagtcacaagatggattctgagtggagtttgacctaagcagcatactgtgtggaatgttcacactggcaagaaaacacctagcttgacgtatggtgagccaaaggccactctgcacaatcaaccacatgtgtgacaacagggacggaaagaaatcaagagaatagagtgaccctgtcggcattttaagtgtcccgtggatgggcggagaagcagagcaagctgaactaactagaattagacgttaaaaggatgtttttggttaaaaaagagctgtttagttctttaatgtaaattttgggcagccttgtctgacttttaggcaaaagaaagctaataaatgagctttactgctatttttttctgtaaggatccatatttgagatgtcaggaagttacctgattattaatgaaatataattattgagctctggctgtattcagctccatgacaatgggtataatgaaaatgaaggagacagacgtgcatatttcagcacatgccacgtaggcacccaggctgcggaacagaaaagcgttgtcttgtaggggagacaaagtttctaaggagatttttcctgacagctagtttccgtgtgaggagagaaaccctgagaaatatcctgtccattcgagtgtgtcctgcccctgccatggtctgtgacctcctaaggtctccctgacccctaagattctacctggtgtcctttgtggctctttcagctctctctcagagctccctctcctaattccttggctgttggcttccagtcctgggttcattagcaggtgctaatttcatcctggattcttgggaactgaagactcagaaaagctaggacataaagccatggtgactggtgacactgctgctcctttgaatctctcatgctctccccttgtttcctgagatggccccttttattcctttagcatctcccctcttctgtcagggctgctccttctacaactatctgcttgacttccaactccccaaacagaatggataaagaaatccatcacttcgtctctgcttcttcatctcccagagtggggcacgtcttgtgggtggactgacttggcacttaaaaatgaaggtgagtgatcatggggagggtggaaaagacttcacagagaaattatttgagtgtaaaattcaagccatacctacagaaaatcctttttgaagtttgaaattgtctttattaccaaaaaaaaaaaaataaataaataaaaatctgggtaagatctggcaggatgaagccacctggaaccctagtgatagcatagaatcctgtgccatgggggtaaaaggttgttgttaggggcttctgctgcacggttgttcaagaacacgggtctcctgtcatctgtgccaatgccccccttcctccatccattaatccagtgtagcggacttaaattgagatccaaatgataggatccccacagccttacaggacagtccacatttctacattccctagcccagaaaacaatgacaggcacgaaaagatgttcagtgagattaagaaaatgggctgaccctgggtgtgaagaaggctcccgaactctgcagttttgattggcagctcctcttcgttttctgtctgtgccaagtctgatttgctgtgagaagaatacgtgatgtctaaactgatgggtttgaaaatgtcgcttggtttgtggattaggccaatccatcccacattgttggggctgcagatgcagttgaatggctcataattatagcctaagaaactgcagacagcaatggagccaagccagacccccgttctccttatagcccatgccaagctgtctcccacagggaacgagggtggttagtctgcagtgtacttgctcaggacagcacagaatcttgctgaaagcttcccggtcacctacccgttcagatgcaggtgggattgggctatgtgtggcagggataagcttaatattctcttctggtaactagaagggctatacatggaagccactaccagacttccatctcactgaaccatgtagagatgagggtctgaggttttgtctccagtatgatctagaacaataccctttctctcactttcaggacatatacaaacacataggttttcttcctcagtcagtgctggaatttctcaatcaaggctatcgctggttagttctctattcaagaaccatggaagggtgttgggttttaaaattcagcatgagagttgtctgaactctcccaggtgtcaattcagttaactgtggatctaatctgttccacagagattagaaaggaagccttaaagtgacctctccaatattctcccggattctggatcctaaagacaataatgatcctttgctgttttctgacaaagctttgcatacattgcctcatgccgataatcttaaaacatgggcgcttttattttccctgcatcaaacacggggaccctgagtttcaggattaagtgatttactagcagattaagttggttaagtttaaaaaacaacaacaacaacaacaattcatacttccgaacccatacgcctcactgtctctattttcagttttctgggcagaatagaccctcaactcctccccagcctcctctctttctccccaactgcagctctcttatggtccattgtgcattgttctcctcaaacaatagctaatgagtcggtattacatgttaggaagatccagggggtggttttagcccctgaagcagagatgaggttgtgacaccaaaaaggttaaatagctttggtgaggtcacagagccagccttcagtcatcaacagcaccttctgactccctggttcaactcctaaactgaccccaaggccctttggaattacattttaattaatagttaatttaattcccccccccaccgctatgaccaattttccattttattgttgcttggtgatatggaggtcctgggtatttttcttacctctgtgctttgcactaaactaaacaaatagaaactccttggtacagacagagttcagtttttgaagtgcttttcagagtatgatagggacagtaggttttttttttttcttttttctcatactgaaaggggaccacaagtgcagcttagacaggttgttaactgagaggtgtttttttttttttttttaatcttacatttataccagtaagtcaacatctatgagtcatgagtttgcttggcatcagtcgttagtggtctgaatgtttttgtgcctactgtcaatgaggcatatttttaaaggttcaaaatgcagtttgaattctagcacacttctggagaagaagcttatgttttccaagattctttgaaattgagggtatttttatatacttcatgagattggagcaggacggagggaagaacaaagggagattattattttttgtaatgtgttcctggtggtgaggaaatccctgtataaaggtgactcttgctttggtgccattcgtgccttttgggtcctgagatccatactctccaaggtttcacaaccgttgatcagatttaagtagctagagtctaaggacttttcaagatacaaatctgtcttctcccagtagaaagcaaactttctccccttggccccaccactaagtgccttaaaacccatcagtcttgaaatagtgtgctcaggtatgtggaaggcaaaactttctggctggtaggcaaggtgaaccacatatggaaggaagtggtgtggataggagttctatttcaccataagaaacaaagggcagctctcactgcagagttattgtcatctcctaggtcatgttcactacaggcagcatacaagaagaggcccagagcaaccagtaaactgatagtgcttcactcgagaaatatttattgaaagtctgtaatgtcctaggcttggggaaaattgtatgattttttttttggaaggtaaaatatagcaacggcttttaaactctgcaagaatgtttggggaaatctacttgtgttataaggagaatgcaaattccatgtgtccaacattaattaagtgatcaacagtcccgattggatgatcagtgtcctcaaaatgtataaatatcttaactggatctctgtcagtgcttctcaccctacagtaagttccaaccagatcctgttgtacacgtgggacttgagatgtatcgaacatttgccatcagagacgtccccatcacaccttctgatttggatggacactagcacattttgagcttcttcacttcacgcacgacacagttagggacaggaaaaccagcacactgatggtcattgtggaagcattacaaggaccatgttgactcactgttgccagggtagaaaatgctcccagctggattgtgggaggcttcctttagtgttgcacatgcttgcatgtcagtagtgttaactgaacacgggtttgctggaggaagaggcctcggggaggccatgaggaaggagggattctgaggaaactgcttttgcaaataaagtagaaattctccagacttttcataagactgccacgtcaaaatgaaaattccccaaataaactgttagtttgtccagttctgcagacgtcataataaggagggcccagtccaagattctgccttgctgcttatttgggcgtgtgaacgtacaattcattcatcaacgggttccctaagcgtttcccaggcttggaagtgtctgttcttgtcatttggaggccagcattgttttctcataccttgcagaaacacagcatggtctttgttctcccccccccccaaaaaaaattgaggattatcacatacacatattttcctctggtcacccaagaagggtggagactggaaatttgaccaagacccagagattgacactccattgctgcccccactccacccctcggattgggatttgctttgggaatcctgtactctgctaaagctggaagggagaaagcatgcttagataaagctagcaggtgtgaataagtctactggaacagaaattacagttgcaggcaagtggtagcagttcggcacatgcttagaaatcaggaaacagtactaagaatagctttccctgaggttgctcaggaagatttgttatgttgtcttttactcaaaggtggacatcagtgccttgctccagttacatatatacttccatgtccttgggtgatttgttaatttataccaactctctcgatgtataatgggtatctatcagtggcaaattatggattacctcactcatcttgttatctggcatgttgggagttctcaaatatggcaaggacatgcactgtgatgaaccccagagattcataccagagtgttggtgggtgtggtgatataggaaaagatgctgttttttttttttttttcctaatagagcagtgtctgacaaagcgttggccaatggtgacacaactagaggaacagaataattagaaactcagttacaggttctggactccctggctaatccaggagcgttgggacttttgttttgggggtctccaataggtttggttctgagctagtgaagttgattgaggtttctgttcatcaatactgcccttgtcttgcccaaccattccacgggtgggattctgagtcaggtctaggcaggaaccctcgcaggacccctgctgtggaatcccccgcacgcgcccctcgttgcgcacccacgcctcacgtcctgtgtgtcaagctttgtgaatgaatgatgtacacgcacttggaaaactatgctgctactggagcggggccgcagagggtgaccaagccttcaagaatgcgtgcagaatcagacggactttcccgagactgtggcagtagccccggcatgccagggacaggctcgccagccattcttagcagcggtgggctgaggccctcgccccgcgcgcgcggaatagctggagcagcgccgccgggccaggctcgcccgcccttcctttcgcttttgggagacgggcggtgattggctgcagatgctaagccccgccccgccgccccgccctcgccgcctcgccgagtgggcagggcagcggctgggaccctgggcctgggctcggtgaggaacgccctaaagcggaggcgagctgcactgcgccagcgccggccagccgtgcgagcgagcaagggagcgagcgccccggacggaggagggagcgagcgcccgggacagaggagcgagcgggcgggcgaggcgcgggcgaggctgggacctaagcgcgctctctgctccgccaagtgccaacttcgcgcggactggctgggcgcgcaccttcccgcggggcggtcagcgggaatttgagattttagggttgcgctctgtccccttccactgggttcaaaaatccccattaaaaagcaaaacaacagttacagcaaacttactctcatcccgccggccccctcaactccgggcaccatgaaggcggccgtcgatctcaagccgactctcaccatcatcaagacagaaaaagtggatctcgagcttttcccttccccgggtgagtggcgacagtgaggcccccactccagctccgggtccccttctgggctgcgctgctcccttaggagcactggatgcagaagccaggaggactgttggtggcccaagacccttggcttttttgggggggggggggcttgggttgtattttattttcacagctgtgtgttttgtgactaatgggaaaacgcttatagaatttccagctccctaattccgttgtttgaattttcccacataagcgagaaacttctggtaatattccttaatgttagcaaggggcctgacactgtctctaagatcacccccaccccgtcccaactgtgtctccccagtattggagcttgatgggaggctcttgtgaagtgctgaaagggtgtctggctagctgcccggccttcgagcacttgcatcctgagcgcccctgtcataagtcccttagagcctcactcctcttttctaggttgagggggaggtagtgggaggagaaacgaacagaatctgtttaactttgggaaagtctgattccttcctggtcagtgtagtaactagctttactgcctttctattctgccatcttttggcctcccgtaccaaaggtccttgaagaaggaaagcatcccacgaccagatgtaacttagtgtctttggctcatagttttatttagcaggcttaaaggatttgaagaagagagggagagtaaagacatcgaatattgtcttagaaggaaattttagtgttcaacagatggagtcaactcttggggattcctgaagctagcagagtgcaaagtgcctacttttagaataggaagctggactcagagaaaagtgactttggaggtgaaaggatctagaaagataaagggagaagatgatgcattttggaaaacaatcagatgtcaaaacacacacgtctattgggtctgattatctgtaactttaactgctgtccctgatctcttgcctctgccgtaaataactgcatatttaacctgttctttagactttcaatacaagccaaggtgacgttttgacattctgatgtgtttcaaaatgttaatgaagacatttgggtgccatcctttctagagacgctcctgacagtcagtgccggattgctctgtacaaacacagtgtgatgacattcagagccaggttgagctgggggtctctcctagagctggggagacttctcaggcactcagagctacatatagaaatgttgctatgaaagtgggtttggggtgttcgatggagccaggagttctctgtgttaccattgattaaaaccatatatagcagacgcgaagggatagttcacagagaagatataaactcagctaataggccctttccttaagaatggcttgtttctatgtgctatgtgtgtttatggggaagagacagatttgggtgtctggcaaacatcatgtgtattatgtcagttcacatacctacagtgggcctttcatgctgccagtgaatgagagcccctggctgcacatgttttagatcatagcaaagagatgaagcatatgttttggtaatttaatattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcaagttacctttggaggctcagtaaagtagtttcaatggagacttcaatttttaggtgcaaagatagaagaagccctggccaggacttctttggtagtcttggctaacagaaagaaggatattaagtagatgttaagtagagctttacctggcccatcagattacacaggacacctgtgtcaaagttcaactattcatggcgtgggttcgagtccacgactgggaccttggtctttatcataatggtttttctttgtattgcttcgtttctcacaagcagagacaaatagtgtcaggtattgctgttacctcagcaatcaagtcagaacttcctctctgccccctccccagattcctagaatcagagaagtgaagtgggaagtctgagggtccaaattggagacaggacacctggaatatttgctagcctctctgtggttaggacttgaccaagaaccattatgcgctttggtttgattttgaggtctgacatttttgacaatgttaatacacaccctaaaatgacacgggcattcggtttccctcacaagtgtaaggtagggcatactatctcattgcacacgtctctcaggtttgctgtagatttaaatccaaacgcagccttgacttgttcctagttccttcctggtgtggaggctttggagtaagggctgaggctatgaaggcagggtgtgcgagcaaatgttactttattattgctctccttctcattccacttcacctgtaccaccagtgaggtggagacgctggccatggaggaacagcagttttcacacagaaaactggctctttgcccatttataaggctataaggaccagacccaacctccatcttactttgatagaggacgtccatcccctggggaccattattgtcctcagagatgggagaagcgttgtcctttcttagtttagacggtctttgtgttgctacaggaaagaaggaagaggggagggctgccggctgccggctgccagctttgcttatgactgtgtttctagatcccttgttgccacactctgttagtgactaaatagaccagtggtttagacagggtctgtggagccagtttgtctgggtgtgaatccccagttagtggctgtgtgactttgggcagactacttaatctccctgtcctccagctcctgcgagtgtgaaccgagactaataatccttggataaagatgaaaccggaatatgtggaacacctttactcagtgctggcccaggtcctggggtctgtggagcagataacgaagaaacaagtcaataggaaccttgaacggtgtagaacattcaaaggaccctggaaggtttggtagggaatctaatggctggtttatatatgtctcccacatctaccacttgggaaggaaagaacaagagagaaaaagacctggcctgaaatctcacaccagtggggctttaatctgagctctagataacaaatctggtttgcagttcacttgcagagtgtttggaggcctgactgtcactctgcaaggttctagaggctggtgtactccttcgggtgattgaacctgtcattgatacattgatacattgatactcagagtaggaaatctcccaagtccaaggacaatggcaacgtttgcagagttgtgggggattagtaaagtttttccatcttactggattgagcaatgtgtcttgtccagttattataaagtattttacattttatttatttacttggttggcagagcttacattcctggcatttttggttggtttgtgttgctgggcttttttttttttcctcttaaagaggccagaccaccctgtaggaacatctctctaggagacaaagcagccgtggtcaacctccccaagtctagcttgctcggggccctaccacaatttctgcaaaagcaagagctggttagtggcagccaggattttccaggaaagagtatccctgtttcagagtacagtggctgattccattggcaaatgagacaatgtaattatagacagaatgagaagtgtagctgtgacgacgacattcctgggccttgctgatggtaactcctgttacctaactgttgtaggaagtttctgaaatgtctatcgcgtatgctttgaatgtctacaatggtcccttactggaccacacttgattgacactcactctgtgggaaatactattcatcccattttccttttttctggatggagaatgtgatattcatagaagtatacaccttttctacattgactctttagagacttagacaccagtacgatgtggcaggcattttgtacctgatgtaaaagcactgtgttattttcagtcattctggaaattaaaccatagtctgtataagaaggccgtgctgactgcctggtgctttggaggctcaaggagtacaggggttctccctgccatcctctgagctgaatggcgtggtgaaagggtgtcccgaggcgtggccagccagatgtgtattcttaggagaggcttaaaggttctgggcactccaacctcaggtgctgaagggagaaccagggagtcttgtgctttgctgactttcaggtgttctaggcttggtctctggtgggaccgtcaagtccctgcgcctccagcttctaccgttttatctcccgcagcactggttggtgctgccgtggacttagagtttcaagtctggatgctgaaaggcatcaactggcaaaccgaaggcagttgaagtttaactttgtgctttataagaaggctctggataacttcctttgtgttgcatacacaggacaaaaaaaaatttcaatcttttctctaaaatttatttattttgatcccagttgctgtgtgaggacgattataggggaaggtaggatagtcgcatcagcacacggctcattgagaaacaggctctgcttccttatccacggtcaatattgattcctttaccatcatatcatgggggtgtttctctaagtacttagcatccttaggccatgcagccttcatcaagaggaacttgtgtatgaattgacaggtgactgctggatttctcagctccacggtgaagcactgtttccatttctccgctcaggcggaagctggagtagcctttgcctctgcgtctgcagagttttagatctgccttctgcttgtagttgttcggctgtgcttaacccagggttcgaaaggccagagctgttcccaaatatctcagcctcactcctcatgctctgtagctaccgttgtactatttagttaagggttgaggataactttttatatgaaccttcagtacatgtttcacaaatggcaccaataactgttttaacttgaccacattgatgaagtctgggttacctcttcttgcaactgactagcctgtgatccttctgtaggaaggaattgggatctagtagagggttgtagtaggcctgatttcaagtgcagagttctgtgacacagtcaacatagtgcagtaggcacctgaagtacttgttttggtcatcgtgatcaacttgatgccagggtcttccctgttgctgctgcctatgctgaggcttgttacttgataccccaggtgtggttggtctttttttccacatttttttttaactcttcatttactatttccacagtgcccctttctagagctttctgttctgtttcatggagatgtaaaatattggcccacacagtgtgattagacataggtagcacaggggatctttaggcagctggatttgagattctggaacagtatagacaggacttgccatctggtcaggatgctctcagaagtgtgcgtagtaatactaatcattccagaataataaaacttaaagtaaggtcctccgagcagaagatctctgaacttcggcactaagtgtagactagaatattctccagaatattctctgccaaatgctcacttaaagacaaacaggaccagattaagagtttaatgttttcccttcagtgtgaggagtaattcttttaattttgtcttcaatgtaaagcgtagtgtttcttagcagtcaaaacagtacctcatacacactgagggcttgaaacttcctagtagccctgggtagctgtgagaagccattaagtgtgttttgcagagttcttctgcaggggaactgtatacatttcaccacgtggggtggggggagagggagggagggagggagggaggaggggagtatgtgtgtgagtgagaaaaatgaacttttgagttgggggcaggaagtatctttacagaagtaaagataattaaaactttgttttgttttagggtttaatccaagatgagtttttataatgttttgatttaaaaaatgtaaaagaaaaaagtgtgtgtgtgtgtgtgtgtgtgtgtggtatcgttaaagcggatgagaagaaagcaataccgcacaaaccctcatctgttcaggagaggaggaacgtaggttcaattgcaacatcccttttggctaaaagatgaaaaagaaggaaggagggcaggaagagtacaaaagaactaataaagagggaaagaataagggaatttaagtggtattttgtagactttaaaaacatcctcctctggaccaagcattgtcctggaccagaacttcttgtctcaggtgtcctggtggacagtctcgggcctgttcttgcttgttctttgtgatgccattttcacactcagtaaacttctcatgcttctgtggttggtcaggataacccagatgttgtttttcccatgccagatatgaggctatgcataggtccaggctctcagcgttttctgtgcctgatgagtgttgggtttttgtttgtttggttggttggttttttccaatagtttttgggtacaatgctttcatgggccaaccttctgaagatcacaggccacccggaagcattttgaggagccataggggaagggggaattacttttaatatagaacaacatgagaactctgcaagtttggaataaagaaagacttgaaggataaagtattgttcataagagagtgaaaagaattgttagatgtcaggatttaagagccacgggaagacctttgtcttaaagaatagggaggtaggactggagagatgggcagtgctcagagcacctactgctcttgtagggaccggaggttcaggtacccagaacccatatcttgtggctcacagctggctgtacctctgtctctgggaggacccagcacttctggcctcagtggacacccacagtcccatgaacactctctcaggaacacataattgaaaataataaaacttcaacgcttaaaacaaagatggtggtttcaaggacagaacagtgctactgagcaggcttctgagaggctgagagggctgagcatttttttttctttgcattactttccctcccactcataactgttagttgctaaaacctctgtatcagtttatcagaataggcgttaaacctcaaagaacatgacagaatcaatcaggtacatatttttaagggaagaaatggaaaataacttagtcaggtatttatgtctgtagatgacttttttctcaataatttaattatttttcttcactttacattctgatcacagcttccccccccccagtcacacctacaaatctctcctcccttccccccaccttgggtaccaccctatcttgggatatctagtcccagcaagactgggtacatcctttcccactgaggcccaaccaggcagtcgggtaggggaaggggggtctaacagcagggaacagagacagagactgcccatgcttcccttggtaggggactcacaggaagaccgagctgctgcacatttgctatgaatgtaggaggcctaggtctggcccctagatgattcctgcttgatagcccagtctctgtgagcctccgggtgattgtttttaaggctttaggagcttctactacgtgccaggccttgtgcctgttcctaaaggaatgatttatttgtgtgtgtgttgtgtgaacgaaactcaaattttcctaaggtcattcattgtcattcatattcaaaataaaaatatatgataagtctgaatttaaattatacttatagtgtgataaacttaattataaacttctgtttataattatactgattcttatttttcttggtatttttatctaacctttagataaattccttatattttgtgtaagttgtcttacaccatccagatactactcatgggtagaattcagtggagaataatcaggactgactagagggacctatcatcagagtaaaattaagtattatttatgaaatataaagtttactttgtaagttcaacttcagagggggcagacacacacacacaaacacagacactcacatagatagacaaacagacacacacagagaggtagacagagacagacagacacacacacagggagagagagagagagagagagagagagagagagagagagagagagagagagagagagaaagagagagagagggagagagagagagagagagagcatgagtgagctcctgtcaggaggattctagccatatcagtgtacctgcttgtatgactctgggaaaaaataatttcatttattctgaatctcactttcttttcggttttttgagacagggtttctttctgtagccctggctgtcctggaactcactctgtagatcaggctggcctcgaactcagaaatctgcctgcctctacctcccaagtgctgggattaaaggcgtgcaccaccacgccgggctttgaatctcactttcttaattggccaagtaagtcacttagaaaagctaaggtttctcttaacactgatggcttgtgactttgggcaacagtaaaggctggtaaacaacatagactgctattgatgaggtagacaggtcactactttgactcagtcactggggaatttttgggtacctctgtaaagggcagcttgtacaagaaggtattaggaattgtgcaaagctatcccaacgatcacatgtaacaggcttcccagttaatgcctggtttcaacttgtctgggatcatttctgaatatgtcatttcaggtagtgctgggccaggagtcatgtcttccagtacaacagcttccttttctgcataatcattggccacagggccagctaaaggcagttccagggaggggtctgaattggaggaagacataatgtaggttaggagtctggtaggcagagcaacgaacccagctgtatcctcacagctgcccatgcggtctgagtaatgacttatttcatggaagctgccccttcttgttgctctgttctgttgagaaacagtcccctcctgcagctggaatgtactccgctgtgaggcatctcagcaccttttcctgacaagcctggtgagacaaggtcctcactgcctgtttgcacagagggaagggcccatgcctgcctgtgggactgttcacaggtgcttcctgggcagcaaccggctgacccctccatgggcatggcctgcctggtggagttgggggcaggcaagatgccacctgctttgacttcccagtcatccaggaagctctaactgtgtgctggtgtgtcaacagcgaccctctcgcttctcaaaggctccctttgtggctggctgtggcgtcgcctacgcatgtttgttatctgtgatctcattttattgatgttatttctacattttgagaaagatctgtgacagttaccccttctttgggaaacaagggcctaggtacagcttgttgatttggaaggaaaaccaggaagactgccattgagttcttatcagagggcagatctaactcctacccatctttatttttttggtgctgttgtggtgttccccccctccgtgtgtgtgtgtgtgtgtgtgtgtgtgtgtgtgtgtgtgtgtacatatatacatacatatatttgtatattaggttttgaatactaggtatgcggcaaagaccctgattgtcttatcctactctgtagtagtgaaacgtttattcccgtttcatagataagaaagtgagatgttaaaaccttatcacaaaggtcctaagcacacattcaaacccagcagtagccagttctaaaaatcacatggatgatatcaacacggtttttgaaatacttagatgttgaattcggaggggacactgagatctgctgtgcatgtttagcagtctgcctaagtactgccttgtaatttggtaatgtgttacagtttgacacacgcctttacccagcagagaccccagtaatccctatgagttgccgatattttgtgaaaaaggagagtatacagaagggatgccaagttgttctctcagtgccacatgcaccatatggtaaaaccacagctggactttgtcagatgtcctgatggctccatttagccacccagcttatatatttctcttgtgtggtgagtgcctccacaatagtcataataaccactaacatgagacagaaatgtcagcaaggcagtcgccccctttttgttgctgcaagtacccttcctctacatcttcagtgagtctacatgggtgctaactagagatctgggaacagggtgcccagacccttctgatgtcacatctaggaaagtggcagagatacccaaaataccaggagcagacaggaaagtggcttgctctgtagggcactggacaaactaatgtgcacttttctttggagaaaggttgactttggaccttaagaaggttgagttttgttgttttgttgtttttttgtttttgttttcttggttttcttttgtatttttattcctaagagatttgaaaagaatcccccagccctgttttcctgtattaaactgaaatgtgctttgcttgggccttctgtgcctccgtgtgtgtagagtgaggtggatttttatgaacaaagggaaagtcagacagctggaggttgcttctaaacacaacaaaacagagtagaaaaatttgaatgtcatagtacgtgttatataaaagaactgtgcccgagaggcataccagaattaatgacatcttagatgaatggtgtattcttcttattcaaaacagaagtaccatttaagctgtggcaccaggtataggtgtgtgtgtgtgtgtgtgtgtgtgtgtgttcactcagaaactagttagattggaccagatctctaattattcttcttaagacatgtcagtacccttgcctcctctccttgttttgatcttgctggaagcaagctaaatgacaaactaactgttgacctgagaagtattcccttgggcttgctactattttcttgcaaatgtatatcaatcctaagtagctacccaataacatggcgttccctggaggactacgtggggcgggggtgggggtggggggtaaggatgggaaggaggtggtggtacaacagcttatagcaaaaacagaaagaagagctttaagtttggcactttctagtctgggcactcaattcttgtcaggaaaattttagaacacatataaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattgtttcatccccgtttttccatataagtaaatggaatcgcagaaaatttccaataatttactcaggaccacaaaggctcaatgtcccagatctttatttggagcttgatcacaaagcccagcctacatagaacacccatttggagagaaaccttgactcctgggatgctattttctgtgtaatattttcttctaagagcctcattaatatcaatattaggcaaaaaaaaacccattcagttgtctataaatgtatgccatagggatgggtttaggtgattcctagcacatattttcaagttcaagatggataaatgaaagcacccttggtaaacttgcacaccgaatttgtgctttgccctcccccaccccctcccccacccctctttgccgactgggaaaccaaggaatgaagtgagagctcaacggtgcctgagaattttccagggaggggacagaagtttaggccttgaggccacttgatgcagcaggaatgtttgtagaaaaataaacacacacggaatgaatcaacatctacacgctggacccgcagttaacctccttcagcaggaggggggaaggggaggagccagagcctgagtccttctccctccctatctttaaaaatgatactttgttaaggcctctcttagggcatcctggtgactgctcttctgctttggctggcctgatggaatgatttagaagcttcagagccttcagcagattttgggtacttattgaacaaaacagcagcagagtatcagtgagagtgggccctggtgagttgttgtggcttcagtaggagctctggtcagcagtcatggcttgcaggcatgcctcacacagtgagcgagcaatgagtgaagatgaagtaaggctctggttgctccaagctgccttgctgcataggaaaatcgtattcagctacgtgtgtttccgactcagcccagttctagggaagtagtatgtggattagggaaggctggtgcagggcacatactcctctacagagcctactcacaccgtgtttgtgggtctccccccagttcctgttccaacagagtctaaatgtgattcatctcctttagtcattagtgccgggttcttaagtttgtcgggtggattcagtcgtgccactggttgcttatcttgtgttacacagccattctccttttcccatgtggcagatgagaactaatcataaggaaagttcatgtttaggtttctcagcacccagggatctctgcccttgggtgaagcgactccccagtgaaggcaggtgagatagccacggctgagtgctgtgttcttactcactgattcgtcctaaggccaatgatttagcttcccggagccctgcttttctgatccttacatgaagataataagaaagcacacccagggctgtggcaaggattagagataattcctctaagatacatttttttcctctttagaccacaccacagggtctcaggaaatggtgtcaccattatctcagcccaccgaattctgtaccagttctacttcgctgctcacactgttcctacttcagcggttgttaaaactgtggttgctgttaacctggttacagaaaattttccacttgacacccctttaaccaagtgcgctagaacggccctgtggctggctctattattttccagtccctctcttcagacatttaccttatctgagttcaggcattgaccgagtttccagctccagagccttcttttcagacactgtccttcgaactgcaacaacttcttagaatgcctgccatcgaagctcagatgatttccattgtcaaggcactcattttcctccgggactcttttctttttggggcagccttaaggaggaaatctactatcagaaatcccaatggtcacttgcagagccaggcaccccccccctttaccgtaggtgtgagagtgtaagtgtaggcagcgaacccacctgacacagaagcagcctgctatcctttcccagggttcttgctcctgttcccaaagaggtgcctgctggactgttcaggctcctgcagatttcccctaaaacccatgcatctctggccttcaccagttgattgcagccgacgatttacaaccagaatccagcacctagaaaaggggatcgtgtgtctttaaacagctgtgcgccagtgtgtgtaaatgtgcttgctaatccaatgactaattcagtatattataaagcagcaatgagcctgctgccaagacagggctctatcccaactggagggtgtgtaaggctcagagaaatgtttctgaagcacgttctctctgtcctttcttgctcctctgaatttcaccgcgtacgttccctgaaccagagtccctccttaccctcttgatttctgtctgtcagatatctccattcctctttcctctcccacctctatgccctgcttcactcatcgggggtgggggccctgggccatgtgagtaagggctagggaatccatcagtgtcggattggggcactccaggggacagaactcattatccctcttgaacattttgccaagtgactgccagtgttgtccctgtgttgtgacaggtcgtgcctcagttctcagtctgtgatgttctgttgatgtcggtcttcctgaaattctgttgtatttatccctcttccatcaacttctaggggttgagagagaaaaacatttagccagtgggcggggtgcagagtataaggtatacttccttctgagggtctttaagtgagggcctggagagcctcctctgggtgtggcgaggggctgggaaatgagagggatctggggcctctacataagtgttcccagacatcactgacaccaggtgttgactctggacgtggaccttgcccagtctctcccacagtgtccagctgccatcagaagcatttccgtgtgtcagaggtgggtgttggaggccccagcatccctctgccttcccttctcagtaattggtttcgtatttgtcaccttggtttcctcccatcccaggacatctgcagtctccttcctcttccccttcccaaagcttctggaatccagccacattggtccctcactgcaaagccttggtcactctggagttgggagtactgctttttgtgtatttagcaggatagctttgtcccactagaaggggaacgcccaagtggagggtctatggctgtcagtcaccaaggtgttcccatcgctctgtgagtcagtagctgacttctgtcttttaagatagagttcctatagtagaagttcagtggcttttaatacagccatagagttgtgtaatcatcacaagtacctccgtcatttcaaaacgttttcagtgtcccccaaagaagttccacgcacacccccagcctatcgtcgatgcccattgaacaaaggcatgctgtccaggaagggcagggtcctaaggagggctcaaagcacacatctgacttgagttctccatcttccaatctctaggggcctatttcccacttgcctctcctcagcacccaggctctactctgcaggctggcttgcttaagtctctcagtggagtaaccccggaactgctggcactgctgggtggaggtaataagtgctttccccagatgcatgcagacagttaggcccagggagcttgggctgtggtggctgcagtttcctaatggcttcctgatgagacagagccagttattaacctcggatgatgaggcctgcgcatacgggcctctctttcccacctgacgcaggcggatggagagagcggcttcagctcctgcccccttagcattgatcactttttctctgctctccaactattggtctgtctagcccattgatctgaagattgggtctgcctggtgactgggtcagcctcttgggtttgttgttagaggtgcccagagatgtctgctctgggcctgtgtggacaggacttggaggcagcagcgtgattgtcagtacactgaagtctgggcgcatggggctcttataagagacccagaaggaagaaacctgtgtggctaaaagggatcaactaggagagatataggagcccttaaatctgtagattcagcgctccagatgtgtttgcttttggatgagaggtacttgaattgctccaagacttcaggccctttgggctgaaacagacaacttcattcaccagagggaggcttgcttcacaagcttacacttggatattatctcctgggtagagccgtgtctctgtgatgttcactgtatcttgcccattctgtttgggcaccacaggactgaaatggtaatgttggagaggcttcaaatggcacagtgactcttgattctcctgtcagtggttttagatacagatctgtagatcagacattaactatgtcctccctggccctggtttgataagaatggcaccctctgtttccagagctgctgtacattccagtgtcatgcaatcaaacactgcttgtttaatgatcactgtcacacaccaggaacctctctctcttgtgtgtgagggggacgtctacagtttggtgattgtcactcagcccttgtaaactgcaatgggaacaggtagcagagggagccataatacgtacatttgtatatgtgttggctttgtggatagttgtccgctggggtttctgaagaacttagggagaaatgttgctccagaatgacactctagggcttggtgataggaaagacatgaagaagagcctcttcctcctagttcacagcagtgagcaaatggtggtggtatagacagaatcctgggcgggagtcagagtaagacaatcagtaaagctacggtgggtcacctccagggcttccttccccattaggaaaagaaaagttggacttagatgacatctaaaggcccttctaactcttgcaggaatcgtgtgggacccttggcctgtgacagagctccacaactcctccaccactggctgcctccctttcattcatcttataattacgtctggttgccaggcgggagagcctccctccaaggagtagttaaggttttatagcaaattctttctgtaaattcttttctgcttcttggctgcagatgaggcttttcatagctagagtgagggtgtatggaggaagaaggcaaaggaagggtaaataaagactcaggtagactgcatggagtgatagtttactcttcttcagccaaagccgaagagatactggggcccaaattatagattaggtagatctgcacggactgtggagaaaggcagatgacagggttagcaagggaacctaatggtatagggagggtaatcatgaactcttccaagtttatctctctgggtcctaagcaactccttagcaaccaggagactttagcagggatcaactcttaattatgacttaaatgtctcagctcctaggggtccagctccttagagacacacgttgagatttacaggactgcatagggtctttattctgtgagttgttgaacatattaatctgaggctataaactccagatgggggcaagagcactgcttgcttttgtgcagggaattttgaaggctgtaggccgagaggagggttgtgtcctatacttgccaaacaagccacaggtggggattttcatatcttctctggtgtcagcctggccttgggtatgaatgctatgaatgtggtcgtctctctgccttctctccactcctaccatgtggctcccatgtggctctcttgaattacactgggatgagtcagcagggcctttggaaagaaggggacgttttgcccgtagggagaatgggtggagaggaatgggagaagcagggtttgaacggaatactgcatcagcttagtgttccgtgcacccatgccagcatccattgtccgatgtattttaaggtggtcttcctctgggttttttgtcttcaccttctgtactgagtgactacatcgcttgccagtgtggcctggaacataatatctcagttatcttcagatttatttgtgtgcctttgggtactctgaacttgtagcacgcatcttccctcatgcacttgtgaatgaatgaagctggagaaagaacccagtgtaacctgtagctattctccgagtccgttggacccagcagtgccctggttgagctctaaaatgatccaacattaaagtgcttgcctccttctcaccatgggagggtgtgtgtgtgtctctcttctatattctaagctagttaaatgaaaaacaggacttctgcttctttttgcttacttaagtgttgtttttccaggagcacagaaggaagtcactcatggaggttcagaggcaggagcagaaagctgtttctccacagggatctttgtactgggtctcagatgttttggtgtgtaggggggggggggggagaatctgggtttgtgctttggatcggtagggtggaatccagtggatgaagttgctgactattggctgcctgtcagtcctctcatgacacaggtggcactgtataaggtggacagggtaacagcttgcagggactcactgctgagtctcttttcctatggcttccttctgccaccagcctgtagcaggttgtggtctatcacagacttatctgaccgctggcttccattttagtaagcctgtgggaagagggagaataaaagtaaattaatagtgcggggggaaaaattgaatatcacagtatgaagtcctgttaggagaaaagttgaaattccaaagggaagacagggcaataagagggaaggaaaggtctttctgtgtctccatgcatttcagctcgtggcctcccttttctccttggtgctggattgaacccagatgctggacaagaacacatgctggacgagtgctttggccttgagagacacccccagccccgtgtcttagtccctttattctgctccaagggagcgagctagggaacttaaccatagaagagctctgttgtagtgtcaccagccgtggttaatgaacagatgtcttgggagccgtaacattgatctctattgtttggctgatttatccttggcatccccgaaagaggccttaatcacctctcaggtctacccatctcagaggggactacggagggcaagccagttctacacttggcgaaagagacctgttagattgagagggagcaggatgagcaaaagaatagctcattcctcagcaggcagcctttgtggtgacctcatcttcctcctagctctggtccagttggagctatgcatacagggcagacttccagttcctcctgtcaggaactcacaggggcagatataaatagaccaagactttgtctgtaaccattgttctctggctgcccattgtttctggtgctgaagcctaccccctcccaccaccattgctcctgcccccgactcactctcactgtgcagaagtttgaatttcagcctggctattttcatttgcacttgtctggtgcttggggagaccagaggagagaaacagcctacagtgtagatcagctgaattataagcctcctattttgatgccagcaatggttttgtctgagtctttcctggatatatttgtggtccagacaaagatatgtggatgtgtcgatagttgaatcaggaggatttgtaaggggttcagcaactgtccccatgattaatgctcctgtgtcagagtaatgcacggtctgtggtgttacattatagggctcagtacttggccattgcctcttcggggtgtgtgtgtgtgtgtgtgtgtgtgtgtgtgtgtgtttttcataaggagcttagactagagaaagatgcagaaagcatttttagtaaggtgcagatggtgcaaaggttgagatggatagctaatagggtagatttaaaaaagatttttacatggggaattaaggttcaaaacagtggcatttgctatagataaatcaataaaggccaaggctataggtgtgggactggctgtgtgagtttgtctagaggagggctggtagtgtcttttgtcttttgcttagtagttgctatgttctcacttttaggcaaccatctcatcggtctcagtttaccctgcttgttggatgttctctatggaggtgtatgatgctccttagggggtacagacatgcaagactgcttttagggggaacaagaggccactgtgaatgattgcattaaacggggagtttaaaaaactggacagaggggttatcaagcaggaaggataaaagctgaaaacctgctagccgaaggatcggtaatgcaagggctttgattgacagagccgggtctgaaggacacagctcctaagcaggcatccattgacaaaatgtgtatgatagttcttctcatagccatcacgtcttatgaatgaattgaaaggctcacaaagtagggcacagctgggtatcttaagccagatgacagttagagaagagaatgccaattttcgcccgggttctgcctctcctttgctcgtcactccttgtcattcttgagaagcttaggtccctgctatgtggacagtctgttgcatgtggcgccatgttgtgcgcccgcgtggcctcgcctgggaaagtggggttgctcattttgtgtcacagttttcctgctttggatacaggcagttgggctgtgtggatgtgtgtgaatatgcatcttccttctcagcccggatttatttattaaaagaaaaacacatctgcataaaaaagcctcagaacacaggaagaatgtctactttgtttttctttctgtagcatcaagacacgcagggttttggcttcctctgagggattttgaagactggctttcatctcaaacgagccccccccccattggaaaattgtcctttttaaggggaggaggggttacatgtatttatataatttttaaataaataagaaaattgggaagagaagttcctttcaaacttcatggaaaatattccattctgaattgggagtaagtcgctgcatctccttagctccttccacttggcctcctgcctctgtcctggccctgtcctccttgctgtctcctctgcctcctctcctgctgtctcttcccagacaggccccagttcagctctctcaggccatcttcctcagctagctgtgagccactgaacgctccctggaagaggcctggctctgtgtttgtttcctgcgtgggagggagaggcaggccttgagaaaacagttcaaaagtgcagaaaaactacctcttccagcctaaataaaccggctttgctccatttgtttgcccagatttttcctttgcccatggagaaaacgtttcatcttctacctctcctggcttcgctttcctgggggaggggatccctagccccccttcttcatgcttgctgtaggctctgagccagtagtgggagcaggtcacttttgggggggccgtgcggtggtgtggtgacatgggggaacctggagccacatgttgcagctgctgtgtgctatctctgggaccaagatctacttttctccagaaagaacttccttcacaattacatttggaaagaaacatcctacatccatgtctgtttacaaacagacccagagggggaatacctaccttttgtgtccagatctctggacttgagtatttggttacatcactttcctgtcctcagggtggtgaaataaccaaggtagcctctgtgagcctccagttcctcacctgaagagtggaggaaatgatactaaaaaacacctgagaaaataactttctaaaatgtaaaactctgcttaatatgcagtggtggtaattataggtaggaagccagtgaaattaaaataagttgattattttaataaccctcttgggctggtagctgatgaggctgtaaagactcaccaggaagccctaagtaataaactggaagtagtatcccttgctgggataataacaagacggagagggtcagaccatttccatcattgtgcttaggatgattctgttacactgttactaagagccttataaccccatcatgagtattgattttagttgaaggttggatcagttacatcagtaatatcagaggtataagggtgaggctgcggcttggtagtagaacacgtgactggcttgtgcaatgcctgggttccagtcctagccctgcaaagcccgaaggcataaggcagagaaggagtcaacatacagtatggctatgagaggatctgggcttatctacttatagcttccatggagaccagtgcctggtactgtgtttatcaggacagagggattacacgtcctgggacattttggacacctggcaatattgtgtgatgagagctgagaatagtcatgttggttggaagtgctctgaaggatgtgaaacaccttttaaatagctaaaagacatcatttaaggacttccatattctgtccaggtggtcttggtgcagaacttcaccacaaggtgttagggctagaacccagaatatgccttctgccattaaaccataccctttgccttccaaacattcatttaaactgtgagagaatcactgccttagaggctcataaatggctatatagtttattttgttttaagaaagtcttactatatagggaagagttttgaatacaaagctacacttttctttgtgcgttgttggttctaaactggtgctcacggggcgcttttaaaaactaaaagatcttcaggatacggtatagccatgaagtgttgtcatggcaaacatgttttagatgacagctaccaaaaagattttcccctagcaggttggattacaagatgcagaataaggaagaaattgctctgttccttcagtgggctagtagagagctagagtcaggtgaaaacaatttttccaagcttgctttccctctgggggtgtgcgctgcaatgaaggttatggcacaggcattcgaaaactccagcgtctaatgggacatagtagatgctcaatagagtgtggtgtcttaatcggactggagccacaacaaacagtacatgggggctcatttacaatgcttacaaggacagcaagggtcaggaagctgacagcctcccaaatgcacacagttgccaaaatggggacgtgtcagatctctgtcttgagaccatttcttgggtcttcatttactgggtctgctaaagaagatacacatttcaaaggccttcaagcagggcatcttcattcacagggttcctccttgggagttttgggtgggagacttgagctgtccaagggaaccgagtaagagcattgagctgcagggcccaggggccagttctgctttctggcttctagcctggaacggaagagtctttctgggtttccctgaacacctggagttgatttgggtcctgctgtgccttcctatacatatgccgaggtggaggatggtggatggggctcggaaagaaataaatccagcgattaaaaatagcttttgcatgtcaggtgcctgaacacatttgggaacatgcctgcaatcccttttgtctggcaggtctgaaccctggcgctgccgaattacaactgctttcatttgtttttcctgcttccctaccatgtaatggtcaagggctcattggaaccatgtgtgggcctggtgactcaccaaatcctcaggaccccagtggtaataatgtgttaaaacttttgggggggatggagcaggggatgggcgaaaggcaggagggggaagtctgaggtcacttcctacagatgttcgatgtgcctggcagaccctgcacactgctttctcgggctcagagcagcttggagcactccctctcctttaggagacccacttgtttgtcctaggccagcatccccctgagaagatgcaactgcctttgtgttggcacgttgtgtgtgttccctggtggctgtgtgcattggcacagagagatggtgtaatctgagactggcttacatttttggacagccaggtcactggagggtgaattggggattttctgtactgcttcgttctaccttctttggattggtttttactggctgccgcctgctagaggtatgaatagaggaggaggacacacatacactcagttacctatttttctacttggtcggaatccattccatgtctcatgctattcctttgtttgaaacaatgttgcactgcgtgattggaatgggtggacctagtgtggcccctggtggatgcctgtttattggttggtcacatcacttctttaatgaaacctgagccaggccagctgatgaactgtgcgttaacttgcctctgggtaactgcccctgggctggaactctggtctgccagggttcaagagcttgttagtggcttaagagcgaagtggaaggtattgttccccatgactgcttctgttctgctgtccatgggtgagacagggcagtgctcactggtattgagttcccattcttttttgcatggttggccactttttgggggggaatatgcttttagaagccagagacaagttccaacagccagggtgttcagctcctctagccacagccagttttctcccacgtggactggggcttgtttcaggcaacttgaccatggcccctcctttgaaactgcccttttggtttttgtcagaatggcagccgttccttgggtggtcttagttgcaggtgaaagttcacaaggcctcgagccattaggaagcagagtggtaacttcagtcttccccgcgcatgtaaggcagggaaggctcgggttggctttcagacctcctaatctgaagccatctctctctgtcctccctgggccaattttttagatcggagtgatgttgtcttgacagagttttgttgttcaagtgggccagaaaatgaaatgtagaacttgatgtagatgccaggcaagatcattttaaacaccatttactttggcataaggtatatctgtctcttaagctttcatactataatatacattcatctaaaaccctcaagacaataaaatattagtaggtgaaataacctgttgcttggataagctttattcccctccaacctctttgtatgtgctacagagaggagggagagagatggatgaaataagagttcattacactatgatgtgtgcgaattatcagatgaaaactgtaaaacccagcgatggagtggctggctaacagaattcctttgggagatgaattgggtaggtgagttatctagcttgggttgcctaatggggaacgtgagagcagagtctacagatttggataaagaaggcagcccagccccatgcatgtctctcatccccttcttttcttgtctttaggacaccatctctgcctttgggccttccttttcttctctctgtaagccagaagagttcttctcagtttctgtttactctgagaaaaggttggcaaatctttgtgtacctaattagtcttagtatatgtacagtgacccattagggtgactcaggagtgcgcacagacaggggaggagccaggttgttgtttaacccctgtgctgattttggtatggaaggaaggaggtcttaactttgtcccaggaaaagaaaagggttgcagtagatgatgcagacagtttccaatcctgtctctgggggttatctatatgaaatgcacagcctaggaataattctgtgtttaaatatctcaaatttatataattttcaaacaaaaacatgaaaaatcttgtctcagctctgaaatgttttacttctcttaattatatttatacagtctgttcccattggtagtggagttgagcaggaagaccctggaattccagaagtggaaggctatcttctggccctagttactccattttactctgtgactgtacgctacgccctttggagtcttgctatatggtgggaaggcatatgaacagttggccaaccataaattacttttccttctcccccagctactgctctctttatggccgtacccaatacaggactggcaggcagcattgccatgtacagactttgtcccagagtagtgtccacaggacattgggtattcatctgggatttcttgtctttggtttttgcccctcactgtcttaccagtcggttccagatgctgtgggtttttttctacatcatttgttgagaacaacaggagaaagaacttgaaaggctctaagccttgaacatcctcctgagcaaaagctactgcagtcacgttctttgtaacatggctggtatgagcaattctgtttcagagaaccccaaagaatggtagacaagacacatgagacacctttggaagggttcttggaaacctaacagcccttaactttgactgacacacaaatagaatagaaacacttgctttacatttcacttgaaaaggtgtggggttgtaaggggtgggtcacactgaaacacgggcaggtgtttctctgcattcagaaagctgctgccccagcaagcctctagattcccagagagctggcctgcctgctgctgcgtgctacatcttggaatggttatttttgtttgtttgtttttgttttttgattattttttctcccagtggcttctctaccactgtcttctcagaaatctaggttaagtcctataaatgctattgtagaggtagggccataaggaaaaattagcagacagaaatctaatttatgagtccaatttccatgtactatattgagggtctccaggtgattggcatactctatcttaagttaggttctctgcattttgagacacctttttatttgaatttaagatgttgtaggtattaccacagaggtaatctcagtagcttcctaagaaatgcaagttagttaatgtccacagaggcactgattaatgtgcagatgctgctaagattaggagctctctgtaatgatgttatagaaagtaacaaggtaaatttaggaacatcagtgatgtctgcttgtctaagccatgacagggtctccacatacttaatgatttcatcacctccaacattgtcaccatcatcatcaccatcaccgtcatcatcgccattgatatgaataattaccagaacgcacacaatcacagataccaaggggccttttgcattggactttaaagtaacaagtttaatatatccacttcggagcatgactattgatcatttataaatgaaatgtccactgcactgaaaaaacaatcccagctagctgttctcatatgtaaacaaagggcatgacatttctaaaagtttaaatcttcttgaggtttaccaattcagagaagttctgactctccttttttgcagcctttggttccaaggacaatgacagtgtcctttgctagagctcacagcccaacacaagtgtctcaagtgtgggaatagtttcttctagctgacttgggagatcttcccaggagacccaacacacagggctctctacaacaggggcatagccaagtggctgcatgtagacttttagaggtagcatagaggtgggcaagtcaaagcagttccagatgcttccacgagagaaagcacgtgagaatatggaaatacttgctgccctgacaggaagcagaaaccagcatagaaatgtatccgcttagcactgctgaccatacaagactccagagagctggggttgaaaatcagccccagggaatccttcccaggctctctgctgctgtccttgcttggatatcatctcaagagggcttcacattgtcccaacttgcatgcgtagaggaaggtgatgtggggccaccccgccaaatccatcccaggctcagtttatagtagccctaccaacactccattaggcttggcctacattttccacacgtggctccagccaatttccactatcaggaaagttcttttcatggagtttttaatctaaggggggggggggaacaaagacacaaaggaaaacccctacaattcaagttcctgaatttacattggatgggagagaacagagttgattcaatggagaaatactgaattcacaacaataattgttgaccgattgtgtgtgagcacagcatctgaggatggtggagttctccctgctcctaagacaagctccctgcttagcctgagggcttctttctccagagtaatactgacgtgtgctctgaaggaagagacagtttagatcactaagacactcttagtttgatgaagtaaaggcaagctgagagcattgatgcatttctcaatgacccatttgattattacgccattgtttgaagggctggatgttatataatcagcaaccatcacttccccaaacttgttttatttatttattatttatttattactccaaaatctgggatttcccactgttttgtcagccttcctggagggcatgttgctgattcttccattagaacttgtttggaatgtcccagggcaatgcaaacattctgggggacttgagatttcttgtccttggcagggactgggagagcagccacggtgagccatcttcctaggctggcccagacacttacttggctgctccctggtagtgtggttggagactgtgctctgtcatgcaactgcatgacaactgatgggtctgttcattttggcattcagaggcaatatattagctccttttcttagaggacactaattttcattatttcccttatatatgttcaggaattttcccttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccagccaaggctcggaacacgctagctgaggaacttaggtagtattctcttctggaccttagtcatcttaacaccaatttctgcatgtggtacattgatagttcaggcttctaaaattcagggcagtgaaggtagtcacttcaaaacgtcacagaaaagctaggtgggattagcgctggggagagattgacccaagatgagtccagaggacgcttgatgttggccctgtgtattgggaaccagggcttgcaagtgtgggagggtctaaccgtgtgggctctggtgataccggcaggtcttcaggatttgatacctcactgtcctttgccatccacataaatcatacattgggacttcctgtgtgcactggacgcttgctgcctgtcttaccagcattgccacttatgtagtcaaaccactgttgtctcccaggcaaacaaatgctaccactttcttaaaggtgacccggcagctacttatattcacctagacctctctttacacaccagccaaggcagtctcctgggggagcagtgtggggaggccattcctctggttaaactagagcagctttctgttttcctcaggaaaggtgacctgtttgatggtccccctcatcccagcctcacagcagacagctcacctcctgatcacactgattcagctgacgatcgctcatctattattttttcttttatgtgttacagggttttatttcttcccctttctgtaagtttagaaattaagtttgctctgtgaaaatttcatatatgtatacatatatatgtacgtgtgtatgtatgtgttcgtgtgttcgtgtgtgtgtgtgtgtgtgtattctgattgttcttctcttcccactgttcctgtcagttcccccctaagtttctttcctagacatgacttttgtttttgactgggtgactcaattagtttaatcagggccatctgtgtgacttttggtttagtagtatatccatcggagcctggtggggtcaccactgagtacacagctaaaacaaggacacccatctccctgaatctgtcacttagcaaatagttcacagtgcagggcagggctccctgggcctctcacagccacactgggcctttggggagcttatttttgtgacgaaccagtgagggcatccacagttgctgtgtgtttgagatggctgtgccttttgtaacgcttctctgtttgttctattctagctcttccgttatttctgcttcccctcctactttgttgcctgcaccttagaggggatagtgtaaaagtcttgtttggggttgaacacgcatctgccacatattgtcagcaccttgtgtggctacaggtctcctcatttaccaccattactgcagaagagccttctctgatcaaggatgggattagcatttgttgatgcatataaacataaataattggaaggcagtttgatgctatgctggtttaagtaaacaacagtattcagttacccctgagtttttgacagggcttaatgtaccaggcatggattctgtcctgtggagtgggcctcaacaacagagagcagttggctactctgtaacggcaatgccagtgttgcccaagtaagcaggtcttgtctgctagctgaactcatggagtttgtagggttcacagctgtgtgagagcactcctgcctttcctccaagagtctgcatagcgctctctagggctgtgaagactagctggaggggcgcttccagctcagtttaagctggctgtctctacgtcattcaaggaaggcaaatggtaacattgtctctactactatgtagtatagtgcgcaaagtggcattagagcataaaaaggaagtaaaaggcatacacataggaaaagaagtccaagtattcctgtttacaggctacatgacagtgtacgcaaacagaaaattcctaaccagatgattttcagcaaaattaacctacacaaaaaagtcagttgtctttttatataccagagacagaggcactggggaggaaatcagggaaataattccattcacaatagcctaaaaccccaaacaaaaacaaaaccaacaaacaaaaaactcttggtgtaaccctaaacaaggaggtgaaaaacctccattcatctttcccatacctccatttatgctgtgccaagaatcgtgtagcttaagatgagggctcaccactggattttgtgttgaaaagctgacccatgtgctctgatccaataggcctccagtaaaactgaacatttgtatctgctcatttccaggtgaggctgacatgtctgcttggggcaccacactctgagaacagctaggacagagtgtagtcttcttctctagtttctgagtgctcatcagatctcaccgtccgtccctctgccagaggcaaggctttcctgtcctctggaacagttcctgttctgggctagcatgtgccttctctttggaagtcctattggcactgtatgtgaacgttcatgtctgtagatctttaatgcctgaatccactgcaaggctcacaatccactgtctcggccagtgctctttctgttctcttcccatcccctgcacattgcaggcactaagtaactcttggttgcatgaataatattgttccttctttctataggtaactgaaaatgcgtagtagcacaaatggtttcagtgaataagaaggataaatgggggaggggcgtgggtagtggaaatcagaagaagaataagcatgtttgttcgccaggattcagagtgttgtaagcaggacatggggttggttcttttttcaaagaggcctacctagtgtattgtggaaaaccccttcagttttacctgctgtgatgaagacgtgaacacaattctttcccagcttgcattctctggctcattgacactctttcattcttcatgagtggttaattacctatgcgggttttgttttttcatatgctgccttgtttttccttacagacatggaatgtgcagatgtcccgctgttaactccgagcagcaaagaaatgatgtcccaagccttgaaagctactttcagtggtttcacaaaagaacagcagcgactgggaatccccaaaggtatacttttgatcgtaggagaaaggaccacgaagactggatccttaggaaaggctcgtttgctctcctgtagcagacaagtttggaaaaatttattttagagtcacgatgggtgaccatggatgaacctagggagctgtggtgcttattatttatattctgctctctttcatgtactttggcaaactatgcctgtgctttgggtgttccaatctaaaagggttttctgagaatggaaagagtctggagttatcataaagaagtgagctgtgaattgtcagctgtccctagaacatttcctggacagtcatgaataggcaagctgggtcttgtttttattttgctttgttttgtgttgatgttgttgttgttgttaagaaagttgaaggaaaactgtctataaataacacctcgtctgactgtaaataaaagacttccagcatggccaaaccaaagtgttgtttagattcttagaatacatctgcacatttttttttttacatcttctgtttacaactttacccaaaacctcggtggaccacagccccaagcatcctttgtggaccagaatgccagagcatagtgacttctgagccctgagtgttcccagcatctcatgcagttacttgtggctcaggcatcatttgagtggacgtagaagcctgctgcctcctgattccttttggtgtcattggcaggtacagctctgtcaaaccttaggtcatgttcatgaagattacatggcttcactgctactcaaagctgtcccctgtggtcacaaataatgatacttcaatgacttaccattactaattgnnnnnnnnnnnnnnnnnnnnagaggagatcaatggaaatcttggcctgaaaaaaaaaaagcagggaaattgctgttggctgattttagctcctcctagctgaggagatgggaaagtggggtgctagatgagggaggaagagtctgagaggtgctggacaagatgctgctcccaaggtgtagagtaactagcatcgtcagctctgtttcggcccttccctgccttctcccagcctgacctactatatcctcgcttggcctctcttctcagacccccggcagtggacagaaacccacgtccgggactgggtgatgtgggctgtgaatgagttcagcctgaaaggtgtggacttccagaagttctgcatgagtggagcagcactgtgtgccctgggtaaagaatgcttcctcgagctggctccagactttgttggggatatcctgtgggagcatctagagatcctgcagaaaggtaaatgtgtgcaagtggggaggggcactgggtggagtttctctaagagtaggaggaaggctggcccaacagtgggatgctcttgctgttgttgcctgtgggtgttcagccatggtatagacggtatgtggggctgtgtttggctcaaagcaagagctcaatacatgttggcttattttcttctctgccttaggagttcatattttattttttttttaaacaagattgtacttctctagcatcttgtatacaattcgagttattttcttagacccatacattatttgaatgaatagtgtctgaacttaaataaatctggatatataaaacaggagtttcacctgctctggaacgtttgatatatactcccgttggtctgtggtgtattctctctggtaacaggagagtacagcttttccaagcccattagcaagacaagtttctctgccagtcacaggcttgggattaaggcagcgtagaataccttttacatttggagccaaagctagggttatatcaggacgtggtgttgcaaccttgtaatgacacagcctcctctactggcctggcctcttctaacctttttggaccaagtgactcatgtcccgtagctccggctgagtatagcaacagcagcgggcggcaaacttgggtgtttctgtgcttatttgtctaaatttcttcttaaaataaatggcagttaccagcagtcagcagtgccctacagctgactgtaagcctagaagcctgctgccctctgtaaccaggcccaccctttccctgtggttaccagcctcaatctctaggcacagcatctgggggcagggcacacagctcagtccatgtaagaccttcctttgtttaagagaacgaacacctcactctagagacctagagacctaggttccaatcctctgggcatatgaatgtggtatgtcttcctccacctcagcttcttgtcgaaactgatccctggatgaacacagttaaggacttggtagctcttcctgtggctgctgctactcaggactggacaactgctcgctgtaggaagggcactggtgcagacccctaggcactgacataattgacctgttcataggaggataaagaaggatgtggcagactctacgcagcaccggtttaacttctgtcttctgaacacaacagcaggttgcaccagaccatgaaaccaaacatagtctgtcaatatggtgcttctgtgaactctaaatgaattcctgcagtggatgtacccagagctgggggtagtctcggtctgtcagaggctgatcatggtctgttcatatccttgattccaaagtgctgccaaatataaactcttgaaattagccacaatcagtgatcgaccctttaaactttacttacttccaagtctgttttcgtttcacttctcacccagtgctcttgctgtgatgctccgaggaaactctaccactgagacaggattagactattgacagtgttcatgcagaggagcattgtcagggatttgaagtgaagcagggtgtaatggagtcggtgtgaggaggcaagtccggtcatcctagccagggtcccgttgcttgaggcagtaaaactgtcaggctatggatttccgtttctgaagggatgacagggacgtttgtgcgtaggacagcgtcccttctgttgatctaacaggagcagcatggcagccagagagcatagctgcttggggtggagctggaggccaaaggtgcaggggatgtttgaatctgataagccgctcaagcagtgtgtaatcattttatctcaactgggaactttttttttttgagtgcaggcataaacttgttttcccatcagcctttgctctcaggaggctagcaggtacctgaggaaaaacccgtatcagcagtctctcttgatgactgatctttgcaaagaaatgcagtcaggctctgtagagtgtcgacagctactgcgattgattctggggtagcagagtaccccgagccccactgcgaaagatcggctctccgctacactttatttcttcctgggtcctaatgaagttggaatctaggcagtgtggacgtgttggcttctgttactttacataagtcctcacagttcactgagtggcgtcaccttaccagagtcctgcttcttgtctgggcctgaacttgaattctgagaacaatgagaaaagcagaattcaaaaggacaaaaacaatccagatatctgcaaaaagtggaggatacaaatacccacttgcctgaaggctagcgtgtgttctgaaatgggttttagtcgacccgtttgagtgttaggtgctgatctttgtccttgagacatccccacacttgagcctgaagattcagttctctgaagggaaatagcaagacaccacccaatagggatgcccgttctctcaaccctcagtgattgcccactgggtctcctcccaagataaatggaccaatcccgtttcacagctgctgatatgttaagctcagccgtactttagtgatgtcatcctgagataaggctccatccagacaaccaagaccccaactcctgtagtgtgcttacagacttcctagaaaaaatcggttgagattattggggtccttgtgttttaagatccttgtaggtcacatgtcacttgcgtgttatcttcattttattccctggtttgtttcttacagaggatgtgaaaccatatcaggttaatggagccaaccctacctacccagaatcctgttacacctcggattacttcatcagtaagtgctattgtccactctgcctctgtctttatgatagggatcctggaaaggctccctggcttagttgatcccagatgcttcaataataactctattgaaagcaatataattttaattatattctgctttttgttacttaatttatgacttgtcacatagtacatcactaagtctatgtgtgtttaccagtctacaaagttcctgcgagtgggaaggaatataccctgggcatattttgatcttatttagtcccatgtgtgtgagagactgggagagatttgattttggcctacatgctttgcttaactattattaaagatgattggatttgctatgggatccttctggattccctgcgtgggctgtgtagcatcatagtctgttatagagagtgaaactttgtttttaaagtgcatgatagcttagtacactatagaggtatccagagaagaacagtatcattggcttctctgatgggcctgacttcaaaggtagtgtgaaacaggtgtggtgtatatattttttttccatcttctggcttattgcagtttttattccaatggcaacattcaccacatatctggagtttatcaagagtgccaggaatgttgtagccattgtgcctattcacacagcctcctttatcctacatcacagtactctgaggaacacttaaccagacttattgtgcagagcagtaaattaaggcaaaagtgaaggtatcttatcaagggctgcaggtagcaagttgtggatcaaggttgaacccaagtccttctgatgtgctctttacttctctattaagggagtcagctcacatcacatggggggaggggggcttgataaggagtgagaatggattctctcaggtcccagtgtctccaactgtaaacattctccttttctaggctacggtatcgagcatgctcagtgtgttcctccctcagagttctcagagcccagcttcatcacagagtcctatcagacgctgcatcctatcagctcggaagaactcctgtccctcaagtatgagaacgactacccttctgtcattctccaggaccctctccagacagacaccttgcagacagactactttgccatcaagcaagaggtgttaactccagacaacatgtgcctggggagagccagtcgtggtaggtcacttttactttcagactccttggctgtacaaaaattgcctcggttccttcattgtccaggtcccgttttgctcacttatcactcctttattcaccagtcttagcttttcattttttcaagtgtatggacaagaaagacttttctgccgtgagattttagctttatccagtatgatgacagagacccttggggtccatgatggaactgagcatggcagagtaataatcaaatgtgttatcagggtacacggtttgcctacatattacttctagttggactttgaaaggcaggctgcagtttctttaagatagttttgcttgagatcataatcttgaaatttggcctgtgctttggcagcctttcagggttcacctgggtcatactgtagaccctggactggtacccgggatgaccctcgctgctcatcctgggaaattagccacttgtgacttctttggtttgggaagatacaagatggttaaccagtggtttatttggaactggtcatcaacagcctggtgaaagtatgtatttagctaggagaccaggggaaaggtggccagtggcttccaaaagaaggtactcttgttgacaaggctattatagcagtgataaatagtcgctggcagtgaagtcagtgtttgaaaataggtctcgctgacctgatgccccagaggtaagatgtacctgatgttgaacccatggccttgaacatcgcactctgagaaggagcctgttctgatgatcttgttgctgagaaaagtgaagtctgatagaaggagggtcttcttcacccaggaaaagcctagtagtttctgaaaagcctagaaatgactttcctggtgggaaagtattaagacaggaagaggagagtagtgattcttgctctccgaatgactccccgtgctacctgctcaatgtgacccatccctcctgtgctagggatgctctttaactgcagctcctctttgctcccagcctgccttgcgagagctctctggcctcgtacagggaaagtccctgcaaaatcagtacccagaatgtccatcttatgctcctaggttgtttttgttttaaactaaagggaatgggtgggaccgggtctgtcttccccttttctgcctgtcttatttttgggtacgtgtctatttaaatacataccctcaagtgtgtgcatctgtgcacttcttcttaagcaggttgaagccttagcaacattttttttccctcgtggggctgtctctctgtatatttaaggagaccgagttgtgggtttggggttcagccgtgttgtaaatctgtgtacatctgtaatcataccactttacaattgtggctggttttgcatttgtggaaatgccctcctttccctttcctcatcttggttcttggatcctcactacccttcaaaccctatctaatgattataaaccccaactgatccttaccgaaggacgtcaggtatttctttgtggctctcctgtccttcagttcctccaagctcaggccacagacttaaggggaagaccagcttgtgcaagcctgcttgctgcctggtagatgtgctgtgacacggctggccaaagggccattgattctgactgttgtgattggtctagactgaagacattactgttagctgactattaataatcgcagtattcagatgctgtgttacagtatacaaagtacttctctgtcccacttatttgagctctaaggcctgtctttgtgtaagtcttttctgtgggtggctgtgaggctacccgtctcctgttcagagtgctgttcggtggactcaattagctttggaaggaccttgcagaggcttttcttagagaagacagtcagtactagtctcggggatgcgtgcctcccggattgaacagagaagcagaacctaatccttttggattcaagtcagtgttttggggaaaatacccgttaatgaaggcttccagctccagggttgtgaaatagaactaagactaaagctgccctccacgctaaaccacagtctgaaccgagaaccatctggtgaggctgcaagagagtggtgacgcctaccttagcacttaagctaaatgaagccctttcagatcctggccctccacatacaaaaatggctgaagagataagaaaaactccaagagcctgaagcatagggaatacctacttatgggtgactcagagggcaggccatcctccgtggaaacacggttttccttcttaggcttttggtgtgtttgtgctagagtgaaatggaatggcagttagcatctatagctaggatgagaacacacctttgatgagataccagggaactctctgccctgctaagaagcccgtggcattccgtgagggtgggggtgctgctttcctgagaaatttaatgtgacttaaaaaatgagtaatggaaagggactagtgtggtgcagtcatggccactcgttccttaggctctgatttgctttgtgagcattgccttcttttgagcagagggtggagtgagagctggcatttctgtcttcatcactacaggagagagcagaagggcagaatgttcacagcagacatacttgtttatctgggactacttctttaattttgagaacaatagcttccccttgtattccactttgatttgggaagctgcttctgtctgagcattgttttcttaaccagtcctcagccagaaagaagctcgctgatgtggttggagaagaccctcttcctcttcagggtttagccagcttcgcacggtcgagaagcgacttgagggcactcctgcacaggcttttcttacctctctccatctcctagcgtacgttgggtaggagtggccatcccatctcctgcggtctgccgcgagctgcctgggaagcagctggtcattggccgtaacaaatgttcctggggtcccttgtagttcttcagtgtatttattttctcttaaagcttccatgttagcccccccccccttttaatgccatttttaccagtggagacttctccagcaatgcttgcccaactgcagtggctgtgtataaccagcttggggagatgaatgaacgtgcatgatcatgtggtctgttcagaatgctttaagcaactcaccctgtgaagggtttctgaccctgctctgggccttcattctgcagccaccccttctgcttctcctgcccatagagtttgaattccaagttctaactatacctcagagggtaactgatacagtttgctgcctgcaagaatgactgagctttgttgggttttgttttcctgtccctgaaggcaccccataacttctttctccatttgagagtcatgaagaaatgacttactatgtggggagaaagtacctaaaaggtaaaaggctttggttccaaggacaagggacgccaatctgcccttaatctaatagaatgttttttttcttatgatcaaaacattttaccaatgggccttcagaaataattccattgtctggagttgaaaaaataataatttgacagtgttttttttttttattaacttattaaatctactgtagtaaccagaaatctcatgacaagtagggctccaagcttctatatttctggctttagaattcttgaggtcccatcctcatgacagttccgaggagtagagccttactttggctactatgctcagaactataagccaggcagtggcagcagcactcatgttgtggccaggccagcatcctttcccctagtgtagactcaggacttctgggactcctgtatccctgggccctctctcccttcctccctgtccagatctaattagcaatctgtcctccataagagggattttacagctgttttttccccaacccctcttccctgccctcttcctacctcctcatttacctccaggtaaactcgggggccaggactcttttgagagcgtagagagctacgatagttgtgaccgcctcacccagtcctggagcagccagtcatccttcaacagcctgcagcgggtcccctcctatgacagcttcgactacgaggattatcccgctgccctgcccaaccacaagcccaagggcaccttcaaggactatgtgcgtgaccgtgctgacctcaacaaggacaagcctgtcattcctgctgctgccctggctggctacacaggtaggcacccagcccctctctaggtggctaattgcatgtttctgtgggccaggtcaagtgtaaggcacagagacccaggggcgtccctttttagttttgtgaagtgtagatgtttctgaagggtctttagtttcaagccattctgcttgtgagaagccactgatttttggaagccaatagtatcattcattctcaagggttcgcttttaagagtggtggaaatgtaacttttgaacttctttcgtgtctggggaagggacctgtgatgactgggagtttctgggaactgcctcatgagtagtatggagggacttttgctggcctgctctggggagaccttttcaaatacaaaaccagacttttgctggctttctcaaaggcagagttgaagggcctgcatgccaaagagtttcacagtctggttatcatggcagcctgctgactgaatgtaggaacagagatctcagccctagccacctccttcctgggcttccgtagccaaacacttaccaacaacagcagcaatagtaacgacaacaagaccaccgccactacactttaggattggtttccttccaggtgtgaaagctatcgttagattagtagggatttcagaaagaacccagagaacggatgaagttcaccaaactagggctcggacgagaagctcatggttagagccaggcatttctccattccagtgagcagcagctcctacggacttaacctaggagccttgggagagcttgagaaatattcaaaagcatcgcacaatccgtgtgctaagcatcagatcccctctacaaggcggtagtgctttcagggcttacagagtgcactcgagaagagccttggttcacatttgttagtccgatgttgttttgtgccatcctcttaagatgtcttgcactggacaggcgtgggctctgtgtgcctggagatgggcagcagacatggcggttctgttgacataactgaaatttttttcaagtgggatagaatagtcttggaatttttctgaaaattaagagatccttaaaagtgaaatttatatacttagaaaaattattcctcctttcaagatcaagaatatgttccctatattgcactccacaaagcccctagctagggtagtcattgcatcaaagggtgcccaggaattaaatccatgattgggagtggcagcaaggaccaaatgaagaatcatgagaaaaggacaaacttgagcaccttctttttttaaaaaaaaaaagatattagtagggggccttggcacatttcaagaggatcttttcctgtctctggagagcacattattgggaaattcactcattttcattgaagatatccgagatgagaaagagtacaagaagtctttcaaagtgtagaagagtggaagactttgcaattgagactagtctctctccatctggatgccatgatggagtggggaggggagagggctgcttacaggaaaggacaaaagctggggtggtgctcagataatagagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggacgtgtgaagcgcagttgaaccaaatcgattaaataaatgagtgctagacattgcgctagacatggtgagaagaaagccctacttgtaataaattgattatttcagaaaatgagcaccaactgggtgtggataagacaccacccccacccccaccccaagcagagtcagtcttatccagtttattctacacgtccttagacttgaactagaatctcttgttgctgtggtctaaataatggttgggatttgttaggtgtgatagcagaccaaattttggcagtttcccccatgacctctgtcttcagggaacacttcctgcctccactacaggttccctgagtctgtgacctggtggccccatcccagaaataggggtggacaagggatggaacgcatctgccttgtgttgtctcttacctgaggtgatggctgcaaatggggatctaacttcatgcaggcatgttaggatgacctgacatttggaaagtactttgagaagtggaaatcactaggtaactgttggcatgcttttgacatgtgtataaacattgcactagtttcctgtctctcgttctggcccctttctgtcctataaaattcagttgctgaagcttgtgtgtgacctataataggggcactcagacttctgcaccatggctacctggtctggactacatacatgtgcttatcatggctgcctggcctggaccacgtgcatgtgcgtatgtgtacctaagtgagaagagcatctcaccacacccctagacgagggactgaggtttcagtccttcctgcctctacaggaatacgttctcctccttcctgtgagatcttagttactgcactgtaagtgtggaaatcagttagagatggaattttcacattctcttgcacagttacattcttccttcaaagataagaaaattgcaccaaccttagcagggctcccatggcaacttgttaaattaggtcgagatgtgggggcagataaaaatggcttgaaagaaagcctgccttgcctgttagctgagtgagggctacatcaagcacaatgttggcttccgccgagacgtacctccttaccgtactgtttacggttatcagactgacacagtcgaaaagctccgttttctcttgttcataggtgcatgctcagtcccttctaattacaacactgagagccagccccacgctcactgttgtctgtattccttgtaaccttagaaaaatgctgagcactcagagtgtgcttacacgctgagataatcaatttgttataattatgagtcccttttgcctgtgtctagcacaatgtgtaatacgcatctattcaattcattgatttaggtgtagggataggataatacttcattgttaaatagtagtctcctttcctccctgtcagtctggccccattttagagatagtgaaactgagcacaaagagcatgctttatccaaggtcaggtaattttgctctgcaagaaggtggctccttaatgaattttaagtgctgcatgccttgcttgaatgcaccatctgttcttcatgttaaggaatgggaacactccttgagtagcctcatgtctttcacagagggattaagacccaggtggccccttgtcactaattaacacttcatacatacatgtgactgaggggaagggggaagggtaagagctggttttggcttcagtacagagttctgggcctgtgaatcaccattattgaactttattccccattcctagtcacagtcaccgataaaggcccattcataaccctgctgcaggtgacctactggaaatccatgtctgggtatgtcatcacccactaagctgtaattacgaaggaagaaagtctctttttcatctagagcctggaaaaagactatacctaaagccattcattaatgaccaatttggaagaatgttttatattccttccttctgtctctccccccactcctctctctgagagacttagagggaaaactgtcccagatgtcccactgtgggtcctcttacattgcctttggtcagaatgaatgctattctgtccattgcacagatgagaggagagcagcctaagtcacacaaatccccgggtcaaactcacaacccctgaggtttgattatagttgagttttagcatatagtaacctaaagctactgatgagacactgagagaataaacaacttggctacaaaaggaaggtctgccaagcccctcagttgaggacatggcctgtgactttggcataacacctacactcacagtcttctgaagaaaactgagttgcaaaataggctgcgttgtgctagggcacaacatggttggcagtgttgggaagctcttgaccggcccaagcgagtaatagggaagaaagagacagcttgctaagtttgtaatgtagcatgcatctgtgtagatttttgatattccaaacaggttaggaaaggtggcactttctaccatgttaccctgaactaggctcatggtgtaatctctccatgcaaatgctgctggcataaggcaatgagaggatgctagcattgatataggctgacttgtcagaatggggagagacccagattgcaagcactgctcagttgattgagagcattggcctcatttccagaagccagagatggccaggtaatgacttatctgagttccttcgttctggccaggctggagctaactcaggcttgtcaaaggcagtgcagtgtgagtgtggagtgtccctgggcagagtctccatagggaagaaggaagctagggacaagaaggatggagaccatctcccttcctgagcttaaggtgactgtgatgggtgagctgcaggaaagtgaatggaatcttcctgcccaacagtagccctgaggcccgagggactgatcctcagtcactgtgtagcccgatggcaggtcccagggtctcaccaaggtgggtttgagcatctgagtggagtcctgggttgattagcatgctgttcatgtcagcatataggtcaatggagaaccgctttggaggatcagggaggaaaattcccaggaatggaagtgggtgggaggagagcggctctctgcagcctgcagagccacctcacaggtcctgcctctcagccggttagtgcagtgacaacggttaatcattccccaccagcagaggaattcctatggttggaggctttggccgcacggttgttaactttttgtttctgaatgccttaacattttatgggaagaggggttccccatttctgctcgtagttctgaaggggccagggttggcagagcttcctcagaaccttcagctgatactgcacacggtgcctctggagttgctttccagtagtctgaacccctggggtacttgcacctctcggagacctgtctgtattttggattacaggttggctctctgttctgggaacagctccctgtctgatttagagaggtctcagagtctcacaatttgggggtcactgttcctttaacagacgctcgttatgcgtgatgaaattgggtggtgtctgcttgggaattccactctgactccagtgtgtaactccacctttttgtctttgaagcagggtgtttccattgagcaaagtgtagccatcgagctgtgagacaccaatacaagccctggctgccttaaagccatggattggaaagtccctattgcctctgacgtgtcccagattctcgagctctgccctgtagggtttcctttgcattgagtgcttttctgcccctgctgtggagagaccgctgctcagcacagaggctcaattccagaaaagcacccctcttcccgtggacacgcccgaagtgaggttgacttggtgtcatgccttcagtgacacctgccattcaaacatgccttcacagagaagtccagtttagacacttgaggggatggccactctgaggtgctctatcatgaggctataacctgtagggaccatgagcacagacttgggctctgccactgtcaagctgtgttacactgggaagtttcacaaccctgtgccccattttccttgtctgaaaatagaggtaatgaatggacccccatctcctaagtgtgtgtaaattagtggcttcatggagccgtgcagaacggtgctgagcacttaggaagtccactcagatgttcattcccaccatctttaaccctttcatctctgcggtatacttctattccaagtcagtaggttcatttcacttagagaattccagtaactgctgacgttagtgttagttaggccccatatgacgtgcagcccagtgtgctgcgtgtttaccagcacctgctgtgccctggactccttccgacagtaatatttgttaacttctcaccaaggccgcacatggaagcttctgttgttctcattttttacaagtgtgggattggttttgagggggaggggaatgtctggaccacagaggacatatgatgcttcccgaggctttacacattgtctagctaacaactgggaaaatatccaaaatagtgagatgcagataaaaagaaatggcttgtatgcaaacagtgtgtgtgggagagtctccaaagacaaagaaggaccagggaaggtggcagggaagcctctagaacatgcagtggacctggacccgaggaggcttgggtaggaagtgcctctgctccacctgcatctcagcctctcaaatggttcagccaagctggtaagggggctttgggtcacagttgcccaggggaaatacctctgtgtgtcccaggactgggcctatatgtttcttgttatgctctgtccctgtcagtaacagtcctgagacatcctgccttgatagggacatggtctctttgcccctgcagcaggacatctgagcaacagttagtgtgacagccacattggacccgacccacataagtggcatctcagtaagctagcatagcttccctgtctggccagtgtaagaatcatgtgtctccatggtcatggtggcccacgataggcttctgggttctgcgcataatgttggctgtaatgaacccagtggtgtgactcacatctccctaatagataaagagagtgaaagttctcctaggatgactgaattcgaaagtttagactcgattgagaggagggttgtacgcaagatatttaagaggtggcaggacacggctttgtggaggagtgtgacattcagacagaggggagcagtttcttgtgaagtcttctccaggctccttctctggccccacttcttcagaggcataggcaggacactttcagctttttgcatgatggtgaaccaagaaggatttttcctatagacccacgctgctgctaatattctgtttcatgtttcaccccagtctagtcaaaagccctacatgaaagatgctcataagttaggtgctggctgcgtgcttgtcagagctagtacagactgacgctcacttatgtctccccgagagttacaatagaccagactggccatgttcgttatccctaaaatgcagaggatcctctccccagaagttaagttagtcccagagatggactgccagagttacatacagagtctggagactcgggcttatagtgttactaatccgtcaactcatccttctctcttctgcctacttacctgggtatcagagcaaggtgtttcttttaagatacttacataggttagggggaaaaaaaaacttcattggtttataacacaatgcttactttctacccctgaccccagctgagatctctctggtggcttcttaaaaagtctgttccctagaaaaccccaggagggaaaggctgtaaagaaagccacttcctgacttgaggctcactgatgggctctgcaggctcatgtgcaagctaggctgaagtgcgcacggcgcgacaacatctgtggtgggcttagaggcaagaggctgcctctgaactttagattataaacggaggcagcccctttaagagaatggagcggtcttttttgcctgttgccttccacccccacttgtggacacttgaatgcacacaggtgtgcagagccacagcagcaacaaaggcctttcgtcatacatgaaaaatgtgtaactgccttctccagtccaaggcaaactagcccagtgagtctcagtgaacacccaggtggggcgcccagctggccacttgctgccctcttgacccagtggccagtttgtctgggtcttggtggctaggcaaggcaccccacttctcagtactggtagaccacgtagacccatgcttgtgcaagcactggggaaggtagtgggggcttggccggagcaggaatgattagagaaaatgcatcacgtgggaatgaggagctaagtctgtctgtgacccaggtttccccaagccaggtcggttcctaactctgctacctctcatggtgcgtacccactcttaattagcgggtgctttcattctcattctgaacttacaatagttcagtggttattctgtaaagatgttttaaaaattacattgatatgattgatttttaaaaccatctcccaggtttatacttcctgaaagttgccacatgaaagttgatttcattcttggaagcattattaaattttatctaggcagtttacagctattcctttgaaagttctgttttgacaaatgcctcttccgctatctttcgcttttctgcacgattcctgtgtttttcccagactgctcggctctgacgttcattcctcagtgttctctccttatgactgccatttttctctaagagaggcctaatggacatctgtagattaaagacaagcaaaattgctattccattttaggaacaggaaaacgaagcccagggagtttgagttgcattatctttcattttcaccaggaagaattaaaatcaaagttctgtatgggtcaccatctgtgcaggctttatgtgtatatatgtctgcatgcatttgtgtgtgtgtgtgtgtgtgtgtgtgtgtttttctgggtttctgaattatttttcatcactgtgtttagcaagttaactttaatggtctcattagtagagtttatattctattcactactcttgatttgtaggctttaacacagggccacatttatggagtacaggatagtagggacttactaaaccaaggcattgtgggaagactgtagaatacaccatatttaggccacgttagaggccagatgggatggtacagtggcaccagaaagccacaactcagaagaaacaggaggtgacaactctaggcatagaactgaagtagatatcagacagcctttgctctctcttatcaaagttctctccaggccttgagagccgagctacagagcagtgtcatcctcacacaggccccagtgcagctctgcacagggtccaatacacagcaagtaaactgctggctgatttctatttaattggcccctcaacaccatgacttcatggaaacaataagattcttggattgtttgtaaatgacttagaagggtgtatgaagactctggagtcacccaccccatcgcagagacaggtgctccccggggtataaaaagggaggctatgctgagcagacgggtcacttccggactccagtgttctgtttttgctgtcgccgttggctgtgggcagagacacctggctggaagggaggggccagccaggcttattcgctgttttagggccacctgccagatgtgtctcagggcagagtcagccccgttgcaagggtgctcaaccatgagagtttcataggttaaaataaatatgccattcctatccacactgaggtattcaatttgaatttcagagtagaactaaagaacttcagcttcttagagcgccatgaaccccctaaggacaagaggtgtggctgctttattttgggagtgtgttggtacagcatagcctgggtgtcatccatattttggccccaaatataatttaatagagagatgcctttaggtacctttcaaacctgtatgcttccaccccccccaccccccccgaggattatggttttggcaaaagcattcattaaatgttgaggtatcatggctgacatcacaaacgtaagagtaccaacctggaggcatttgataaaacacatagtgttagaattgttagcagggaggtgtgtgctggtcaggtgttgtcagagggcctccatggaatcatatacattccagtaataggaaacacagtgaaagtgggaagatgggcagatggctcggctggcaatgtgcttacctcccaagcacgaggaatggagtttgaccctcagatctctagcacctaccttaaaaagcatggcacattggtgtgctttcgacatctagtgctaggaaggaaaggtcagggagattcctggagctctggcctagctagctagttagctctagtctagtctgtttggacttccagatcactacagcagtgggtggcttctctcagacacctgaggtttcttttcctctatatatgtgcacatatgtgttcacccacacagccccacagaggagcgatgtagggatagtttaaaaagaaaccttggtaaaaataggagcagtctgccaggacaacagctgtctggtggcgactccatccatacgagctcacgtcttgtgttagcctcttaccagggcccagatgatagatatgaactacatttgaagtggaaatgtggatggagtagaagaacctgatgtctaatcttgcctcctctactgccagctttgagtcactgccttgggcaggtagtctgcaagccgagaacacaaaatgaatgagggtgacattgtcaagtgtgaagggttgccatagttggtcttgctggtgcaaacctccaatctcaactactcaggggtatgaggcaggaggattacaagttcaaggccatcctgggcaatggtagtgagagcccgactcaaaatgcatggatgcttatatgaataggtaattaaatagttgagagcatggctcagtcttagaaaacttgcctaccacgtgcaaggtcctgggtttagtctccaattctgtaaacaccaacaagagaaacagaaaccctcaaccagacaagccagacatttgtgcatgtgcacgcacacacttcaataaggtttatttccagcttacttcaaggtttagcctcagagtcagtgaccaaaacacaggagacctcaatattcagtcatcaacagaagcattaggccttgcaatttcttgataaagatgagacataaaatgtgacccagatgagcagggatttatgggaagctgcctctgatttgtggcctctctcaggtcccctggagggtagcaggcttggtgttctttgtctcctggcccaggctgctccgtgtacttctcccaagtctggattgtggttcgcaaactagtactgccagcatcctataagaacttaactctaatatcaagtccgagaaggagaagccatcaggaagttccctagctggggtggcctgagaagagcagagccaggggtacaaagttgattcaggagctgggagctgggtgtgtgtcctgtgttccttcatgccccgccttggaagacctccttctaacagggacccctctgttgttgtggctccgagctctactggagcaacatagtttcccaatgatgcgactggattcctgatgtgtgacaccgtggggcagcatggtgaagggctccgttgactgccttggggccccagacaggcctgccattgtgagtcacatttaacatgtgagctcccctttcccatgactggcgctattcttagtaccagtttctgctctgggcgacagaggttcacggaaccacaatccatttgggtaggtggatggggccaggatctgggaaggggaattgaagaagtgttgagctttcagagcatgttggagcatgggcaaaggaaggaggctggagccctgagggtgtgaacaggtctacgctaagcagtcgagaaatggcctcaggagacctgtaactgggactacaagtctctttcgtgagtctggggtgtggacttggatgtggctggcagatatgcaaagccagtaagcattgcgaccccagagccaccttcatgcttgtgtctccaaggggactttccctccagaactgaagtgaggctgatatgttgctgtaggaacagggaaggtccttgtgacatcacccagcaaagtgataactctgaagccacagttccatacccttcctccttctgttgctctctccaacagaagggccgtgtgtagaagtcaatgaaaagtccagttgggaagttttaggattggccctgggattgtctcattgggtacaatggtcggttcttatcctcactttggggtggagaggggaggggaggggtctcactgtgtagaccaggatggtcttgaattttcacttctcatttggcctcaataatgctgggactgcacacagatggatgctagcgtttaaaattcctgcgggctgctgggagcgctcgggtcagctaacctgtgttttctgcaagagtcccaggaaggagacttgagctgatgttgccactcagtgaacaagagacatgtcttacctttccagctctgcttgcctgagataacttgtcttcctttttcttcttctctctggtctagaataaaagatggcaagaatagttaatcctaggaggtgggttaccaatgctcataccaacactattttgttgttgttgttccctctgaacgtaggaaaagtaacattaaggagaaaaagcttccatgtgaggactcccctgtccagccacattcagacattagtggtcatcacccataggctgtggtgagttcttggccactgaagcttaggtaacactgtaaatttcttctgtcccccaagctggcactcataatgtgattttgaagtcctcttctttttgtctgtcccagcctgtgctgtactcctgagtctgcctctttaggacctgcaattatgctcgctacccacccgtcagtgactaggacctgtctgggtctttgcatctttccatccctctcctaatcttaataggttagccttgctctaagagaaaattttaagacagtacaagagaggttctaatagtataaaacttagccacttcagggggccttctggggctggcactgtcacttgttgggataggtacccagcatagtaggccatgtgtatctcaagagtgtgactacgtgagaagcaagggagatggcttctgaaagccagaaccatttagcactcgagttacggcaaccaggcagggaatctaattaggcccttggcttttggtttgggcagtgtattgaagaatctgaagtcttgacccagctatcctgtttctcttctgaatgccttcacccaagttagatagctgtgttgtacattgtggttttgttgttgttttcctgcgcggtagaaaccgatagactaataacagtatctatcccgttgagtcactgagaattcacaagcagagaagaaagcgttgatgtgtagctagggccacagtgattgatgtgtagctaagggagtgtgtagcagctccccttagttttttgttagcaatcttctcatatttgaggtctgtagtgttaatacagagtgcacataggactcaggtcatcttttctgtgtctctctgtcagggatgtgtgagattactgagcatcatcaggaaacttaagagttgacaccggagctcttatatagtccgtttctcaagagaggtttgctcccgggtcaccaagaatggcttctcagtgagtctctcatttgccatctttagcttcctgagctcagagcagctgctaacttacctggactcccaagaaatctgaacacgtatttgagttgtacactaagtggattattttacagatgggtagatgtgacgggagtgaaggctttacagccctctaggtcgtttgcttagaaggcacttgctgagtgcttttattttcacaatgtgttttgcaagatggcttcacagagctggaggtatattctcattgtggtaaggaagagctggctcctttacttcacaaagcttatgtgtgctgaggagagactaaactcctttggcaccagggagacataggcaggtggatctctgagttttaggccaacctggtctacaagttccgggccagccagttctctgtagtgagtcatctcagaacaaacaaacaaacaaacaagattagtaattccgtagaacacgtgtgaagatagacttggtgttgtctttccagaaaactctggaattaaaagagcacagcaattaaaagagaccaacctggaaattaataaaaacagacacatggtgtatcatcctgtgtgatttcctttttcttttggaagggaaatctttactttctctgagcgcagagtactgactccagtgtttgtgctgtcgcttgcctgagttttcgcctgtctagacaggctgggaggctggtgagggttgctgcctagtgggcctagctgctgtgagccttcagtgtgttttgttaatgagccactgtgccttgtgcttccaggaagtgggccgatccagctgtggcagtttcttctggaattactcactgataagtcttgtcagtcctttatcagctggacaggagatggctgggaattcaagctttctgacccagatgaggtatgtaatgagtgacttgggagtcctgggctgagaatgggcgagagaaaatgctgggattgtgatcctgtaggcccagatttctagctcagctctgctgcttgctgcgtgtgctacctatgatgcagccagcccgagcttctgtctcatcattggcagagcccaaagtgtgtacactttctgggacaaactgatgtatatataagttcctggtacagagttggtcctgccctctgtctagtccctggctctgtgcatctggaaagatgcatccactctgatcgttttccatcctttcatcccagagtgttgaataaatggttggtatatgaacgaagagatctctcttctggcagacatgagaacgtgtctctaccctggtccagaaaggatgcttcctactggtggaagcagaggtgccagcgctctcctcccatcctctcccttctgcacagttctgtgctttcattttaaggatgcctgcttataatgtgggccagagggatgtctgccccacggctcttccttttccttcaagaccaagtgttttaactgtattccagaggagttcagagtcactgtttgaacaagtaaatggaactcaacacttggacacttgaaattagaagttctattgcagtcacatgtatgggatagggacattgtcctattgagaggaatactctgggctcagaaagacagcacatattctcgcttacatgtagacactgaattgctgattccacagacacagaggataaaagagtgacgtatctgtgcatggccaggaggaggctaaggggttggggagaccctggttaatgagcccaagaatgcaggtacaggaattggcaactctggaatctctgtggcactgtagggtgcctacagaacattagcaggtatttcagaatcgctaatgtgggttattttgcatggtccccagaaagtaatgggaaatgcctgtgattgaagacacgccatttagcctggtctgatcacgacacaatgcacagctgtattaaaatgttgcattgttctgcctacatcttttgaaataatctcagaatgtccatggctcctaactatacattcaatgtatagttattataaacaattcaaaatattttttaaaaaaggaaatgaaggaataagtcagacatatgcacacacacacacacacacacacacacacatgatgtttgtttgaccaccatgatggatgtgaagacttgtatagacacttgtatttaattttatttttattacaggtggccaggagatggggaaagaggaaaaacaaacctaagatgaattatgagaaactgagccgtggccttcgctactattatgacaaaaatatcatccacaagacggcgggcaagcgctacgtataccgctttgtgtgcgacctgcagagcctgctgggatacacccctgaagagctgcacgccatgctggatgtaaagccggatgctgactagtcatggacagacgcgcagaaggaaggggctgggggaaccctgctgagacctttcaaagagcaaccctgttggttggactcttcatttttaattgttattcaatgttttattttccagaactcatttttcacattcaggggtgggagctgagggagcgccgctgtattccattggccattggtgggccggaaagaggaggtcaggacctgcggggtgggcggggcaatagctcctgagcagactttcagaagggagaggtcttctcagaagcctgttggacctggcttgcagaggaaaaaaaaaaacttaagtgtccggttatttttttttttttaaatcaaagaaaaaaaaatcatcttgagttgtggatctactagtgggaggaatgatcacattgagatgaaagagattgatgaaagccagtcagttttgtgggtgggctgaaaacagtttcttcaggggattactaaactcaagaattattaacctttctactttttgaaacaatgatggactttgattgaaggggtccaaaactgtttttatgttgaagtttattttattaaattttgtgccagtatttttttttccttaaaaaaaatatcgtcttaagctctaaggtggtctcagtattgcagtattgtgagtttgttgttatttgctggctgaggactcttgtcacagtgaaagacaactgtttatatagaccccattggaaaaatcccagttctgtactgagatcagagaccccgaactcttacagctaaaggaaacgaatgctgatctggggacagggggactgtgcgtgtgacttccacctgcggtttgtaaaaactgttttcctttgattcactgtcaggctttggacttagtgttagttacggggcgttaagtctctgcactgaatgtattctgcagctcttctatggaatcgtcggcatcatagcacagttcaagtcttggaaacgaaatccaaggagcaggattaacctgggttttggttaaaccgctacccgaaacatggaagactcagaataaaagccgtttgcatgggcattaccccgagggtcttaaggcctcaatgcatgccattccaaactaacattctcagttctcctctactttgtcttatgttccccccggcatccctcattgctgcccctccctcatcactgatcagtgaaagtggagtgtaatgcatcctgacacgtgactgaaagtgtagtttcagccatcacaacacaaatccaagagtccagacttgctagggctcggaggccacggcagtggagagggtatttcagtagcatgtgactcggcctcctttgaagacttggtgctcgtcaggtaggatttcaggtgagactgcttgccgggaagtggcagggagcactggcacttgacctgttaccacctcagcagagggcaagcccaggtcaactgcggtgagagggagacggagaaaatacaagggaaggcgcttaggtaaggaaaataaggtggcccgagacagttagatagatgtttagtttcctccaagtttaaactcaaagacttaattgaggcagccatcatcctgcctgatgggagaggagacctgaaaataagccattgtgggttaaaaaaaaaagtaaggagacatgcctgggatcattagaatcccttccactgtatagctgcctagttaagacagtgacagtgacatccctgagagaagagaggcaattggctgaggtgggcctctccaggctcacccttcggggtttgtagctccctggtatcatcttccaggagagttgatggctgactcccacattcccttgaagactctgaattactaagactataactcttgtccgtgggtgttctgtactgactgagtggagcatccccacaaggaagcaaaggccaaacattccagctatatattttgatcttacaaatgcaggtgccttaatgaagctctcaaaatatttaggagctgctcagggagtgttaggtgggatcatttggattatgctgttttctcttatgttatgtgatctttgttgggcactgacaagtgtgagtgtgtgagtgtgtgtgtgtgtgtgtgtgtgtgtgtgtgtgtgtacatttgtataaagttgcagctgaaatagtactgaattttctacttagagtctgttcacatttccataatggtgaatgaaagagtacagccggggctggtattattgtttgctctttgcaacagggcttaaaaaaatcacttccccaagtcttcacccttctccatattgggttcctgctgggaatgcccctcctgagagcctaccacctgcagtcccctagcagagaagacataagaaagtgtctcccacactcctcagcgtgctgacttgcctgccttgatgccctttctccctaggtccaccactttcaggatttgtagatagtatattagtcagacagctttgttgtccatctggccagatgctttcccccatctcctccgaaggccagagaccatcccaggaagagtggcgggtggtttatacactggaaatgtagcagcattgctgcattgatgctcttttaaaacacgttcacttcacaggaaggatggacagatctgacctagctgggcgactccattattttcccagagaaatgctttaacctgtgtggctggctttgggctcagaggcggggctaaggatgctccctgcggagagctctgatggtgtggccatggagaccttgtaaagcattcaggatcagagatgctcttcctcactttggagaccagcactctgggttttaaagcattaaccttcatggtgaaatcacaccttctgtctcctagccatgctgtgcatgcggccttctctgttggggtctatataaacctgttgaactcttacgtacattccaaagacgtttcaaggaaccacaagtatatgtatacaaatacatatatgaagtatatatgttaaagtgaatttatctctatcaggaatactgcctcagttattgaattttttttaaggatacttttttttttaaagctgagaattattgaggtgaaaaagatgttatattgtgtttgactttttccaacttgtattttcatataatttatattttttaaatgctgaaaatttaaaagcaagatttaaaaaggaaaagcaggtgctttttaaaaatcagaactgaggtagcttagagatgtagcgatgtaagtgtcttaaatgtttttttttaaacaaatgcaaaaaattcttatgggggagtttttggtttgtttcatttaagtagctgatgctggcacatcattttgctggaaaattttttatatactgtaggctgatttcatattgtattttaaactgtgtgaaattaaagaaacaaagaaattcattcataatgaggtggctctggcttgattctttcctgtctacgtcgtgggagaattaggagaaatcaatcaaccagagaaaagcacagaagaaatacagggcagttctccagatcctgcggcttagggtcattctagataaaggttgcctaataaagggttagaggtatagggacacaggattcgtgtcccagtgattccctgcattgtttgtttccacctgtgctgttgcccccaccttccttgtcaaacatcactgttcatgtctgaaggaccaagaaccatgtgaagaaaaaaactgacgactcaacgggtagtcactgatggagtccagctaggtccagttcctgatgttcatatagacaaaccatgatgtttggtttcttctgaagaaatctgtgctctttggcagttagaactcatcacatccatctctttggcctcaacttttccactggggctaggcacgaagaaggatactatctgttagaaccactccagcctatgtcatgaatagaatacatacttccaagtgttttgggacaggaatgcttagggctgcattctgtatgcgggtttttttttttctagttgaaactgtagaaggtggatgtttttaattaacaccaacatttgcaacatgaatcccaactcacagctggaaagagaatttttgctgaattgttcacaaagagaactgtgtttttggaaaatctgtttcttcagccctggaacttgaggtttgctgagcacactttaaacacggactgtgtggtctagtggtcagagcccagctggccaggagagtggctttggtcttgggtatctggtaaagccactactactcctggacagattttttttgttgtcgaggtgaggtcctcagattttgtccttctcagctgcaaacctggacaaagcccctactcccaagccaaccagaagccacatctgaggtcctctaaccccgcataaactattcaaatgggttgcagcttcagtcaaagctttggacaaaaactgatccaagttgacgttatctctcaggatatctgactacacggagaccacagtaaacagcacaaggcacatgtgagtgaagtcagcttagccccttctctctgcatccagaagccacagatccagtgggttattttcaggcagttgggctttggtgctctcttaatgacaccaataagccactgtatggaagccattgtggagggaaaggcagtaatacagcaaccattgcaggagttgagaaggatgggtggggtaaggtaagagctactagcgacaggagtcacttaagagaaggtgggcatgcacagacttcacatgctttcagaaggtaacaagtaagatgtgccaagtggtttgaatccttgtggccatgaaattatatccaattccccaaacaaagttctgaccatgcttccatctccgggctgataagtggatacatgtggatcagttttctgtagctatcagaacataactgaggtaagtagcagagaaaagcattttctttggcacagagttttggagcccaaagtccaaacttagtggccctatgtatatgacctctgttgaggacctgatggtgggggcatggtgttgggtgggtgtagacagagaccttccctgatgagatagggagccacagcgattaggggtcaggcttggtatttttataataactctcaagagaactaagtcgttttcaaaaccagcatgaatcccctttgaggtcatgtcctgtcctaaccactttccaccagcctccatctatctccaagaggctgcaccagcacactgggatgttaggttcaaatcatatccacaccatgacaaagcttttcaacatagtggactgtaattcttttaacctaaagagagattgtagtctgtgtttggggggaaatgagggagagaccatggaagatagtggtaacaaaacaacattccttctctgagatgattcgattgtccttcagagtatggaacccacttacatggcccaaatgagtaacctcctgacatatgccatgacactgaataagctctctcctggatgaataagactcttatttcatccccagtgggccagccccattcattcatttacatgtttgcctgttccctgtagaatgtgagtctgcagctcttacatatatctctccttagttcatgtttatttaacatgaagcttattggagtcaagaaacgctagtggaagggagtacaaaaggtccccgggctcgccagagagccatctgacttgtaaccccttgtttcttccatgtgcttgccctaggacttgaaagacttcctttgaggacacagggtggtggctcaccctctgtgagatccataatcctggtactaagaggtacacttcatcctctaaacatggaaagggaacaaagtctccttttaagcaaggatgcttttcaactgtcaaaatcctctgtgacctctcctttttggtagagttcgcgctggaggtggttggtaatgtggtctgcttctacagaggctcttctctgtctcagattgggaggatccttgatgcacctgggagctgcctctaggaccaaccctagccacttggtacctatcccatattggctgaatttactgttagctgcaaaccacccaaagggagccctccatgctataaaaccccacctggtcctaaaagcaatgaaaaacaagaccaaaaccattctatggtacctgttgtaataaggcaatcattccaggggtctaattatagcaggcgttgatgcactggagaaaaatcccaaggataaatttgggtcacacccataagttgagcgcttagaactcaggggataaagtggacctgtcctctgcctttgggccaatgccatttcctgttttactttatgtcccagccccctcctatgtttccattttcctgacaaatatgtctgtcctgggaaagccactcttcaatggcctggcatatctctatgtgctgacgtccaaaataacgatagcaatgaacatctgcccacagcaacaagaggaaatctacaatggccaggtcttgtgacacgctcccaattcccaaagcctgcagggagtttacagacctgtctaatctctcctctctgtcactcaggctctgatacgcctagccacagcactgcacagggaactttgatgttgagttgactctggtcactccctgtgataagacataaagagtctaggaaactttcagcagccacttgtggtaattactaaggtcagagatggccagtgtcttctctatgttgtctgcttgacacactatcagttgaagccattgcacctgagctattctatagcaggcaattgtaacatttgtgtaggcaaatgtgaaactacagcttattctttgagatccgttcccaaggtgtacctgcaaataacaagagagcattgacacttgaaaaactgacaccggtcttcagacggccagaccaccagtggtaacaattagtagctttgtcaactcaagactcctccaaactatggaagagagatggcaatagggactttctatgtactttgggaattttgtgcactgttcataagaaatggtagctggcctcacagatctctgagacagaaagttcaagacctaattcagagatgggggtgttgctcagtgatgagtgagcacttatctactgtacacaaggtcccaacgatgcgaagaaagggaggaaggaaggaaggaaggaaacaacacagcccaaccccaaccccatccctaacaattgagagcctgtctctcttccaagctacattttaggtcagtcttgttccataatttctgacttccctgtcaatagaagattcacaaagtcgcaatacacaaagaaatgtggtcctttaattggagacatatacacacatctgtatgtattttgtatatgagtattatttgcatcttaagtagataagatgatagacaatgacgggtgtttggagtggccgatatgtgtgcatgtatctgctttctccaaagccaagttttcagaacagtaaagtatatccgtgccctggtgcccaaggaatttaaagccccttttatgccccatcacagagccctggaggagggttcgagtgtgccaccggcatgatactggcagcacatgttcattgctttaggaacctgtgtgtttagcctacttgaaattccacatcagaactctgactacagattccaaagagtcttccctctgctgctgtatgtgatgatccaaatcctgaagcccagacaacaaagacaagaattaaaaacaagggggaacacataactgagggaatctgggagcattccagtttcctcaaatcattctgtctggctcttgctggcagctcctttctcctctatattgagttgaaaggtctctttgggaaacacaacagtgtttcaggggtgtccaatctacaatttcatcacaaccattttgtctacaaatgtcatggtcaatcctgttataaagaaaccaaacaaacaaaaatcaaattacaaaataatcacccccaatcttacaatgttttaaacttataatttttggaatgggacaccttcatagttattgtatagtacatttggactgtggacagtaggttagacactcctagaagagtgatagccaagagtcaaaatgtcagaagtctgattctacagttttagaatccaaatcaccttaagttgacattatacaatcccttcagctaggcagtcatgatttcacagggcagtggagggtacatgacttgtgtcctccaactatcatccattggtgacagaactggtacaagaatgcgaatcctattttactccaagtcctcccacattcttcttctctacttggattattctcatccaatttccaggtaatgcacccggcttaagctcatttctagaggattcgctgttagtcctcattattatttgtattagctgtgatggattcaataccctgctaaatgctgaggtcacctaaggaatggatgagaatccctctccagtgagattgacactggcttgataccaagaacaagaacctgaagaggtctgtggtctgaatgggtgaggatgatgccagccaggtgggaatgggagaggttgaggtacagagaaaacgtgcaacctgcgagagaaaccataactcagaaggacagagcagaagctgcagaagcagaggctggggtggggtcacaagagatgggcgtgaggtgaccctgtatggtgggccctgtgaagcacaaggtagagtcttggcactcttcctactgacttagccacagctcctgtgttgtgcttagaaaggtcaccctgtctctacatggcagatcagaggggacaggttggaggaaggaggggagttggaaacccagttagctcatctgaagagaggtgggcacaaccagaaagccactgaggttgtgggatgcatgccctggtgatgggcaccaaggtaggactctatccctgcaaggtggactctatttaaagacaccagtatcatccttctccttgggtaccagtatcatcaggataaggattttagatctgtaaagaacagtagaggtaaggtccagtcttatcatcacatcctaagagttaaggcaatttcagtcacattgcttgactggcttaaaaatcacgctgtcagtctaacaaaggttaaaaacttgaatctttaagtgtacccaataaagaatcaatccagaatggactgtttcttctcaccataagggcactataaaccctcaccagccctggtgcctcctctactcaggctgtaattggaagaataggagaaggctgatattcctctctcagcttcagtttctgctcctccagccatacagagagctgcccagctatgtttggcaagtgaacccgagcacattcccagaatccctcttggggcataaggaagagcaggagtctgttgtatcttccctccaaaaggatcctccatctctgtacatagcctcacagtgcaccttctgagctaatagcctactgcttttaaagactctgtactattctagtccctggcgatttctcctttctgtcccatctattctgtttattctccatcttgccttttttctcctagtgtcttgcatcttgcaattttagagaagcaaattgagaaatgaaagcaagaagacattgcattgaagggtcagcactctgaggatgcaccacttggttttaagtccaggccatgtcttttgtgagctgtgtgagcagacacgctgtttacattctctgtacccctctttcttcatctatgagataggaataatgataaagacctcaccagggtgatatgttggttgccagctggatgtagacctacaaggaagagagttaatgtataagaaggcatgcttaagaagccttttctccctttagagagccatgttttccccagacttacaggatgtggactctagaatgcctttttgtggaagaagagggtctgacttctctgaacaggccttgggtatggccacaggcacccaggccatcggcgggtcaccgcagctgcaggtgtgtgcctgccaactctgggactcagcactttccactactgctggctctgtttgttttcttccctaggctcctcccgcccagc

SEQ ID NO: 344 - DNA, 1496 bp, Mus musculus
ccactgggttcaaaaatccccattaaaaagcaaaacaacagttacagcaaacttactctcatcccgccggccccctcaactccgggcaccatgaaggcggccgtcgatctcaagccgactctcaccatcatcaagacagaaaaagtggatctcgagcttttcccttccccggacatggaatgtgcagatgtcccgctgttaactccgagcagcaaagaaatgatgtcccaagccttgaaagctactttcagtggtttcacaaaagaacagcagcgactgggaatccccaaagacccccggcagtggacagaaacccacgtccgggactgggtgatgtgggctgtgaatgagttcagcctgaaaggtgtggacttccagaagttctgcatgagtggagcagcactgtgtgccctgggtaaagaatgcttcctcgagctggctccagactttgttggggatatcctgtgggagcatctagagatcctgcagaaagaggatgtgaaaccatatcaggttaatggagccaaccctacctacccagaatcctgttacacctcggattacttcatcagctacggtatcgagcatgctcagtgtgttcctccctcagagttctcagagcccagcttcatcacagagtcctatcagacgctgcatcctatcagctcggaagaactcctgtccctcaagtatgagaacgactacccttctgtcattctccaggaccctctccagacagacaccttgcagacagactactttgccatcaagcaagaggtgttaactccagacaacatgtgcctggggagagccagtcgtggtaaactcgggggccaggactcttttgagagcgtagagagctacgatagttgtgaccgcctcacccagtcctggagcagccagtcatccttcaacagcctgcagcgggtcccctcctatgacagcttcgactacgaggattatcccgctgccctgcccaaccacaagcccaagggcaccttcaaggactatgtgcgtgaccgtgctgacctcaacaaggacaagcctgtcattcctgctgctgccctggctggctacacaggaagtgggccgatccagctgtggcagtttcttctggaattactcactgataagtcttgtcagtcctttatcagctggacaggagatggctgggaattcaagctttctgacccagatgaggtggccaggagatggggaaagaggaaaaacaaacctaagatgaattatgagaaactgagccgtggccttcgctactattatgacaaaaatatcatccacaagacggcgggcaagcgctacgtataccgctttgtgtgcgacctgcagagcctgctgggatacacccctgaagagctgcacgccatgctggatgtaaagccggatgctgactagtcatggacagacgcgcagaaggaaggggctgggggaaccctgctgagacctttcaaagagcaaccctgttggttggactcttc

SEQ ID NO: 345 - protein, 470 aa, Mus musculus
PLGSKIPIKKQNNSYSKLTLIPPAPSTPGTMKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMSGAALCALGKECFLELAPDFVGDILWEHLEILQKEDVKPYQVNGANPTYPESCYTSDYFISYGIEHAQCVPPSEFSEPSFITESYQTLHPISSEELLSLKYENDYPSVILQDPLQTDTLQTDYFAIKQEVLTPDNMCLGRASRGKLGGQDSFESVESYDSCDRLTQSWSSQSSFNSLQRVPSYDSFDYEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDAD

SEQ ID NO: 346 - DNA, 79799 bp, Homo sapiens
  misc_feature (1)...(79799): n = A,T,C or G
aaggttcttttgggcaactggtcagcataggtagttaacaccagggagcagaatactttttctgaattccaggtggcaagtccaagcttgcagggagtgctatctaggtccagaattctgtagctaaaatgtatgtgtatggcacaattagagatagatagaggtttaggtttatagcacaagttaaaccgttcatgccaccacactccagcctgggtgatagagcgagaccctgtctcaaaaaacaaaataacaaaaacaacaagaactgttggctggcaggaaaagagacagccgaggaaaatgtaagatgcaataacatagaaaaagacttctgtgaagtgagtgcagtaaggtgctgcctaatgggtgctagtttgggaagtacctaggcagagtgctatgggggcatattgaatagcatgtgggattcttcccagattgaaagtcaaatgctgaggccagttgcttaagaaggtcttattttgtttaggttgcaaaaatcattggctatcaaacgtgcaatccagagagtggagaacccaatactggaagaaattcaagagggtacatattctctttgctgctaatttgtaatgtagctgtgagtatatgattagaactttcataattgtatctcacatctatatagtgggaattaatcccctttcatccaagagggatggtgtcaaggatttgcatgatttgcatacctagaccaaaacttatctttgtcactatgtcatgattttaacagcgcacatgaagataggacactgtgtcctcatttcttcataagaatactatatactacagtttggattaacattcatgaaaattttatgctcactaaatccgaagtcacaattctgatttttaaaatcaataatagcagtgaagggttactgagtcttcattctgcatcatgcacagtgcaaagcacttggcacccattcatctcatctcatctcagttcaactctgtgaactaggcactttccgcatctccattctgtagatgaagaaactgaggctttctgaggtcaaagactgacatctggagagcagccaagctaaaattcaaactctcgtctatttactgccaagcttgtgctcttaacccactctactatgttgcctccctggttattttagagtttaaatttattctatagtgaggaaaccaaagcctggtagtttctgcttggcaagaaactgcaggtttttgtatggactatttggaaacaggaacacttatttgcaatagcctttttacctccacacctcagttcaattcaattcaattcaattagacaaatacactctgtaggagaaagcattagctcactaaaagtggatggatatgtagatgctggacctttcctggatctggaattttgttgccagccatctggtctctctcaatgctgtggaatcccctgaaagaaaagtttataatcttcttgatttttagaaattctcaacaattattcagaattttaaattcctggaaagggttctctcttgggaatctgccatgagagcgctgactgccctttgttttttcctctcacagtccattgccagcttcccacccagctgcacctcctcccacccctcctggatgggtcccttgtggtacttcccacccaaggcctttttgtgatgaagtctttcaagatggtttcccaatctggggagaacacatgtttctgatcattctgatgaaacacgtttccattaagaagcaacttctatatgctttctgctttcttcattctgcacgttacctgtcattacctctcactgccagccctggactcttgaaagtgtttcacaggcctgtctgattaaatggcgccctcttacacgtcacacatgcccattttgcttctcttcttttcaccaactcaacggaagaaagatttttattgtatgggagccaatccagatagatgagatgtgagctgggtctgttccacctcatgagtcatgggcaggaccatccactacattctgactccttcacagggctgatgcaagatgtggagtgagcacagctggctgcttgcaaattaaagaagacttcatttctttttggtccttaagagctgagaatcaaatgtgagctgtaacgctggagaaattgacatgtccctttttgagcttcttattcaaatctgtcaactttacatcattggcatgcttgatgctcagtaaattctaaatatgaataattacactggacaccctaaagttgttttaatgaatttatgttcctgcatatttatgaaactcagattctgtgcacccttttcaggagagtacataccagaaaagaggtttaaagcagcatgggaacttaaaaagtgctatgcattttacttcctctgttggtagagttagcattggtgaagctaggattcatattaattcattatgacactataatgctgctcattgaaggatgcctaaggtaagataggcatagattcttgagtaaaatgtttgtggatgactgcagtgacatactcaaagaatgttatatttactggctaagcaggctgttcttagtgtgacacatcaatgttttcttggggctcttatacggaactggttctggaagaagtgatgtaaaataatgtgtgttcatgattccccctcagaactcaggagaaatcatgagccctcaccaaatccaatatttccttggtttttaggctttaagatcagctgccttttctgttccaacatcttgattacccattagtagatacaaacaacaaagtgcagagagcaatactctacttcgacaaaagtggttagggctgctttctatatttctgtgccacctgctagattgtagcagctccatttgatcctccctgtccttttcattcccatcttcactctcagcccatccccatgtccccccatttctacttccaacccatacccttcctcaatatagaatcacctgtatagccagaagatatatttcaaaatacagtgcttctggagtcctgacagattaaacttgagaaggtgaaagggatttgtagtaagcaccctggctcaccataaagcatgtaacagtctattctttctcataaagatggaggaaattgagttcatttcatgtatttcccttatcttacaaataatgtatatagcagttgtacatcttacctttgtggaagccagtgaaataaaagattcaactcgaagttcggaaattcctgaagactgcttctgagcagccatctgagaatatgaatagcgtgatgtataaaacgtccaggctgacaatcaaacaactgatttacttcgtggtgagccaaatgtcattttttacatgaagtctcagaataaaaaattagataaaaagtaaaatgaatattgtgatcttagcaacattctcctttaaggggatgggaggaatgggaggaacagaataaaactttacgaagacctttttagttagaaatgagtcagttggttggatctttaatcttaaactttgggcaaatttgagtctcacttcagaccgaactaggcaaaacaaaactggtatctgagcttcatttttctgtaaaaatgttacggggatgttaggaagttaactgttcattaattaaataatgaacataatttatggggctcttactaccttgagctaaacaccatggagtgtaataatgactgaacctcagttgctgcctttaaagagtgtaggagactgacacgcatattcaaatatgtactaggagtgtgctcttgagctgagcagaaaagtggcaacttgcaggggtggggtgacagcttctgtgagggaaattctttgtgtactgcaaatgtccatgtgaggaaaagactgagaaacacactctatattctgcctagattgtcagcttgaccttcccttgtgtcttctgtgacctcctgagatcctttcacctccattctatcctggatcctttgcatctcttccagcatgaggacctcccattgatctgttttctgtagttccatgactgttggccatgcaagacaattaattaaagtatgggatactttactaggtcttaactgcattttgaaatcttggggactgaagtcccagaacgacaagaacataaaatcactgtgactctacctcctcatctcctccccttctctgtcctcgacttacacttccattgttctcagaggacttcccttccactacttcctcctgtaccaccgtcccttttcctttcagggctatttctcctttttgtgctccacttatctctgcttcttgatctctggggtggtaaatgttagtcttttggggcaattgatttggcattttaaatgaaagtagtggggagaggggaaaagattccacagtgaaattgtcttaatgtaagattcaaaccacaactgcagagaacatctgttttgaagtttgatgttgtctttgtaacccaagagaaaagcagagtaagatcagaggaaggccttagccttccaccaggatgaaaccacctgcagccttggacagtgggtgaaatcctgtagccctgggatgcagagcttctaggagactggctgtcctcttctctcatattattaaaggatgttggttctcttgccatctgtgctattgccattatccctctacctcctcaagagtccaattcaggacaatttaaattggaatcccaattacatgatccccaaaggctcacagagtagcctgcattctgcatttgcagcaattccaggcaacatgctcagcctgcttcagggaagcacacaacactgagtgtggatgagacctcagaaccctctaaccttgggcagctccttacctcttcctgtctgagccatgtttgatttgctgcaagaggaatacgtgtctaaactgctggattttaaaatgtcgcttggtctgtggattaggccaatccaccccacattgttggggctgcagatgcagttgaatggttcataattatagtctaaagaaactgcagacagcaatagagccaacccaggccctttctctcctgacagcccatgccaagctgtctcccacagggaaccatagtgtggttatcctgcaatgtatttgcccaaagacaatacatccagtgtagagaagttggatttctagaaattgagtctgctcatctatctactcccatgtccattgtatcctgtcttgtgtctcaagggtgtctggtacttctcctgccaaagtgaaatgcaaagtaaatgcaaggagatgccagggagagaactgctatcagggcatctggttctagtactgacactgacttttttagattgtgtggccctggaaataataatttcctcactcacactcatttttcacctctggtaaataggagtgctggacttggagagcactgataaactcccattgagctctaacatgtgacaaatccaagacctaaggttttgtctccaaagaggcactacaaatgtgatcttctttcagaatttaaactgtcacttttctgtgactcaaaacaaatataaatctagttctcttctccaatcaggtagttctcgaatttctcaagtgaggctgatgctgggcaggttgccagtttaagaactgaggaagggtcttgaagagatttttaaatgaaatgtggtgatagttgttctatctctcgctggagatcgttcaggaaaattgagcatccaagctattctgcaaagagatggctgtagacagacatttaatgtgatttcccacatattctaccgtatactagatcttaataacaataatcaaatactaattctcacctagacactgtgctaaattctttgcatacattatctcatttaatcattcaaatagccttaaaaggtgtgtgctgctattatccctagttgaaacatggaggaactgaggttcgggattgtttaaatgacttacctgtggcaattcagctggctagttggtagagtaagaatttgaacctgagtcttattccaaagcccacactactatcctctttgttttcttatattgagctttccagggcaaacaggctcccaagtcctcccctctcccccaaccccaccccaccctcccttcttccctcctgactgcagctcctcctaccctcattgtttattgtgccttctaaacaatagccaatgagtctgtgttccattctagggagagctagggctgatcttattccctgaaacagagatgaggttgtgacacaaaaaggttaagtggctttggtgaggtcacagagccagcctgcagtcagcaacagtaccatctgagtcccctggcttgggtcccttaactgaccctaaggctttttggcatccaagtttaattaagagagttattttaattttccttcctatctctaattttccattttattgctgcttgataatgtagatattgaagtgccaggcatttttcttccctagtgtgacttttaatgactaaacttctcacatagaaaccacttgccttagaagtaagctttcaaagattgtttctgtgtatgacagagactgttgccttttctcagagaaaaatgagaccacaaatgcagctcagacaggttgttgttaattgagggcttttttttttttttttttttctaaatcttacatttataccagtaaatcaacatctgtgagtcataaactggttctggatcagccgttagtggtctgaatgtttttgtacctaccttcagtaaagcatattttagctcaaaactcagagattctttgttttgttgaagttcaagactcaggagtagataacatgctaggacacttctggagagggaaagtctgtcttccatgattgttcaacattaagtgtatatttatatttcttttttattgaagttggggtggagttgagggaggagtataaataaaaaagaaagtatgctttttacatactccatgtgcttgaggaattcctgtatgaaggtgactattttcttaatattattgtctagctccactcttctgttccccaactcctgcggacttttcttggcccttattgacttcacgttcctagtgtaaggcaattcagcacttggtaggatataattagccgaagtctaaggaatgcttaaaaatacaattctgttttttcccaaatgcaggaggaacagactgctgcagtacaagcacaagcacagaagtatttatttgattgattttttttttcctgagtgccttaaaaaccagatatggtattgaagtatcttgcccaagtggatgaaaggcaacgcttggctgctgttgtttggctggtggggacactgaggcatacatgtaaccgagtggacgtgagtgctggggatagaggttctgctctactatgaagggaaaagggcacagcctctgacactttttagttcatcttcacaagccagagcatatcaaactcacttaatcattgaattaggaagcccatagtgaccaaaaagttgatagttcatcattcaacacatatttattgagctctgtaatgtcttaggcactaggctaggcatcaatgttttagcgtatgataacatagaaatatcatttaaagtccatatgaacatttagaaaaatctacttgtgtcctaaagagaatgaataaaaatttcatttatcaacattgattagattaatgaaacatgaccctggcagacctgatcagattattatatcttaaatatgtaaaaaatattttaacatgaccttattagtgctcttcatccaaatccagggttcgatgcataacttctgatggcataaatattcataattaatatcatctggaggtaactttcctggcagcctgtggtggcgcctggctatctctccaaactgctgctttacgcaaccctattccttgatttggacattcactcattttgtttctgtgcttcaggactggattaggaaacggatgattgactatctgagttgtcactatggaagaattagaaagaataattttcctcattgctagagtggaaagtgtttacagtttaatcatggtgggcttttttagtatctaatttgggtggatgttagcagcagtgtttaggctagtctggggaagaaagttgaggagcaaactggggaagagagaaaggagttgctctgaggaatctgcatttgaaaatagagaagtactcacacttggattaaaaaatgccaacattttctcaatacaacatcaacaaaacaaaattccccaaagcaactctagatttgttcacttcttctcctgatgaattcatagtgagtaaggcagaattgattcaagaacctttttttttttgtggttcatttggacgtgtaaatgtacaattcattcatcagctgtttctctaggcttttcccaggaccagaagggtctgttcttgtcatctggaggccagcattgttttctcataccttgtggaaacacagctggattgcaacagtctttgttctttcaaaaattaggactatcacatacaaatattttcctctggtcactaaggagggatttaatctggagtttagaccaggagccacagatttttctgttcctggcttcctccccgatttgctgtgggaaatctgcaaattactaaggcttcaagggcacaaaactgggattagatgaaggtaagcctgtgtgtcaaaacttaccagaggcagaggttacagttacagtcaaatgctgggagttcaaatgtgcttagaaatcaggaaacattaaaaatagctttctctgagattgctcaggaagatttatgtttaatctttctgttaatcaaagatggagctcagtgcctggttctagctatgtatttagatatatacatgtactggttgatttgttaattaggacaaactatctctattacaaccaatgtattagtggcaaaccatgaattattcgggttcattttgttttatctctagtgttgggggttcccaaatggaacagaaactgtgcattgtgattctgtcatggctgccaatgatgtactccagaaattcaaaaccacagagcctctgcatcacttttttggtggcggtcgtgggagggttgttagttttatctaaaagaggagagtctgtgaaaggaaagacaaagctttggccaatggtgacataattagaggaacagaataattagaaataaatcataacttccccttcaacccaaccactgctggaggtaaattggaagcttacggaagctcatggctgggttctagtttggggtcccgttctggactcccctgccaacgcaggagcattacatgggtgggctctgaaaaactgaagcctccttcagaaacacacgccctgactcaagatccggctggagtccaatactcctaaagccctttgaggacacgggctcacgaatcccctgcgcctgcctgcacgctcgccttcatccacatgcctcacgtcctgtgtgtcagtctttgtgaatgaatgatgtacacgcacttggaaaactatgctgctactgggagggggcgagagcgggtgaccaagccctcaagaatgcgtggagaatcagacggactttcccgaaacggtggaggcggcctgtgcacccagcctgcacacccgctcccggcccttcccgccccagcctgggctccgaggcccggggctccacgcactgctcctccgcggtcgcggcccggccccgcgctcgccagcccttcctttcgctttgggccgcgggcggagattggccgcggtgctcggccccgcccccggctccccgccctgccccgacgccccgcccctcgctcccccaagcggacatcgcccggcccagggcgcgcggacccagcggccgagacgcggcgccgcgagaaacgccctaaagaggaggggagagcgcgggagggcgagagggagggagagcggccgggagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccgggtgagtggcgacggccgaggcccccacccaagctctcggccagagccgggggtcccctggaacttcttccccctttcgccgttcccttctgggcggtgcatttcttcaggagcgggggatgctgttggcagctgggatctggaggacgaggaggagaaggaggaggaggaggaggaggaggactgttggtggccctagacccttggtttggggggtggtatttattttcacagctgtgtttttgtgagtggtggggaaaagcttatagaatttccagcgccccattcctgctttttttattttcccaaatgagcgagaaccctctggccttattccttaatgttaaggggagatggacgctgcctcagaggacatcatcgcctgactccacgtcccccatagaactgaggctgggtggagggccccgggcagtctaacgggttggccttcaggcagattttcaaataaggtcttgcctccccaagcgtccctgtcacatgccttgcccctcttttctgggttgagggtaaggagatcggaggagaattgaaattatcctcttaactttgagaaacgtccgaccctattcatgtaggttacttactttacccatgtttctaatctgccataaatttttcttctggtaccaaaggtccgttggaaggaaagcatcaaacacccaaatgtgactttgtgtctttggtacatggtgttgtccaactctttcatttatatgcatttgaagaagagaaggataggaagtaattttttttttttttgtctttgacacaaatattggtgctaagcaacttaagagagtctggccttacagaatttctgaaacaaatgtagtttgagagggaaagatgctttcttttaggataaggcactgccagctatccttagagatgagtgattttggaggtgaaagtatatagaaagatctagggagaaggcagtgcaccctggaaaataattaatttcaagaacaggctcctctgttgtatctgattatcaataagtttagttgctgccccctgtggttaacacttctttgcctctgccataatttattgcttactttaaccctttcttacgctgcttaaactttcagcacaaccatactgatgttttgtcattctgaggtccttcagaaatattaataaagacatgtaggtcacgtcccctccctctgggtcccctgacattcagctccagggctgctgtgcacagaaggctgagattttgtctcctcgcaaggatgatggtggtgggagcaatgctgagagcgcagctggaaccatggagacatttaaggcacttaggcctacaattcagaaatgctgtttctatgatggttgtgtttgggggttcgaggaagctagaatgagttctgtttgtcagttgattgaaaccatatatagaagtgaaaagatagttcacaacaaagatataaactcaactaataggtcctttccttaagaacagcttgtttatatgtgttgttatgggtgtttatgggggaagagacagatttggtcatctgggaaatatcgtgtcgatatgtcagtccacatacctacaagggatctttcatcctgggaatgaaaaagagccctggcaacacatgtttcagatcacagtgaacagctgaggcaatttttttggtaatttaatattaaatattagagacaatgtatatggtgccgtcatttcagttactgattaaaaataagctctgggcaagtaactttctttagctttctattctgtaaaatgggaacaataaggcctaatgctacagtcagcgtccattataataagcatatttgcaatggctttctttttcaaaaaagatttccaagccattggtcatcttttgtatgtgaacttcgatacaacaaaatttcaactggccaaagaaattgggcagtcttctgccattcattgtaaagaggtttgatttctagcaccattatttattatcttggaaaaaataaagacaaaaacttgaaaaaatatatagactataatcaacttttttttttctggacctttagttgcttatatgcgaacattatgcccatacctcagagaggaaaatagagtcacaggaaaggtaaataattgacataaaaatatgtagtgagccagtggctgaagtacaatcaattcctgtttctaacttcgcaatgtatattgctttgagtaatgttgcaagataccttccaaaagctcagcaaagaaacctcagctgagacttaacttgcaggtgcaaagcaaggatgggagaaacggtgtttctggccagggctgtctgcttttgttagtggaaggacaagacattggctaagtgcggatttgccttgcccatcagaccatataggacatgtgtttaaagtttaacttctcacagcatagctttttatccacagctgtgacttaaatatttgtcagaatgatttctttgggttgcttagtttcttatgtgtggagacagctagtgtgggatcttatctggcttaaatgattaaaccagaattttctccgcaccccctcccaaattcatgagtgccaaagagaggcagtaagaaagtggggtgtccaaacaggagccgcaagacctggattatttgttttcctggctaggacctgaccaagaacctttatgcacttttattctattttgagacttcacaggagtttgacagcgttaagtgctaaattaacatatactctgaaataacagtagaattgacttttccttgcaagtgtaagagtaaggtgggatatgctatttgattgcaacagtgtgattgcaaggatcttaaatagcttaaaaacaaatatagccattgggttcactcctggttctctcctggtggagcctgctgtgaaggggccaggtgccaaagccaacacattcccaagccacttaatttttcctttccttcaacactctgctctaccttcttggtgaggtgagcttaatgtccagataagagcaggagctctaatcctggatacttgctgttttataagaataaaaggatcagcctctcaccccacccgccctcagcagagggtgtacatccatcgggaacatgcgttatacttagagataggaagaagctttgtccttgctcagcttggtcagtctttgtttcttcatcagtgtagacaagaaagaagggcagagctgcccagtctattagatcacttgctcactgtgctcccagatccccgccgaccatactccattagagactaaagagctctatggttcagagcagagactctggagccagcctgtctggatttgaatctcagctcggccacttagcagctgtgtgactttggacaaatgacttaatctctctgtgctccagcttctgcatctataaaatgagtacaatcattctacttcataggatgaatatcaggattaaatctatgaatatgtgcaaaatcttaaaacagtgcctgatccataataaatactatttagcagttaactacagagcaagtcaacaaaaaatgatcctgatcagtgtagaattttcagaggcccttgaatgtttgttagaagataaggtggctgtgttatgtacctcctgataatctattattttagagggaaagaagagtaaagttaaggaggaccttttcacctgcttagctgagatcccatgcccgtgaaacttcattctgttctccagggagcaaatagtgagaggtaactttcagagagtgtcttgaagtccagctctcactgttggaggcacagggagggggttgccagttactttgggtgatggagattgtcattgttacctcagagcaggaaggctaccaagtctagaggcaaggggaacatttgcagggttgatggaaaagtcaagttttcaattatgcagggctgagaaatgcatcatgtccagttattataaagcatctcctattttatttatttatttggttggcagagcttgcattcctggcatttttggttggtttgtgttgctgtttttttgtctgtgtaactttttttttctcttaaagaggccagaccaccctgtaggagcatcgcctccctccaggagacaaaccagctcgtggtcaacctcccggagcccaggtctctctgggctccatcaaatctctgcaaactgagagctggttagtgtaggtcaggatttttcaggagagtctccctgtttcagaatacagcagataactctgcaatggttacagtgacagtgtaattacagatgtctctctggtttgtgtaatgaataatccatggctgtggtggaattccatgagcttgcattgaaggtggtaggttcttgtcattcaaaagttgttgggatatttctgaagcacgcatcgagcctgcattgtgtgctgggcacagccagataaaagagcacttttatgcttcacacttactctgaggtgtggtggaagtattattttctccatttttcagatgaggaaaatgagtttctgagagatgcatacttggcctaaggccacactctagaaatttagaaactgatgagatgttgtaggcattttatacctaaaattttgagttattctcaaaaactctggaaattagaacacaggcaggtgagaaggcaatgctggtcggtgctttgggggttcaggaggtacagtggctccctgctatctctgcaagagccccctgagctgaatcaggtggcctcattgttagctcagtgcttcatacggcttggggaaagggtccatcctgtgggttgtccccaggcctggcagtccagatgtgttgctttagaaagatgtttgaaagttccagcaatgcttacctcagaatgaaaggcagagaaccaggattcttgtttttgcaacgtcttccatatggccttggctctctcacaggtaggaaggtgattatgttcacctccaaggtcagtccttcgctgagcctccagattctgcccatttcttccccttcatcactgatgttgctgtgcattgaatctctcataatcaggatgatgagacatagcttggcaaactagttcattttcttaaggcagttaaaatttaattatcctgcttgcagagaggccatagatagttgagttgcatttgctgcctatgcctcatataaatttcgttttttcccctaaaatttagttttttttaaaaaagtccattccatgtgtcagggcacatggtctggagttgtcctggcacaagacagccccaggtgtctacctgcagacctgccagctgtcccagcccatggctcacacacaggcacactcccctgccacttgtttaaggttaaggcattggtttctttattactgcattatggggagcattttcccgaagagttagtatgcttgggcccacactgtcaccgcagagaggaatttgtatatgaacaacatcatctccgtgtttttatttagctgctccttaatgaaaaccttggctccattttcctgctcacaaggaacctctgatagcatttgcctctatgtttgcagtattctaggtctacccttcgctcacagctgttaagctgttcttaactcagggttaggaatgtcaaggctattcccaaatctatcatttttacttgtcatgtgtctctagctactttctgctttattttttctgtcgggttgatgatatctttttcaaaacttcagtggatgttttccaaattgcataaacaggctatttctacttggctgcttttctgaagccttcgcctatctgcacccccttttccttctgattgtataatgtataatctccatgcagatacagaaagacataggtctgcagggtggattgtggtaggtctggtttcattggcagagagccatgcttaacagacacgctcaaaatattgctattcaagccgtaaatattttattgatcacttggccaacgctgtcatatttcccaggtgctttccagtgtctactgcttgggtgcaagcctgtcacttgacacttcaaatgtggcttattactgccccttccacttttctcaattgttctttcttgtagcatttagtactgtctctaagagttgtggaatattgacccagatagtgcttttagacccaaagtaatattagaaattttaaggctgttggacttcagatcataatggtgtagagatagaaaatcgtataatttaccacccaaactgggatacctttggagagtgtaaaggggcactattaataattgcatcagaatgacannnnnnnnnnnnnnnnnnnntaactggggctctccccacagtatgagggccacccgagttagacactaaatttggtcaatcgtactttctagaatatcttctctcaattgccaatttcagggtttagaccatctaagtaagctaataaggcacgattaagagtttgaagccctttaagtttagtatggttttcccccaaacatggattatattttaaatttgtttctcagtgtctgagaaacccaaatcaacctcagacaagttcacttcaagcatttgaaacctcttggtagctttgggtagctgtgataagccatttatttttgctttgcaaggttctgtggagaaactgtaaactctgcatgtagtgtgcacgcgcgtgtgtgtgtgtgtgtgtgtgtgacagagagataaaatgaactttgaagtagagggacgtgtcttcattacacaagtgaagacaattgcaatttttgttttgttttgtttaaatgtttatcgaagataagaaattttactttgggctgaaaaggggcaaaaaaaatgttgtgttttctttttgtaccattaaagtgggcaaaaacaaaagcaaaaataaaaaacaagccctcaattctttagaaggggaggaaaggaatggtggattcaattgcaaaattctttttgaattaaaaaaagacaagaataagaatgaggacaggaagagtaagaaagtatgaaagaatgaatgaaaggaaattgtaaaactaaagatgaacgaatttaagtgatattacatagattcttggaaaagctttcatctgggccaagcattacacctggttaggaattccaggctcaggtggccccatgggcagttttgggtctgttgtttctactccttgcctgtggtcatttctgaatactttaaatccctcatgggtagatgggtggtcaggacaactcagatgaagtcttccctgggttccaggtgcttccatggcaaaaaatgcaggaggaccagtgtttacatttatgaaaatatgtgtggatcaatgactgttggtattttctgtgtctgtgaagctctctcttgcaacagtgttaagttagtttcataggtcagcttcatgggaaacaggggcacttctgaagcatttgaaggaggtgtaagaacagggaaaggattattttccatatagagagcagcgtgggaagaatgctgcaagtttggaatgaaagagatgcttagataaacatgaaggaaaaaaacttacttgtagaaagggatgaaggaaggaagtaggaggccaggacccaaagagcgttttgaacctcaggatgaattttgcctttgaaagtaggaatatttaagggtagagcagagttattgagtaagcttatgagataggtaactttttttttttggttacttttcctcctactcatactgttgttaaaacctctgtatcagtttatcagaataagcgttaaacctcagagaagatgacaaaatcaatcaggtacatattttcaaggtacaaatggaaaataacctcggtcaggcacaggaatctgctaagcctggtgagtgtttgtagatacgggttttttgaagtatctagggtctcccactatgtgccaggtgttatacctgttctcaattaattactttttttgtgtgcaattagagttgtgtgatgcgtttagagttgtgtgatgcattagtatcattcatgttcagaataaaaatgtgttgttgagtctgattttctttttcttttttgtagaaatgaggtctcgctatgttgcccaggctggtcttaaactcttggcttcaaacaatctttccaccttggcctcctaaaatgttgggattacgagcatgagccactgcccctgcccaagtctgattttgaaataccctttaagaaatttatcacaggaaattttcagtgaaagagtttccatgtaaccgacttttgtacttctagtacctacacatttctcctatttgatatcttttgccaaaaatttaagttaattccataccttatgcatcagttgtctcacatcattaagacacgaaataaatgcacagaatgcaatgaagaatcacagatgataaggaagaccttaccgtatttgttccttaccagtaggaataaatattgtgtatgaaataaacagcatccactctgtgaggagaatgtgggctggagagtcgggagtgttggtctccagccacagctctgcatcagtatctgtctgtgtgaccttaggcaagtcattgcatttttatgcacctcattttcttcatcagtcaaataaattcattggaatgacgacctgtcagatttctcctaacagtgacatcttatgactttaggtaacatttaaaacagccaaggcttggagagagtgtagactgccattcaagaggtaggcaacatggggatttgcatcctaatccccaaattctgttaataacaacttaatcattgaggaattttgggtgctttggtaaagggctacttccacagagaaacagagatgttagaaattgttgccagcctagctcaccattggggaaatggaggcatgttgtcttgggtagcactgaaccaagagtcataccttcctcatggtcttcctttcagcttcccttttccatgagccgttgctgcagttgcagcggaaggcagctccagtgcaggttctcacctggaggagggagatgtaagtcaagcattcagtaggtgaagcagctagtccagctgcttccgcaggccgagtctgtgggctgagtgatgagcttatttcatccaatctgcctcttcttgataggctgctctggtcagaaacagtccctcctgccttgagaatgcaatctgctgttagccacggcagtgcctcttcctgacaggcccagtaagtcagggccctggcctgctgtttgcacagagggaagggccaggcctgcgtgctttgggtgcccacagaatggtgtctaggtggccaccggctgatccttcactggacacacgctgcttagcagagttggagccggacaagaaaccacctgccttggcttccccagccaccccggaagctacaaatgtactgggctgtggcggcggtggaagagcggtgcccgcacatgggggttatctgaagtctcatctgattgatgttatttctgcattttgagaaaggtctgtcgcagttacccttctctttccaaagcagggacctaagttcagcatgccagtttttgggggaaaaacaaggaaaacgatcattgatgacagtgtagagtttatctactggtgcttgtgtaagcacttctcatctccatccatcttttcttttttcctcatgttctgtttattttctgatagttattgggcgcaaactttgtgccagtatcctcattatttcgccccaatagtgaagcattattattgccatttcatagatgaagaaactgagattaaacgacttgcccaaggttgcaaagctgctgagtggaggagttcagattcaaacccagctgtagctaacttgaaaattccatgtctgttgttttcagaattctcagaaatatttgggtgtttgtggaatttgggggaaatactaaggtccgtttgtgcatattgtttgctagttcatcttaatacttggctatatctggtagcatttgacagtttgccatgtgacttcaccacatttgagctcatggtaatccttagagttaccaatattttacaaataaggaaagtgcagtgcaccgatgccaagttaccctcccaaggttccagggcaaataagcggagagttagaacatgaagctccagtcagtttctccaaatcccctgacatttgagttcagccacatggattttaaacatttctttgattcgatgagtatctagtacattcacttaaatataataatgatgttattaataaacgttagcttgagatcaaagtgtcaacaaggcattcttttctcttttggtggaggtagatttcacccacatattttatgcatctataacaagtcccacatagctggctgattactgagctttgagcaggtagcactggtcactatgcacagattagtatgattactgagctttgagcagcttgaacagatcactatgatataggctctggaaaggttgtgcagatatgcctgatgccaaggcactggcaaaattgttggtaggctggcaagttagttccttctcaaggaaaaaaaagtgtgaatgatcctataggttactagacagacatgcagtttccctttggagaaggttgactttggactttgagaaatacatttttttttcttttaatctaaagagatttgaaaataatagatgtccaatttttgtttacctattctgaactataaggcacattgctttgttcttctgtgcctcagtttaccccttttagtaaaggaggtctattttaatcagtgagagcttcaggtagctggaggaatgcttcaggaaacacaaaacacaatgaaaaaattgttgaatcttaagctgcatgttgtggaaaagaactgtaccaaggaggcatacagagattaatgtcatcttagatgaacaattttttcaccctgctagtttccatttgggacatagggtgtttgctgtggtaccatgcatagacactcagagcttagcagagttatgtcagattatctctctaaaacaatgtgttgttccttaccaaaaaacgtaagcccctctggccggaccttattttggtcattatgggaggcagagcattccaaggtcaaatgactggttttccatctgggaagtattcttttggttgctggtgtttccttgggagtggatgtaaaccttaagtagccagtagtgaccttgagtacctctggattactagggaaggggaggtagggatgggaagttgggcggtacacctgattatagcaagcatgaagataatagttttaagtttgctgttttgaatctgggcactaacttcaatgcttgccaggaaaatcttatcttgtaaagcaaatcctagtgaggtcacgaagtgtgtctcctcctccaattggggttcagcactatggcttggtgccctccatgtaccaatagttttgggtcaggcctaaggggtccttggtcttagctttgcccggtttgaatattttctctgctgttaactgggcagggtggcataggtggtcatcttattaccttctgttgcctgatgtgagaatcaggatacccaagtctggctttaccttaagccaccagatatggacacatgtctgcattatctttgtattcttctccaagaaggatgctcctagtgagtgagctgcctttctttgagagagagtgggaaagttaatgagttcacatttagaaagtactctggagtctttggtgattcaaggagtgttattaaattagtgggagatatgatacggagtggggatgctaaatacatatgagctccccaagggtgagtcatgtgtatgtgtacaggaaatgcatccttatttcatataagatcaagagttcaatcttacacctcccttgcctcctaatggaaaccaaacattcttcaaaactgctggatgcttgcttttctttacataactgcagttcagttggaggagtgagagaagtgaagctaatatttacagagagtacctactatgtgtcagatactttgcaatgtgctttacagaaatacataatcacattctttaaacaaccctttgaggttgatgccttaattcccattttgtagataagaaattgagtccagaattaagttcagataatttgcccaaagccatagagttttcaagtcataaatttgatcttagacctttctagttgccaaggccttcctacttagacagaatccatttggagagaaaactttctaacattcttctaagaggtcttgattcttggcacattcttctgtgtgatgtgttctctgtcaggcttgtcattataggggcaggaagaacgcactcatttcacttatacatatctaccattgggatgtgttagtagtgggaaagtaaaaaaaaaaaaaaaaaaaaaaaaattttcacctgatttccatggtgcattttcaaatccaaagtagacacatgaaaggtggctagccaaatttactaaacttgtgtacagaattggtgctttggcccccactctccagattagacaattgaggaatgaagtgagagctccaccccagcttgagagttctccagggaggggatgttcagaggcacaagcctagggcttgaagctacttgatgcaagagggacatttgtagaaaagtaaacacacacacagaatgaatcagcatctccacggtggacataatgttaacctctgattcaattggagatttttaaaaataaagaatctatttctggatttctgaaggtctctcttgcagggagctttgtggcttttccatgccttccacccatcctcttctgtaatggatgatctgatgaaagaactttgaaatttcaggctgactgcaaagtctccaaaggatctggggtgctgggtgaaccgaacagcgatttagtttttttaatgagattgggccctgggtgacttgccgctggtttctcctggctttgatcaaaatatctgcctagtggcatggtgcaggcagagagtgatgagcaaagatgatgcaagtcttcagttgcccccgactgccttggttcgtaagaaaatattttcagtgtttttatgggcaaacaagttctaaggaagtaatacttgaatttccaaaagctggtgcagaatacacactaggctctgcctacacgagctagtcacaaatctctttacgaatcttctctaaattcctgttctagaggagcctaaatgaaattcgccttatttagtaattggttcttggttcttatatttgtcaggtggatttatttatgccacaggctttttaccatgatcttacgatacagagtttagataaaccctatttctctttgggtacctaagccctctaagacaaaggagagggatttacatttagggtgcttgatagtaagtaattgagtccctgaatcacacagcgtccctttcattatgttggttataatgatattcctcactggaggcagcaccatgtcttgaaagagcagagttttgaggtaagacagccctgggtttgaattcaggcttgatctttactaatttttccttagacaaattatttaacttctgtaaacctttcttttctgatccttacaaaggaggtaataataaagagctttcagggctgttaggattagagataattcctgtgaaaacttttatactttttcattgccacaggagctcaataaaccattatcttgtaggtcactaaattctgtacaaaagttcattgctgctgtcgctgttattacttcagcggttgttaaaactgtggttactattaacctggttacagaaaattttccacttgacacctccataaccaagtgggccagagccgtcccctgtggccagttcaattattttcaaatgcctctcacgcattcttaccgaacgtgagttagggcttgagttatgattnnnnnnnnnnnnnnnnnnnnnnnnnnnnnnnnnnnnnnnnnnnnnnnnnnnnnnnntacttgataatacagccaggcaggattagaactcctgttctcccaggcgtcatttcctgagctaggctgctgccgggaaggtccaggtcagtgaagacctggcagccccctgaagataataagattcaagacagaaaaagcccaccgacctttccttctttgccacagatgtccctcctgtccccagaaaatggccatcgcagttctagcaggcttcccctaaggaagatgtctgcaggaaccatgcacctctggggtttgctggctgctgattgcaatggttgatttatagccagaatctggcacctagaaaaggggatcctgcgtctttaaacagctgtgcgccactgtgtgtaaatgtgcttgctaatccagtgactaattcagtatattataaagcagcactgagccggctgccaaggcagggctgaatcccaactggagtggtgtgtaaggctcagagaattatgtcttgaattctgccacaccacccgtcgctgaaatctcatctggtgtgttccctgaaccagcgctggccttctggttcctgtctgcccactccgctccctctccttccctctccctccctccgtccctgcctttatttactcatggagggtggagcccggctcgatctgagtcagggccagggaaccaatcagaggtgctctggggcattccaggggccaaaattcatgatcccttttggaaaagaatttcccaaaaagatccctggcatcacagtgttgtgactgcaccttcctcagttcctgtgcagtgagccttcaccgcccccacaccccaccgccctatcagcttttcctctgtctcccccaccagggactggagggggaaagagccctgtctgatggagacttcttccccttgagaatcttttgtatgtaagtataaagatgcacatatcactttaaaagagcactcggcagccttttctgggagcatctttagggtagggaacttgagggattttgttcgtctcctagaacctgtggcccttcctctttagtcctcacataagtggtcccagaaattgcagttaccaggtgtctgcctctggaaatggcccgtgcccagcctctcccacggtcggtctcccagtgagcatcgcggggcttccatctcacaaggatttccaggtggcggaggtggctgtgggagatctcatcctctcgtcttccctttcagtaatgccaccaactgccaggggcgccatcctggacaccttgcccgccttctgtccctcacgccctacacccaggacatcttacgtgcactccttcctaccccctcccctagtgcttctggaccccgctagttcactcactctgcattgcaaaaccttccgcttcagccgtgatcccagcactcatcgtctgttgtgagcatatagctattgcttctgtacttaggcggtgtttgcttctcccactagagggaaactctgcctgagggatctatcaccaaggtattcattgttgggctcatagcagtgggccagtagctctttctctctctaacatttacttttttttaaattgagatataattgatataacataaaatttaccatcttaaagtgtacatgtcagtgcattccagtacattcacagagttgtgccatcatcatcaacgtctaattccagaatgttttcatcactcccaaaagaagccccatgctcatgagcagtcagtagctctttctgaaaaaaagaatgctgtccagctgggatgtgaggagaagggctcgtattcctgatctggagcttggagcacacacctgggggagcgctgcatctccccaatctcaagggactttttcagtccctccttcctcaccactcaagcccagggtttattctgagggctcattggttaggctccactgtgtagtgagctagtgtcgtctggacagagataatgagcgctttcaccagctgcatgcagacagttcagtccggggagcttggggctgtggtggctgcaatttcctaatggcttcctgatgaggcagagccatttattagcagcggatgagggctgcacatcccagtctctccctttctcacctacccaggcagatggagagtggcttaagctccctccgccttttgcattgatcactttttgtctgctcgccacccattggttggtctcgcccattgatctggagattgggtctgcctggcgacttaccaccctcttgggcttgctactgggagaggcgtctgaggctgtctgccctgggtccgtgtgggcgagactctggggcagcagcaggaacaatagaatgctgaagattgggtgtttggggccattaaagagaagcccattgggaaggagaagaaaaaaatctgtggggtctagaagagatcacaatgaggtggatctttcctggaacccttaggtctctgcattccgactgcatttgccttcacaactagagctgcttgtgttacttcaggccatggcctttctgggggtcaacagatagcttcattaattagatagatcagattcaacttactggccagtgcccctgatattaagttctggctttgtcagtggggtttgttgtattccctcaaccctatcaccatggctcagtgaccctatttggaataccagcaggactagaagggtagtggtgtaaaacctttaaatgatatgaggcactctgcctttcagtgctttttagataaaggttcatagatcactgaagttaactgcagtcttcactctttctggattgacaggaatagcaccctcaaatttcagagccatcagacaccatggtatcatgctatcggagttgactgttgaaagttgcttaatatccctggtatgcaacaaggatctttgctaggaggaagcttttccaccttagagtctgaccattggtattccagacttataacctgaaataggagtggatagcatcatgaatctgtaaaatcccatcatatttattagatctttggatggctcattcctctgtgattcttaataacttggggaggagtagtgtttatccagaatgatgaaccaggacttgatagtagtgaagatataggagaaagcctctccctcccagtccactgttgtaagtaaacagcaatgatgtagaggaaaaaaaaatcctgagagggagccagagttctagaattagtaaccagtgacttaaggcaagttgatgtcaccttgagcttcattttacccaccagtaaaagaaaaggtttgaactagatgacatcgaaagcgtcttctaattctgtattccaggaatagtgtaagacccctgaccagtggcagagcttggctcctccttctctccacttttcatccattttataactatgtctggttgcaaggaaagagaacatccctccaaggagttgttaaagttttatagcaaattctgtaaattcctcttttctgctttttggtcctggataaggctttatgcatcctatagctatagtgagggcgggatagagggacagaggcagggaaatgtgtgaacacaccaggagaggactcgggctgatagttattgctccaggccataaaaaaggccaaagccaaagagatatagaggccaaaattatagattaggtaggtctacacaaaccttggagtaggctcgtatgataggtttagcagtgagcgtaatggtttagggagcataagcatgctcccttcaaagcttatctctctaggcccctcctttttagtgcaggaaacttgagctgggtccccacaattattgcctaaatccccgaagtctcaggatttctgactcctcattagggacatatatttagatttactgcactgtgtggggcctgaattccattagatgtgccatgttggggcggcaccatcggtttttggtgtgtttagctggcgtgctggtattttttggagcctgtgataggcagagggacggccatctcatgtgcttaccaacatgctcagggtggggatttctgcatcttctctgatgtcagccttgctttagggtaagaatgtgtgtctctctgccttctcctgactcctaccatgtggttcccatgtggctcttgtgaattacactgggatgattcagcagggcccttagagaagggaataattagtctgttgggagcaggggataggggaggagtcaaggaagcagtgtttgaatgaagtaccgtaccaggtcaggtgacctatagatcactcacttagatcttcacagtttggtctattttaggtggtccaatgtttcatctgaatttcagtctccaccatttgcatagcatgaaagatgtactagtatgtttgcttgttatgggcttgtgcacattatctgttgtcctggtagttcaagtttatgagcgcaccctccagatggtctggaccctgagcatcttgacacacttatgaagttgatgaagagcatgtggggctggggaaggaacgtgatgcatcccttttaaccatttcttggctcctagggttcgttggccctagcagtatccagcatgtgcctgctctgtgcttaaaattttaagttataaaacatttaactgtttgctactagttccctcccaatgggttgacattatctgggatgttgtctgtaaaatattttaagctatttaaaggaaaaagagaaaaaaaatcttatttagatttgtatatctccttacatgttggttttccaggaacaaggtgggaagttagtgacaggaacttgaggcatgagtggaaatctgaagttactgctcaggggatctctttgttgagccctgaatttcttgcctctgggagattccagctttgcacgtgggattcttaaggctataaggttggactggatccagagggtgcagttgcttactgttggttgcgcattaatgctaagggctgtcggtggaaactcacaatgaaggcatgcaggaggagatgcctgcaggggctcacggcctgtgcctccctccctgttccttcctccccagcccaggctctcctcatgttcagtttggtgtctgtcacaggctaatctactggtggctctttttagtaaggctgtaggaggattaaggatacaagtaacacagtttgggaaggattaaaattgagtatctctccaaagccatgttagagcaaaagatgaaattccagaaaatagagataccatcaaaaaggggctgaaataaagggaagaagagattgtccctgagatgtaatgcatacatatctgtgaatttcagctcttggcctctttatttgtctccaaagaaatgaggagggaactttcccagggaaaagctcctttatagtgctcctaaacatgtataattaacagacctaataagactgttgtttcagaaaccatagagttgacctccatcgattggttattttttccttggcgttcccaccttcctgcaacctctgtacagagaggccttaattgctttgggctgggcagagcagcagttacttttctcatctctcccttctcagcagtggctgtattttagcagaaggcaagcaagcttaagagaacctctaggctaagaagcaactatacgaagaaaaaagaagcccatttctaagcaggcagccttcttggtgacctcatcttcctcccaacttgggtccagttggagctgtgcatacagggcagacttccagttcctcctgtctgggactaacagtggcagatataaatagaccaagactttgtctgtagccattgttctctaactgcccattgtttctagaagcaaagcaatgctgtggctgcagctctctttctctctctctctctctctccaccccaccccctttctctgtctttctttatttcactgtacaggggtctgaattccagctcaaccatttgtactatcagccacctttcacttgccagatgcttagaaactcgaggggagaactggctccacaagtgggagaccaactgaatattgtaacctcatattttgattccagtaatgcttttgtctgagtctttccatgatatatttgtggtcaagacaaagatatgtggatctaatgatagtaaagtcaggaggatttgtaactggttgagcaactatacccaacgggtcttgattaatgtgtcagtgtcagagtaatgcatggtctctgatgttatgttatggggatcagtacttgctggttgccttttcaacatttttattaggggcttagaatagagaaagacacagaaagcacacttagtgcattgcagatggtgcaaagctgagaatgatggctaataggatgagcacagattcaaggtataaaaaagttcttagaaacatggatcgaaacaaagtgaagttaatatggataaatgtgaagccctgttgtgaagttaataaaattcagtcaataggtacagaactggttcagtatcactttctatggagaggtcctggcaatgtcctttgagtggcttttgtagttaggctgttagatcagtgttgtcttagtctgcaccagtcaaagcttatggagtaagatgatcatctcattgttcccatttaacttctgagaagcacgatgttcacctatgaatgcttgtgatgctcttcaggaacataggcttagaggaatgcttctaggtggagcgaggggagtggccaaaaaccatgccaacatgaatggttgaaggaaccacggagtttggaaacctggacggaagtgatgataggaggaagaaagcaggggaaaagctgccagataaggacaaatttgctttgtgctgctgatctctcaacaagcaaagcaagggcctattgatagaattcataagaaggcagatttaaactcgttgtgtctaatcatttttaaataatcattttggcttataagtgaaattgtgtagctcaaaaaggatggggcaaccaaatgtcttaagtgagaagacttctggggaagtatggtggtcgttcttcaggtcctgccctgcccctcatgaccactcatcatcaagtactcctctgtggatctggaagctggagcagggtgtgcacgcatactgtgttgcttcagtgcctgtggctgccaatattgagaatccttgtctgatgtactgggaaaatggacttgcgtattcttatttttcattgtggtttccctgggttgaaaacagacagttgcactgtgtgaatgtgtatgagtatgctttttccttctcagtccagatttatttattaaaagaaaaacacatctgcataaaaaagccttagaacgcaggaagaatgtccactttgtttttctttctgtagcaccgagacatgtggggtttcagcttcctctaagaagtttttgaagactggctttcatctcaaacaagactttttcccattggaaaaacggtccttttttggtttaaaaatgtatttatataatgtataaataaataagaaagttgagagagaatttcctttcaaaattgatgaaaaaatgttgctttctgaacatcattaattgggagtcggttgttgcctcttcccaggccattgccactctgcattctgtttctttgttctggtttacaattttccaatattccctttctctgcttcctgctttcttccctctctcctcccttcttggccagctctcctcctctgtctgatcccagctccagccttctcccttggcggctacccccatggccactgcaccaccttcctagcccccgttcctccttcctttctctaagcctttcttccttctgcccttcccgggctaactttgaacaactgaagccctcactggaagaggcctgtctctgtgtttgtttcctgcgtgggagggagaggcaggccttgagaaaacagttcaaaagtgcagaaaaactttacctcttccagcctaaataaacgggctctactccatttgtttgcccagatttttcatttgcccatggagaaaactcctcatcgtacaccttgcccagcctggccttcttggtgattctcagcaccactctcccgatgcctgttttaccccccgaccaagtgccaagtgggccccgagccgaggtttgaccaggccagttctgggtaggacgtgcaatggagcctgctgtcggtagagagtctcagggattgaggttcttccctgctacagaaagagctttttctagaatgaaaatgttggagaaaatgaaaaaagaaatgttatcatgccccatcatttttgcctcatttgcttttaattctgtgaataggtgcagggagaaaacacgtggcttgcgtgtctgaagatgtgggattgaatccttgttatatcactttactggtttgataatcttagttaagtcacttaagaaacatttgtgagcctcagtttcctcacctacatgataaagataatactacaagtgcttgttttgaaaaatcatatgagaatattcaagaaaacgctttctaaaagatacagttctagtcaaatagcaggaatgataattataggtgggagttaagtgaaattaaaataaattggttagcccaattcatcagcatctgcaagatctcagaggatgaggcctcaaaggctattatgtaaaccagaattagtggaagctgggattatagcaagatgtagttgtcagatattctccattgtcttcctggatggggttatcctatgtcatgttggtaccaaaagccgtatgatcctgtcatgagaattttagtgaaggcagggcaggagttttcctcattcagaagtgtaagatgtgggaagaaccaataggatgcaatgtggttctctgcaaagccatggagacgaaagagcccaactcattctttcctcctgagtaatgtagagaccatggctctgtgtttttcagataaagaagtcacactgttctgggacatttaggaactataaagtatgtcatgtggtgggagtcaggtgtaattatctatgcaggaaatgctttgaaacatgtgaagtactttgtaaatggcttgaaatgatcatttaagaagcttaaatgattctttaatgtaccctatggaggtggtccttgcacacaggaatcataatctcaatagctaaaacttccttttaaattgcttgagtgtcgttaatttagaggcccataaatgacaattaaaacgcagcttgggttttggcagattccaaacacatagaaaagagttcttagcataaaattatacttttgctttgtgccatattgattctaaagtggaactcttaggacgtttttgcaaccaaaaggcatcttaggtgcattggattcatgtagttctgaagtgtcacggcaaacatattttagatgcttattgctgcaaaaagtatttcccgttagcagattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctttcatttgtttttcctgcttccctaccatgtaatggtcaaggctcattggaaccatgtgtgagcctggtgagtcaccaaatcctcaggtacttcagtggtaataatgtgttaaaactccttttgggggatggggcaggaggtggatgaagggaagagggagaagtctgaggtcacttcctacagatgttcagtgtgctgagccctctctacaggcttctttctcaggcctggctgcaggacctgaaaccagcttctccatgcaatttggagctgccttgcaggagaccatctcttttgtcttagggcagcttccctctggggagaggcatctcctctgagttggcacattgtacccaaagagcgtgctttccctagtgactgtgtgcattggcagcaaaccgagatactgtaacttgagactggcttgcatttttggtcagtcaggtcactggagggtgaattggggattttctctgcagcttcttctcccttctttgcagtggtttttactggctggtgacttcgaaagggttaggtattaaaagaagttcagaaacccagttgtatgtttcctaactcatatgagtctcttccaggtctcatagtgtcctgttgtttgggacaataatagacggtttggttgggatgggtggcctcagcatgggcactgagtcatttattgcttcactcttgctggagccaagagtcctgcgtgtcccccattgtgttgtcacatcattgggtttatgaaaatacagccgaggggctgaggagggacacttccctcccttctttgcattaaccttagccagaagctttgtggattatagtacctccctaagctggaagtcctgcctgcccggtttctagtgcctatcacaggaatcacttaccactcccttctactctacttcaaccctgcctttatatgaatgagagagggcaatagagactgtctttctttgagattcctttgcacattcttctgagatcattagcttttttatcaggagaatcctcttgtagaccagtgaccaccctccaggggtcatcaacttcagaagcagagccgtcagtgtggctgcagccatttctctatttgtgttggtctgaaggggtaaaggcaccttatctcctaaactgggacttgttgtcggcagtttggcaatgatattacctttcacactgcccttctgtgctggccagaactccgagcctttttatttgttttgtacactttagttacagttgtaagttcatgaggatgttgaccattaagaggaaatatcactgcagccttctgcttgtaggaaatggaagtccctggaactggcttaccatcttgatttgaaatcatctctgtgatccaacattggcactttccagatcatgacagtgttgctttgaaagaagttctgtggttcaagtgggccaatgcatgaaatatagacctagatttaagcatgagagaaagtaacttgaaggctttttttctttttccttgagtttatttgcctcttattgaactttaactctatgatctccctttatctaaaaaatatccttgtgacaatgaaatatttgtgggtgaaatgacttgttgtctgggattaggtgtataattcttctgcgtgtgtgtatgggtgtgcatgtgtgtggaagatgaaataaaaacgggtagtattgataaattttgagtagagtttctctctacttttatgtatgtttgaaaattgccaaataaaaaatgtaaaactctatgagggatatagacaccacctatgaacagacctcttttcaaagtgaattgagtaagtgacttatccagtgtgtctacactaatggcgtaagtgaaatcagaacctatggattttgatcaacaagttatcaacaatgcacgcccctctctctcttttttctttgtctttagaatcctatctttcagtttggagaactgttcttttatcctctccatgtggaccagaaggtttattcttggtttacttttactttaaaaaatatatttcagtaagcctttatgtaacaaattaaacttctgttatatgcaaagttacccattaggttgagtcagggttggacagagaaggaagccaggttttcacttaactcatttgcttcatatggaaggaagcctcagttgcctgagtgccaggaaaagaaaagattatagttgattctgtaaatggctcttaattatgttcttacggggctagctgtatgaaaccctgggtttcttggaatagttttaagtttttaatcactcctaaaatctttcaaaataagaaaggaaaagtcccattttttttttctcagctctgaacaatgttagttttcctggatatctgatccatttctgtttgcagtggaatagagagaaagaccctgaactttaagagttagaagactggcttctagccccagctggtccctcttggccttgtgactttaggtcaagctcttgatctcccagggccttgatttcctcatctgtgaaatggggaccttgtgatacctttccaggcccctccagttttatgtttagaggatattttggaatagtgtatgtgaagagtcttggcaaactgtaaagcatttctcaggtataaggcatattactcactcttagtatttctttcatgctgctattgagtgtgaccatacccaacacacatgactggtatcataatctgatggggttgggcccagttcaatggtcatgcaaaactgggacatgcaccttggatttcttgtccttggctgtatccctcatctcctaaccctaggatcccagacgctccagtcttcacatgatcattgattgagaatagtgagagcataaactcgtgaggtcagtaaggccagatgtcttgaacttcttgccaaacaaaagccacctagtgtttagattctgtgtaccattgttggtaagagccattcggtttcaaagaactgaaaagagtggtatgaaaagacacatgaaacaccctggaaggttcttggaaactgaacagcccttaactttgagttacatgtaagtgaatggaaacccttgttttacatttcacttgaaacatctatgaggtggttcagggttaggccacaatgaaaaatgagcagatgtttccctgcattcaaaatgccactagcttattcttctgtagattcagagaaagctacctgctcacttctgtctaaatactgtgcaatctcctgcaatggttatttaatcaccagcttctgcacaactgtcctttcagaggtctaggggaattcctataaatattaactgaaatttggggtcccaaggaataatcagtgggcaggaaatctaatataattgcaatatatttatgtcctcattttccagtgcgttgtgtttagaatctccactgtgttggcgtagtgtttctccaggccggattctcagcattttgaaacaaatacgttatttgaatttaagatattgtaattattagcacaaaggagatttcagtatttttccataaaatataattagttaatgtctatggaggtagtgattaactttcagacactgattctaaaattagaaatattttgtacctaatgtaaaaatattataataggtgatgaagtaaagtattttaagagtaaagcgatatctgcttaggctaagtcatgtcagatttttcacccgtgtaatgattttgtcattgtttttgatgagtatattgaacagaactgctacaatctgcaaacaacatgaagagaatttttgaattagtattttatatggtgagtttattttctatttaatatacatttttgagcatgattagtcatcacttaagagcaatgctcacacaaccgaaaaagacaatctttgccaactgttcacttagttatagaagggagtttgactttttttttctttttaaactacaattccacactttataggataaagttctgacttttacatctgaatcctttggctccaaagacaatgctgtgccttctctggagctgatcaagtccaaatgcaagtgtcctaagtggacagggatggtttcccccagctgggatgtgaaccctttttttaaagagatctagcacttgagtctcacagccagaggggcagagccaggcacctctgatggggccccaacagcacgtggactgggcttgtggagatggcattgaggtggaaaggcaaaagtaattctagctgctttcctgggagagaacaagtgagaacccagaagtgcctgccccctgacaggaagcagaaacctacgtggagaattgtcagctcagcagtcctgtccagaccacactgccagggcttgtgtagttatgggaggcagactcaaggaacttctttttcaggctttctgctgtcgtccttggctgtcacctcacactggcatcccactgtcccagctttcatgttgagaagattctgggggcctcctagtcagtctcattcttcagttcccgctacagcagaaccactgcttgtccatttggcctggcctgtgttttccacatgtgttgtcctggccaatttccgccatcagtaaggtccttttcatcaagtcataaatctaatggagggaacaaacacacacaacaaaacccacacagttcaagttaatgaatttgtgttggatgggggtgaagggaggaaagttgcttcaaatttggaaaaatttaattcactcaacatttgttgattgacttgtgtgtttagccatgtgctgggagctggggctgctacagttgtttcttctctcagaagcaatactctctggttaactagagagcccttttctctaaagtaaaactgatttctactctaagggaagacatttctggacctgccgcttagctgttcttggaggtgtagagtggggatggatggggagcagccatgtgtttcttagtgactcatttgatgattactccattgtttgaagggctggatgttatgtaatcaacattctatcccctcccccaattacttccccctaacaatctgggattttccatcattttgttaaccttcctggagacatgttgattttttccactagatttttttgggcatgtcccagggcaacccaaacttaccactccctggaacttcagattcctcgtcattggcaaggcctggaagagcagctagggagcccttctgttcttccagggcacagcctggactctagcagtttcctgacagcatcactaaaagcaaacaagagagaaagtgccacctgtccttcttttatgcagtgtaatctccacttagttcgacattcagaggcaatatatttgctcctttcttcagaggtttatcctatgcttaatttcattcagcccataacacattgtttgtgtccggggaatattttttaacgaagcaaagtttagaaatggccagttgaagaatttctgtagtagccttgcctggaacttagtcattttataagtcagtttcatgggatacactgaagattcaggtttctagaaatcactttggtaaagtgtatcactgtcaaaaggtaacaggaaagctagtagggattctcagctcatttctttgcttattcactttttgtgggaaactgtgcctgaggttaattcagaagatgtttacgttcagctgtatttatgtaccaacatcgtgaacatggtctgcaaatacaggaggatctggatggacatagcagagattaaggtgcatgtgggtgtggcaaatgatgatacatttgcaaatctgcaggctgtaatgcctcactcttcttcactactgacactaaccaagctttatagatttttcgtcctgtatgcacttcaagttgacttgaagtcatgttcacttatgttatctgccttgccacttttgtagtcaaagccaccatcctctctcaccaggactgatgcaataactttctaaaatgtcttgctcatccattcatactcacccctaaatcactctttacagaacggataaggtgatcttaaaacaaaatgatctttttgtagttgatgctgatgtccctgctctgaggactacactttgagaaccactgatctggagtattcttttcttcctaaattctcatgcatccttcacaattcaggtcaaacatctctcatcttctaagggaggcctttcctgtttccttcagacttccaggaattcctgttgcacattaacgttgcatcatgtacttctcctttgaagcccttattgacattgcatttgaacatttaactgtgtagatagatttttagtggctgaatctactgcaagaatcagatagctagctcctgtggagactatttctgtgttgctcactgttgtttctttaattccttgcacaaagcaagtgctagataatcatttgttgaatgaatgaatattgttatttcattttcataggtaactgaaagtatgtagtaacattaatattctcggtaaatgtgaaagataagcagggactgtgtataaactagtagaggtgttcaggaagagtaaacatatttgtttgtcagggatgcaggacattttagacctagcacaatgtggaaagccccttaaatgttgcctgctcatgccggcacagtggctcatgcctatgatcccagcactttgggaggccgaggcaggtggatcacttgaggtcaggagctcgagaccagcctggccaacatggtgaaaccctgtctctcctaaaaataaaaaaaactagctgggcatggtggcacatgcctataatcctagctactcaggaggctgaggcaggagaatcccttgaacccaggaggcagaggttgtagtgagctgagatcacgccactgcactccagcctgggtgacagagcaagactccgtctcaaaaaaaaaaaaaaaaaaaaaattgcctgctctggtgctctggtgaggatgctagcacagttgtttctcagcttgccttcttacagcccatttgtaatgttttatgattggttcattacctatgtaatttttgttattcatatgcaattttttcatgcagatatggaatgtgcagatgtcccactattaactccaagcagcaaagaaatgatgtctcaagcattaaaagctactttcagtggtttcactaaagaacagcaacgactggggatcccaaaaggtatggttttgtagttggaaaaagagtggttggggtcagaccctttgggaagacacattttctcacctggagtgtgtgaggcagacgttacactaaccacattggagtcagcagctatgggccatggctgccatctgttaggacaatcatgacacacatactgaggctgccccgtctcctgggcttgttcttgccatcttggtatgaagacagtggtcctcaaacttgcctgcacactagaatcacttctggatctcttggaacagctctgatgttgggcattacacctgctgtcatctgaacttctaagtgtcattggtgggtgtagccaggttaaacctcaggtcatgtatgaagattgcatgttatcaatactacagtgctactcaagctatagcttatgataagtacagactttgcagagtatctggtataatacaggcacctaataatgttattaccaagtgccatttgaatgaatgactactactaattgctacaattgttaccactataattggctaagataaaaaataatcgagaataatagtctcaagtatattatagttaagagcagggagaggcatgagcaatctcttgttattattgctattaaagaagccatttgttctgttcagggctttaaaaaagtccaatgggaataaggcagtgagagaggagattcatggaaatctttgcctgcaaggacagagaatactcatgtggtactttttggctggcagtagtgacctcctagctggtgaaatagagaaggcggagatgttgaatatggaggggagggttatggaaggcactcaatgatgtgcaggctaggctgatgcttcctcattcgatgaataaagatagcattctcagctaaattcagctccttcagtgtcctctctgaggcttggataggagttaaaagcccgacctgctggatcttcatctgatctctttcctcagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaaggtaaatatgtggaaacagagagaggtggaggttatgtggggttgctgtgagagtaggtagggggctcacccaatggtgggacgtcaatgcctttatctgtgggtgtcctactgtaggacgtatgtgggaatgtgcctagtacactgctcagcatacagcaggtactcttagatgagtgtaatttctttttcttctacatattgggggttcagatattaatcttcagcaagattgtaccactgaagcttcttggattgcaacattctaatccaggtccttatctcaaacccatgccctggttgaacaagcagtgcccacagccaacccaagaatagtttttgtttttgtttttgtttttgttttctgcaatcttaatacacactgccttgatgcatgccccataatacctcatcacatcccgggaaagcttagcgtctgagaccgtattaataagacagatttctctgcccactaactgaattggaattgcagtagtgcatcataccttttacatctggagcaggaactggggttatatcaggacgctatgttgcaaccttataatgacatggcctcccctaacagcctcttccaacctttttggaccaagtgactcatgtaccacagtcctggctgagtatagaaacagcagcaggcggcaaacttgggtgtttttgtgcttatttttttgaattttttcttaaaataaattgcagttaccagcagtcagcagtgcccttcagctgactgtaagcctagaagcccattgccctctctaacccaggcccatcctttccctgtggtcatcagctctaacccttggcacagacgctgggggaggggagcaaaactcaggattagcacttttaccccgcattataccttcctttggttaagaatatattccattctgcagtgctcaagagagacccaaactagatttctctgtgctcaaaaatgttatctttattccttcttttcactttctgttgaaaaataagacataaaggaatacaggaaagaactaggtgagtctttctgtggctgcttttaccgaggatggcaggcagttgcaaagcaccggcatgttctccatgcacagacacccactcataggtgttgacatgagcgacctgtttatagagggaaacgatacggcaggctcctaacagatctgatttgactgttgacttctaaacacaatagcagattcaatcagactgtgtaacccagtatattctactaagaggctgttttcctccatttatcaaaatggagctgctaggtgttttgggctatctaagcccatctctgattgtagttacaattaatatctctatcatgtctccctgtttccaaagtgctttcaaatacattttctctttggattatcaaaataactgtgagatagtaaggacaagtcctattattgtccttgtctgtaaaatgaagctcagggtaggcgatttcttcagtatcactcatctccttttcttcattttatttcaactttcagtatatttttattttattttattttatttattttttgagacagagtcttgctctgtcacccaggctggagtgcagtcgcgcgatgtcggctcactgcaaccttcgcctcctaggttcaagcgattctcctgcctcaccctcctgagtagctgggactacaggcgcatgccaccatgcctagctaatttttgtatttttagtagagtcagggcttcaccgtgttggccaggatggtcttgatcccttgacctcgtgatctgcccaccttggcctcccaaaacactgggattacaggcgtgagccaccgcgcctgccctcaatatatttttatttaacttaaaatttaacatcccatcctgtgctttttgtataataatgtggattcacaggggccttctggcccctaagactggtttggcctcacttagggtaaaggaataatgtaagaaaatttaagagaattaggatataagtcagtatgtttgagagcaaaagtcatatcttcccacccaatattctgttgagagaggcagaaagaattctccctcttcaggttcagttacttgaagagatgagcatgatgtttgtgctgaggctacagcttttgttctgtaattaaagcaacacagcagcaaaagaacatagctgtttggggtggggtggaaggtgaaaggtacggggatgtttcaatctgataaactgctaaagcaaagtttaatcattttatctcaactgggaactgtttttctgtgcaggcataaacttgttttcccatcagactttgctcctaacaagctatcaaatacctgaggaaaaacccaaacccatactctatgtcagattcttatggtgaaatataatcagactactccatacaagaatcggagccatggcatttgttccagggtaattagaggatcccaggcttactgcagggtcgttcagagctttctgtccgcaggtgcacttcgtctcccttcctctccttttcctaggggagttggcatctgggcaggagcttgactgggttgctcttctctcccttgacacaagcgcagtcgcatttcaccaaatggagtcaccttaccagtgtcctgcttcttgtctgggcctgaacttgaaacctgagggcaatgggaaaaatacaaaacaaaaaccagacatctgttagaggaaatggagaacgtaaaatctatggcctaaagactgcaatatatttttgagaaattttgaaattgattagtttgggggttggggattgatcctgctaacctgggatgtactcaagcctttggctatagtgtggtcgacatacacgcagcacgaatgcattgagaatgaatgctgaatgccttctgagcccttagagattactcatggattctctttccaagatactaaatcccattttgcagctactgaaataataaccttagtcatatttttttgatctcatctttagacaaggccacagtcaggacagactcagataccaacccagttaatgagtatgcagatttcttagaaaaggggttgagatcattgtggtctttgcatccaagatccttttaggccaagcatgacttgaatattgacctctttgttccttccctatctgttcattacagaggatgtgaaaccatatcaagttaatggagtcaacccagcctatccagaatcccgctatacctcggattacttcattagtaagttcatttctacccctcttctctcatgataatagcaaactaggaaaagacccctatctcagtgaatctcaggctccttcatggtaattctatcaaaaatagtatcttcttagatgtagactcttctttgttactttattttattattttccacaaagcacaaagtttcaacctatatatatgtttcattaacctaccaagttcctacacactaggatccttctctgatgtcttcacctgaaagtcatgcagagagactgcaactagacccctaaacttttgttcctatttgatactgtgcactacgatggccaaaagagggttgggttagggatttgatcttggtctttgttctttcctttttactagtggagataacagcatttcctccaaaatccttctttaagagtgtgctatgcagcttcaaattctattatagcaaatacagtcttctcctttttcgtgtaagatacccaaccatactgaagagatggcctgagggaaagaatgaaatgtaggcctgttgccactaatgtaagctctgagatataggaccatcttatctgatggctgtgcttttacagggaatatgaaacaggttttatttttttcgttttatctttttacgttattacaatttttattccagtgacacaatgatattaactactctgtgtcaagagcttattgtgtggggaatgttggtgggcatttgacctctatcctcatttcatcttcatcacagtgctccgggaaaaatcgcaatcacccccattttagagatgaggatatgaagtcaggaaatcaattaccttgtcaagggctaaagctgtttagtagtggacaaggttaaaaatgcaagcttttctgatttaaagtattttcccttattctctaaggagcttgtcccacatcatagggccctgtagatggtgaaaactgcttattttaggtacaaatctctcctctctttacttgcaaaccctttgtttccaggctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaggtcatatttcttctctaaaagctcttgggtttacaagaattacctgactttgtgagtttttttcaggttccattttttttttcttatttattagacctgtagattcctcagtttcagccttcccatcttagagtgtccagatactaagaactttccatcgtggtgttttagccaagtccattattatgacaaaggccatggggtccacagtgaaatcaaaatcaggcaatctaagaaattaaatatcttacttgggcaaaatgttttactcaataactctagttgaatttggtcattttgaaaggtatgctctattttccttgaggaggacataatcaagtaaaaatggttcaggtggccaccctggaaaacccttaagcttagcatgtgtcctggtgctcctcccagaggactcctgggtctgactgtagatcctagctgggtacctggaatgacctctgctggccagcctgggatctttagcctcctgtgactttttcggtttgggaagatacaagatggttaaccaacggtttatttggaaccagtcatcagcagtgtggtgaagtgtgtatttagctagaggaccagggacggaggtggccaggggtttccaaaagaaggtagttttgttaacgtgactattataatagtgataaaatattcactgtcagggaagaaagtgtttaaaaatagagctgggtgacataaagcaaaaaaggtaaaatgcacccaatttttaggaacaggacataaacactcagaggtacagcctacctagtaaagtgtccagattgttttgtttctgagaaaaatgcaatctattgtaagaaagggtttgtctatttagcaagagctagatgatttctaaaaaggtgaaaaacctgacttttctggtgggtaaatgggaaagaattataaatgggaagaggaacaggagaaagctgatcaagcggggcttgggtcagatgtcaggctggggctggcctattagtgatttctgctcaatgactgaccatatgcggtgcctattgtgaggctcttggaggagagcccaatggtacctttactttgaagaatcatgggtcatgcccattgtcgtcttcttcgagtattcagactcacacttcctcctagcaggcctagggatcaccaacaagccctgcagagggaaagtccctgcaaaatcagaacccctaatcttccttcttaaggccccagggtgttagtgtttcagaccgaaggggatgggtgggaccagtcggccttcccctttctggctcttttttatttttgggtgcatgtctatttaaatacatacacacaagtgtgtgtacatgtgtttcttttttatcaggcgagtcaaagcattaaaacgactttcttccttgtgggactttctgtacatctacacagtgaggccaagcctgtgggtttgggctcagccatgttgtaactttgggtcgatctcctgtcacattgttttgaaattgcatctggctttgcatttgtgtaattgtctctttccctctccttttcttcattcttggttttggtccctaccacccctccaaccccaaactaatgactgtggaccaaaagtgacccttacaaggagacatgaggtatttctttctggctccactcttcttccctccctccaagttcaggccacagaaacttgaggggaagaccattttgtgcagggctgttttctgcatgttagaagtgctgcaaacagggcctatgcaaagggccaattgattctgagatgctgtgattggtctagaccgaaagcattactgttagctgattgttatttatactaaccatagtacagtattcacgggctgcattacagcgtacagagtgcttctatgccccacttatttgggccctaaggactgtctttgtacgagtctactcagtgggtggctgggtgctgccgcatcttctgttttgagtgctctgaggtctgtttggtggactcagatagctttggaaggagctcgccgaggcccttctcagaaaggctggctagtggacagtttagagaacacaggtttccctacatgagcgcagcagcataactgagtatctaatccagttggattctacccatttttggagaaaatacccgtaaatgaaggttcccagcaccagggttgtgaaatcgagctaaaatgaaagctgcctaccgctgtaaaccacaactctcaacagggttgcatttgcctcatgtttggggggttgccagagactggttctggcttggtttagtccccttgcttagtgggactccttggaaactctactatcttgcttgtgaaaattctgatgtcctttttctccaagtataaaattggctgatagaaatggaatcatttcagagagactttagcataaatactatcgacttggtgcggtgttgatgaaaatataaattctccttcttaggcttttggtatgtttgtctcaaagagaaaataagtgaccatgaagatcagtagctggtatgaacaaatacctttttatgagacgccacagaatttcctgttctgctaaaacaaggctttgacattctggttgtaggctgttttcttaaatcatttagtgtgaatttcttgaaagaaaattaaatgatctctaaaaaggtgaaaaagatgacttttctggtgggtaaatgggaaagaatttttaagaattataaagaaatatatattcatttttagtaagaatgaagaggtgcccttttgctagtggactgggtgggcagggctgataactccatgaagctcttcagtttgctttccagagattaccctcctctgaatggatgagtggaggaaggaatgagatgaaacggatgacaccacctttctgtttaaagcagttctagagggggtcaggatgtagagaaaacccacagcagtggattttacaaaaagtacacactcaaccgaatacattttatccggatctttaaacaatgttgggagcaacatattttcctatatatttaatttaggtttgggcatctgttcatgtttgatgtttattgttttaaccaatctccgctgtcatggagggaaaaatacactggaggcacactaatatgaagttgtataagtcagccttattctgggatttgaaatttatagatcaaccacccctgaacaattaagagttgacttacggatatttctccgtaaacatttgtcacatccctttgccttttggcctgtgctgaattgaggtgaccatctagtctcctatgatttaacttaggttacttgaaaagtatctgaaagttgcatataaaaaccattcctgcgagcctttttcgctcttagattcatttgttttcctccaaaactattttttttttttttttgctagcctcctttttagtggcatttttgccaatggaaatttctccaggagctattgtgcaatcatagcagctgtttataacctggtttgggaaattaatgaacttgcatgatcttgtggtcagttaagaatgccttaagcaactcacacagtaaaggatttctgacactgctgtggaccttaactctttaataaaccttttaaatattgcctacacttttccaatgaagtttaaatttcaagtacataattttacttggagaggataaagaatatggttttctgtttagaagagtgatagtgtgtgtgattttaaaaaatctcttgggaaaagcatcttacaccatcttactctatttgaaaaggcatagggtcagtacatgtatttcatattaaaatagtatttgggaaaaatgctaaaaaatagcacttagttccaaggtcaaaacaggctaatctgctcttagtctaatgggattcttttttcttatgaccaaaatgttttccaaactgggccttttgaagtcatctcattggcttgagctggagtggggaattcagcctgacattgctccgatttcttcatttattcattgggcctacgacatcagccagaaatcatatcataacatgtgtgatcctcagcttctagatttctggctttagaactcttgaggacccaaacgctactccgacagatgtgagcaacgtttgactctgaatctctgtacttggagttctcaaaccaggcagcagagtggccgtggaccctcggatggtggcctagtgcagcccctttcctcagagtaaacccatgacccctgaagcttctgttcccactcgcctctcccttcttccgtccttcctgcagatctgattagcaatctgtcctccataagagggtttttacagttttttttttttcccactccctcctccccctgtcctcttcctacctcctcctttacctccaggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggtaggcgccctcccgctgcttaggccaactccatctgcacgtttctgtgggtggggtcctggaaggcactctgcacctctgaccagagacgacgagagactcccttttgcagggcacgggggagaagtctctctaagaattctttagtctctctccagccactctgcttgtgaatagccattgatttttggaagcaaatagtatcattctcttcaaagggatcatttccaagaatggtaggaaacttacattttgggtgtttttccatgtctgggggaagggaactataatgatctggtgttcctggaaactctatctagtggcctggcatcaggggatttttcctggtctgctcttgggaggtctttctaaatacaaaatcagcagcagcatctctcaaaggcacaactgaatggcctccgcactggactcttctgcagcacggttctccttaggccagctgttcaaatgtgggaacagtatcctcagtggcactacgccctgtccagatccatcctggcctatagagaatgccccttctcttactcggctttattatcagttttcttccaggagcgaaagctatagttatgatagtgatgggtgaagaaaggccatagagaaaggaagatgtaggttgagagcttgaactttgattgagactctggtagtagagcaaaacaatgctttcttcaaatgggttgtagcatatcatgctacttaaccagaaaaacatgtggagagtatatctgagaaatagccaaggagcattaatgtgttaatcatcagatctctctgtaagattgtagtgttttctaaaaattagaaagtgtgttgtgagtagagcttattttaaagtagctttgattactcagatgtggtctaggcctttattctcttataattctctccaccctggatatgttttcatgtagggaccctttgtgtggatgatgacaaacagcaagatctgtgtttctattgaggtgtctctctgatccttagagtatgctgaatccttatttttgcattcagggaagccttaggtcttttatgaagaaaaccagtgacctttgagaacaactcaaatgcttgaaaacttactcccccttcaaagatcaggagtatctctcttatattgcattccatgtagctcctagtgcagttcattgcatgagtagtgctcaggaattatgtctacatgttggagtagcaacaaggtcaaggccaggaatggaacttaaaggtccttactttattctttctacaataccctggtggtctttgcttgaacatggctagcatgtaggaacttagtacttttcaagggagtcctttcccatctttgaaaggagattattaggaagtatatccatttccattaaaaacgtctgggatgaggaaaagtgtattaagtcactctcaggaagtacaagagtgccagctcatgcagttatacctgttaggggttaaagaactagactgcagttgaatatagtgataaaggaagggagatgtgctgcttaattgggaagagaaaggaaaggcagaggtagctctaaaatgactttgtggccttgggaggtagacgttatctctaattggcagtgcttgcttctgtttttgtggtgcagagaaaactatgctctaggtctgagttatgtttggatagattgatagttgcctgcccaccctctcttctgcccttccttccttccttccttccttccttccttccttcctccctctctccctccctacctcctttccttctttccttcccctccctcccttcctccctccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaacatttagtgagtagaagagaaggggtggtgattatctcttaaaagtctcaaagtctgaagtaatcattttaatgaaaaaacatttttgaagcctcttaccatttaattctttctccttgacaattgcaatttcacttttcatactatctcatgtgatggcgagaataatagtccagaaaacagaagtcctctgtgtttcctcccaactctaacacactgtgtggttttaggcaaatttaccttgtacccttttctacttttagtgaagtagaagtgttcattcttatcttggtggcaggaaatctgtgaaagtgtaattgaattaaatcaactaattaaataaatgaatgctagacattgtgctagacatagagaaaaaaaccctcaattataacaattcaattatttcagcaaatgtttgagcgcatattgagtgcagaaaagcgagtatgtgggctcactgtctccttggattcaagatattttaaatatccttagacttgaactggattctcctattgttgtggtctgaatgaaagttgggatttgttaggtatgtgaggagcagcccacattttagtatttattttttccctgtaattgatacctggtgaacacctcctgcctgtactgcagactcaccctctgagggtgatctcacaccctcatggtgcccccgccaacctcatttaagatgcgtcctagggaatagggaagcggatgaaatgtgcccatacagcctcacccaccacctgaggcagtcactagagtgcctataaatggctgtctagctttatgcagacatgttaagatgagctgaaatttgcaaaagtactttggaaagcagaaatcattgtatagacttgttggcaatacattttattgcttgtaaaagtcacactcaccttctcaggttctgctcaacttttctgtctgttcccttaaaatttgattgctccagagtatgtttggccacacagtaggggtacacatagctctatgtcactattacttggcctgaactaaagggtgcatgcttagattctccaagctgggaagagaatccatcttcctgccatttcaccaggagtctgggtctttgtccctatcacgtccaaaggaatacattttacttcttgataggatgtctttcttactgcactgtaagtgcggaagccagttagaaactgaattttcacattctcctgcacagttacattcttcctccaaagataagaaaattgcatcaaccttcactgggctcccatagcaacttgttaaatgaggtcaagatgcgggggcagataacgtggcttgaaagcctgcctgttagctgagttaagaatacatcaaatgcaatgttggcttccgccaaaatgtaccttcttaccttactgtgaactgtttacggttatcaaactgataccatcagaaagctccattttcttttgttcgaagatacattatgaaccccttctaattacaacacagtcctagagaagtagcccaatgctttctatatacattttatagacctaagcaaaacgctttccaagtccttgaaaaacataggcatctcttcttcctcttgcttctccatttcagtaggtatagaataatataatgggttgtcacatagtagtctctcttcctctcaacccctctagtcccatttcatagatgatgaaactgaggcacaaaaaaatgacttattcaaggccatgtatgtaattgcattctgcacagaggtagcttctgaattgaatcttaagcaccaaatgtctcacctgaatagaaaatcttttcttcatattagataatgagagtactccttggttattgcagttgcctgcctagactgattaggaccttatctccctcttgtcactaatgaacactatatgcatgtgggttaggggtatgtgggagggaagagagctggccttggcttccgtccagaattattgacctataaatcacctttattgaacttcattccagattgtcagacatagccacagataaggagtcctatcacttctgcagctgttgttgagcaggtctggtggtaatgcccttatcaatgtctaggtgtgttctcactctttgatttgcatttatgaatgaagtgattttcttgttttctaggagcctgaaaaaggctaaacccaaagccattcactaactgtaatgaaattatgttttatggtgttatgcagatttataagtaggcagtccttcagtttccttaaggctaaatttgggactatctggaattcaacttccaaatttttttgtgtgtgtgagacatcacacacacacacacacacacaaaggtactagtcttgcaggaaaagaagccccgggccgggtgcggtggctcacgcctgtaatcccagcactttgggaggcagaggcaggcagatcatgaggtcaggagatcgagaccatcctggctaacacagtgaaaccccgtctctactaaaaatacaaaaaactagctgggcgtggtggtgggcgcctgtagtcccagccacttggtaggctgaggcaggagaatgctgtgaacccaggaggcggagcttgcagtgagccgagatcgcacactccagcctgggtgacagagcgagactccgtctcaaaaaaaaaaaaaaaaaaaagccctgtgcattctcctctaggtcctctcaagttgattctgccctgaaataaatcctcttcttgtcatttcatagatgactctagagccagtctaaagtcacacaataagaaagtcccagggccaagtccagaaccttagagttctggctcgtagttgagttttagggatcagtaacccaaaactactgctaaaacatgtttttgaaaataaacaactttactgcaaaaggaagtgcttcaaagcccttcagttcagaatgaaacctgagatttggcagcattagctgaaatcacagttttctgaaggaaggctcgattgcaaaataatctcaatgtattcaggtacaaacaacaactgaggaaacttttggtatgagcctaagttagtgataaggaaagagtaaaagcaggttactagtgcagtgtgaatttgtgctgtgggcatgtgattaggaacagcgtagagccttttaatttggggagataacaggagcgaagctctggaatctaaagtctctccatgtaaatgctgttgtgtaagacagtgtgaattggctaaagtcaggcccagagaagttagggcatttcactgaggtctgcaggccaggcaaagctggggctggcttccaggcttgctgaagccatcacagtctcaatgtagaccatccttgggcagtacctgattggataagaggaaaagagcttgggaatgagaagggcagaaacagagtgtcttccctttcttgctcagaggctgttgtgattaactagttgcaggaagctggcagccccctcagcttaaatagagccttcctgtcagccagcagctgagatgctggcagggattccattcacggtgctgggtttagcagtggatcctaaaggggtgcctggcgtggacctggggatctcagtggagtaatagactcacatgctgctcagttatgtgattgacgggaaaatactttggagcactgaggaggaaaattcccgggaagatttgaactggttgggaggcaaagctcttttctattgcctgtgagtaattccactgtttctgcctcctatctaattagttttgtatgaatttttcttaatcatctgctaccagtagaaaaagatcacatggtaaaaagattcgtcctcactatgaacttttttttttctaaatgtcttttaaaaaacgtggaaagtggtgattgcctatttctgtcatggctttcaaagaccacaactggctgaagcatcttagtgtcttgattcagctgcggtaataccttgcaagcagtctttggacagaagggatctattcatactgtacaatacatcctgcaccctggtgctgtttacaactctctgaggtcttgagggtgcctggattttggataccaggagactcacgggttgacccctctattctgggtatagcccactgcctgttttagaggaagagtctctgagtcttagatttttggggtcactgtttctttaataaagtctcactacaaataatggaattgggtggtgactgttctggaattccactctgtctccagtttgaagctccacctttggaggaagcaaaatgtttccactgagcagaatgcagccagcgtgctgctgagacatccacaccagtctttattgcctttaaacaacaggcctcggaaactccccatcacctctgttgggaaaggccctgccaggtgtcccagatgaccctgcctttgcccccttggcacttctttcttttctctggacggcctcccctgctgcagagagtgagcagctgctgctctttgtagaggctcattcaagagaagcgctgcccttcctgtctccctaaggtgacttgcatgtgatgcctgcaggttggagcactcatcagcaccccatcagtcacttggggatgcctgcaggtagagaagtccaagttaaacacaagaaagagtggtcatcccatgcagttttaccaagggcaacattcaggggccatccctgtagaattgagagcatggagtcaggccctgccagtgagcagctgtgtaacctttggcaagctaacatctctgtatctgttttctcatctgcaaatggcagtaataatagtttctataccataggcttgttgtgagaactaatgaattagtttatggagagcacttggagcagtgctgggtatacaggaagctaggctctaagtgctagctgtcacctacattccatagtattctccaaaccttttatttttccagtataattctaagttccttgaggccagggaacaacgcattttacttatagaattgcagtaattgctggcagtgtcatggggcgtagcaggcatttaataataattaggtcttttcaattatttagctcaatcccagatgtattaagttcctactgtgtgcttagactccttcatatacactgactttttaaatccttcaccaaatatcacatgaggaagtttctgttatgcccattgtataaatgagggaatcgagacttttttttttctttttagaggaggaggtctagcccaatgttacacagcaaacaacaaataagatgactttcagggttttcacatgtcagaaaatattcaaaatactgtgttagtttgagtgtgccggaaagcaggtgccaagacatgattagatgtgcaagatgtttacggaaggagcatctatgaaggaaaaaaaggcagcgaagagaaggcagcggaaccttcagaccatgctgcaggtctggaaggaggagatttgggtagaaagagccctcaactgcagctccattctaagaaaactttggctgggcccaggggatctttgggtcaaggtcgtctgctggaggagctctgtgtctcacaggggtggacctgcatgccctcactgtgctcagtccctggctggagcagtccccaggatgaggggtgctggtgtggacatggtagagccagtcaattatgttccctgaagcaggagaactgagtagaacaggtagtgtgacagctgcagggacctgagctgtaaacatggcttgttgagaccagcacagctttttccatgtggcaggactcaagaccatgtgtcccgacactctcagtagtccgtgatgggcttctgagttcaatgcatgttgttgactgtaactccccaaactttattgtcttttgtatgactcacctctccctgagagataatgagagtgaaagttctcctagagtgattgaatgtgaaagtttaaactctgaaacaaggatgggacttgctttgttggagatgctcacagggcacaggtctgtggaggtgtttgacattcagagctgaggcggtggagtttcttatggaggcctctcaaggctaggttctctgttctttttttctttaaaggcgtaggtaggacactttcagcttatcacgttatggtgaaacaaaaagtacttgttccgnnnnnnnnnnnnnnnnnnnncagttgttaatattgtgttttgctattcaacacactctggctacgtttgaggagtgttcagagattatatgctggataaatgcttacaaaattcggtgtgcaaatgatcacttaggatctagttcaactaccttccaaggattctattatacctaactagtgatttctctcattgttgacatgcaggggaaaacttaacccctaggataaaataaattccagagagcaagttgagaatcctactgagaaaagactataatcttcagacttctaaagtcctgttttctaaccctgatcagtgaacatatctttctttcttctcattacctacacacttaggaagatttttctttgtacatttatagtggctggaaaaaccttttctttggtttataacaaaattcttatccccttcccccaaatccaaacctaacccatctctggtgacttcttaaaagaaccggttacctagaagacatcaggaggaaagagctataaagaaacccacttcctgacttgagcttcactggctcactgtccaagtttgtgtctgagtgttagcttgaatgtgttagacagagttactgatgggtttagaagaaagaggtggttgcatttgaatagagactgcccctttaagagaggaacagtcccctttctcctgctgccgcccccacacatgtgtacttgagcacttgcaggtgtgcagagccagagcaaaaacaaaggtctttccctcataccctaaaaatgtgtaactgtcttgttctcagacccaagtcagactggccaaataagcctcacttaaccctgttccaggtgggaggactccactggccagttgccagccacctggtcttgctgtcaagcctgtcttgggccctgatggctggacaagaggttctgcttgaaccccagttaatgctggtgggacccgtctctttgggcccaaactattggcatttgtggggaacggtgttgaacttgctctaggtgagctctatacaatacttaggtgaagaatacttggtgagggacatgaataactaaggaaaaaggtgcatcgggaaaagaggatctaagtccatctgtggccaagatttccctaaaccatatatgcctgtgatactttcacttgcaaagcagtttgcatctgctgtctcttttggtgcgtgtgcacttttaacatgggaacaaggatttcagagtcttccctaacttaaaaaagtcctaaatgcttattctcattgaaaatattaaaaatttttacattcgtatactgtaacttttttttccttaacctccaactttctactttttcaaagttgccatacgaaggccaatttaatccttggaagtctaattagattttttctagtgcttttacaattttttttaaatgcatcttttttcttgttttttactgaaaattgtttttaaaaatatattttctgttgtttcattcttctttgtaattccattattgtatattcagttgctcctaaattgttcacctctttaagtgtctttctctctctctgtctatatatatgtatatatgcagatttttgtaataaggacttaatttacatttttataaactaaagagaagcagagattactatttccattttagggaaggaaaaagtaaagcccagagagattaaatgagttgcataagattgcatatggtgattcaggtaagaactgatatcaaagcctcgtaccctcaactccctacccggggctttcccacaggcatcatatattttaattttataggatgccgtcatcactcagtactccactgcctgacatgtaaaatggcttttatttttaaattttttgacactcctcctcctttcgtttttgatctaacatgcaagagacatgaactcggcagtcaaagactggttttaactgatttgagagctgttttctcactctttttcatggttagatactggctatctcagcaacaaatacaagtttataaagttgttgtttgttcatcatcgtgttcagcaagtatgctttccaaacacctgtcagaatgttctttgttgtttgagttgaattattggaagttatattcccaatcactgcccttgagttattagccactgatacaggaacacgtttatagaatatactgacacacagtgagtctttaaaccaaggccgtattggccagtgatagaatgttatacatggagtgtgttagagatgagataagattgggtcagggtggggcaaagaaaatatacaactcagaagaaatgagagacatagaactcagccaaaatatcaagcactcctggcccttaatcttcttaaaataattttctcagggtcttgattgccagtcagtccagcaatacagtttcttgagttattcatcctcaggcaacaagactttgtgcagcttcaggttgagcttggtccagaggccaagaaactgtcaggatgttttctgttttgtccttaaacttaatggaaatcaggagatttaggggcctttgtgaatggtgatttagaagagggttgacagaaaggggtgatgcttggactggggagtcacccaccccaccctcagaggtgcgtcctcctgtggtagcatgaaaggcagattgatacacttgtgaacagatgggtcatttctggattcgaatgttctgtttttgccatcatcgtttggctgtgggtagagacacctggctggaagggaggggccagcaggcctgttcctctgttttagggccacctgccagatgtgtgctatcagggcagagtcagccctattgcaagggtgaccaaccatgagagtttcataggttaaaataaatgtggtgtcctgcccacaccgaggtatttgatttgacttttagaatagagctaaagggattagcttcttaaagtagcaaattaactcccaaaggacaggtagtcattttcatttttgggaacacgttgatgaaatgcagcctgagggtcacccatattgtttggccccaaatattgtttaatagagagaagccatttgagcggactttctaatccatatgcctttcttcagaggaggtttgtttcagtaatgtaatttagaaaatatttaatgagtacctgctgaagacaagctatcatacctggcattgaggatatatggctcagtaagatatagtctgtgttctcagggagaacatgtcaaatgacactgtcattcaacagcaaagaattttttgtttgttggtgtttgttggtgaggcactgtgctaggctttgggttgaagcagtgaaaaaacaaagtccttgtccttacagcatatattctagtgatgggagaaatggacagagaccaaaccaatggggtggtcttggtgtaagccatgtactatggaaatatgaggagactgcctgggaaggtgcctgcccagcgttgacctccttctgtttggaagaaaactcctgtgttctcctctcagcagagcacaggtgacaagagtgagaacttgtggttgaaatggaaatgaggaaggagtagaaggaaaaagtgaagttcaacctgaccctgttcacttgctgtgaggatgtccttgtcacaggcaggcaactcccagatctggaaaatgagaagaatgatactgacaaatcgggaaatggaagggatttccatcaagagcatgttactaacaccttgtcctagcccattgctatatatgtatttatgctgctcagttctcagcctcagggcaagggaccagaatagcaggggatttttaataaccagctcctcattgagacagatagtgggccttgcagctcccagacaaggaaatatgacccaaatgagcaggaatttacttgaagctttactttttttaaaaagtgagattgttgccttagatttgaggagccttgggggtccccttagggggtgaacatccttggtgtgatttgctttgtaggcttgggagctctccaagttcccacctggtatttcttcttcagagcttgtagcacgttcttcaaatcagacctgtcagtgtgtagtaagaactgtcctcttctccagaggctgagaagaacaaagcagtagaaggaaattcccctgcagccgcctgagagggagggtggagagggagcagacagcagggggtgtggaggctccgtgccatgggagatgggtgtgtggagtgtgtgtgtggtgctctcccgcccgcatggctctggaaagagacctccttctaacagggacccctctgttgttgtggctcagagcttcgacttgagaagcatactttcccagtgatgccactggattcctgatgtgtgacactcccgggcagcatcgtgaagggtgctgttgactgccttggagatcccagacagggacaccattatgagtcacattgaacatgtgagctccccttcccatgactggcgctattattagtaccgttttctgctctaggggacaaaggtcactgagaccacagtccatttgggtaggtggaagaggctgggcacagggataagggggagttgcagggggaatggaggaagaggctttacaagtttaggatatgttggagcaagggcaagggatggggtcctggagccctgtggatttgggcagacctccgctaagcacacagaaacaccctctagaagagtcgtaactgggagtgctggactcattcattgtctgcaccaatcttgggtgtgagaacttctgatgggcctggatgtgggtgtcgctggtggatctgtgtagccagtgtgccttccaaccccagagctgcctctaagctttgggtttccaagtggccctgaagtcccctcccagacctgaagtgagggtgatgcattgctgtggagacaggctcctgtattagaccatccacgggcccagccaggaactgcgcccaccctggcccagtgtttctggctggaagaacatttccatgtctttcctagttctcttgctccccacaacaaaaaggcagtttaggagtcagcaaaaaggtgctagaggggacgcttcagcggccatcatgaactcctctcacttggtacaaaaatgtgggctttctgaagggtgagccctgtgtgcaccagttaggctggagtgcgcctgtggggtttctctacaggaatcgggggagggagccaggaactgacatctctgttatgttgactgtcctattatgaagccaacgggagagatttcttcccattcatattcccattatttctttaggtatctgcttttcctatctatcctccctctttccttgggtgtaaacagaaaaaaaaaagagttagagagctctgcacctaggacttgggcttctagggcctgaatttaatttttttttctttcattccttttgaacaaaggaaaagtcacaatgaggacaaaagtcctctgacgagtactcaccctgtcccagactcaccgggtcccgtacgctgacatcacagagaaagggcagggcggggcatctacagcctatgactgcttgacatttcagtttggaaaatgcgctggtagaaaaggaaaactaaccattccgtcagagggttcgtcctctgggagctggtgcaaaccacgggaattgaaggtcccttctctgcattgtggctgccaagtcccaagggcaggagactgcagtgtgctcctgggccctgttctccagcaccagcagatgtgctgacagctccctgccaaagactcatccgggggaaggatctcgatcttcccatccctttcctcggcttggtgtcatgagaccccgtgccccaaagagattttcagatagtgggagagaggttcaaaggtgaacattgggaaggagaaacaatgaagtaatgtaacataatggctaccacaagaggatgctggaaatatctcctgtggaggtggatgccatggcgggggctggcatggccactggtggtcggatgactgggagaaccactggctatcccgtgtcctgcaactgctgtgagaagtaggggagagagtttttcaagtcaggtccccttatcccttggaacattgcactcagtcaggcagtttagatgccaggcctttggcctggtcctgtccaggggcaacgtagcattgagatgaagaacctggggatgggctgcatgggttccagtcccggctactccactgctgatctaaatggccttgcagtgtgtcagttttctctgctgtgaagtggtagaaacaaatagcacaacagttgcatccaccccacagaattattgggaggaatgaaggaaacgagtgtagagcgtcactcacagtgtctgcggcgtagtaggtgcaccgtcaagcatagcactcattagtttttctctgtcagggtctaaggcaaccccctctcctccgaggcttcttttacatagctttgggatagaatggttttcttcatgtctctcttcagtctctatagttatcgtgagtttctccaagaaacctattctgtgaccagggctctggcagctgcatttcttgagagcgatttgctgttttacttctttgtgcctgttaggatggcttctcagtggattcctctgagaatgtcacggttagttttgtgagcccaggcagaaaacaagtagctcatgactttaggcaactcccaagaaacctgcaaatgtccctgagttgaatacgaaacggtttttattgaatgaaagtagaaacagaggaagctacggctttaccagtgcggccctctgggctgttgttcgaatgttactttattttataggcattcactgagccattttattgtggaatacatgtaaggtatttcttgcaagatagttttaaagagctaatggtccattctcagaaagaggaggtagagctatttcatgttttcatatttagcgtggcaagtgctgagaggagccttggaaaccaccattaggaagttgttactggaggaggacttcctttggctgtgggatgatagctcgtgtcagtagctgtttctttacttcattggaggttgccctggtcctttgagtctaaaggcctgggtactagacccagaaccaccatttcgctaaccgtggctcagagcaaagtcacagtactttgctgagcactttttctgcaccattagaaaggaagccgtaagaccacttgtgcctctccttacagcagagggttgggtgtggattttaggagcaagcacaacgatgcatgtgaaaatgtcttgtagaaatatgagatacaacaagacattacccttatggattatgaaggcaatttcttttttagattgagagggaacttaaagtttgtttcctgttaaatctcagtttactttggatcagacaaatttgcaactccggtgaaaaattagagccttagtgagcaaagctttcctgtaggagctggtgcttcctgggctgtatccagagacatggactgggtctttcccagtcccgctctgcccagtttgtttatgttataaggggcagtgtaacaagaagcatggacttttgaacccctatttgtctctccaccgacacctataaattaagaatcactggtggcattgtcatttcagatgagaaaagtatcctcaaaggaaatcggtgtgatataaaccttttagcatagaataaattgactgtcagagtgttgatggctaagacagagaagtgtgtgtgtgtgtgtgtgtgtgtgtgtgtgtgtgtgtgtctaatttagaatatactgaacctatgcagaatttctgacagtcctcatctgacccctgaggattttctgggtggcacgttaattcctcaaatagtaatgatgcttttttttttttttcctttgggtgctttcctgtaagtggactggaagggcagggtggtggcagtggagagaaatattatgactgaacagatatttaacatctatttccttgtaagagggccggaggatagtgatccttcttactcacaaatcaggggccacaggctccctactacagagcagtgcttatgagccataacttgtgtttggaactggcaaagacattcattccttcgttaatatgtttcttacttctgaaggcaaaaataatgacttagtttttgcaggtgtaaaagattatgctgccttagaatatcccagaggataggcacagtgttctctttctagaatttgtttagcaataaaaatgaaccgatccttaagttaatcaaaataaagcacttgacacattttcttccatgcttttgttttatagggaggcctttgtcttttctatctgttcgagctcataacacttcctccgacatgtgcactgtctgttgccttcattttctcctggctggatgggctgagagaagagggatgtgggagtgccgtgtgtggggattagctgcgtagagtgctgaatatctggtgtaatgattcacaatggcttgtgtttctaggcagtggaccaatccagctgtggcagtttcttctggaattactcactgataaatcctgtcagtcttttatcagctggacaggagatggctgggaattcaaactttctgacccagatgaggtaaggaaggaggggcttgcgagtactgtgttgaggaaggatgagagaaaactcctggaaggggtggcgtgggcctgaatgacgtgttccaggattgggattcccagctctgccacttgccacccggagcaagctaggtagcctgtctgagctccaggttcattatttggaaaatagagaaaagatctatgttaccccatttgtcttacaggattagctgatagaaggcattaacgtgcctggcagtaggtcagttatcacccatagagctgcctcctgtgacttagcctcttcctagcccggtggctctgtgagtgtgaaaggggccagacagttcaagaggccttgggagattggctcattagtttcttatttcattacacacgtttatggagtagtggttccgtgccatgcccaattctgaggataaaaaacaatgaacaggagagacaacatctttgttctggcagacatgagaaaatatttgtgccctggtatggaaaaaaaacacttcctgttgatgaaaggcaggtatgattgcagctcagctcctccgcttcacacttccctgttagatttcatgcttgcaaagcaaggagattttactaataatatgcggaaagaggagaatgtatagtgtggctttttgtttgttttttaaagtcacatatttaatcctagttcagggtcactgtgttttcatcaacttaaagaatcattgtgactcccatccttgcccaacccatgaaaaatggaattcaggagataggcccgaaaaatattttctatatctacatgaatctcaaatcatcttacttgagcatcatgggtcaccatgaatgggtatagcataggcatagaaacatatatatttggcctgtcttgtagatttttgcctactcctcctttatttttctttttaaatttcaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggacttgtggggtgggtgggaccagaaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagtaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgctgtggcttggcttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcccctcaatcctggtcaagccaccaccactcactgggagactttgggaaaaatggcttcaggtccttatattttgtttttagttttcagctgcaaacctgggaaaagccacaactcctgagccaacctgaggccacatttgaactcttctcccgaataaacagcacacagagaataggtttctgcttcagtcaaggattcaaccagagagcttttcttcagtgccaagttgcagttatccctccaagtacccgactcagtgctcaccagggtcaaagatacaagacgtacttgaataattcagcttaggcttacgcttctcccactaggagccagagttcagatgaggagccctcaggcaaccgggctttggtgattcctcttaacaatactgctgagaccacagttgaagctgcagtgatgggggtctgtagaggagacagtatcttcaaaagcagttgcagaatttgggaggatcgggtaaggtgaggatagaaggagacacaagggaaagaggaggtgatggtcacactctgtagatttgaacagctttcagaaggtgatgggataagaaaattaaccaagtctactctgactcgactgctataactttggagcaagctgcagcacccaagacaaaaagaaaagaaaaacaaatggatcggcagaggtgtatgaatgaaatgtaactatttaaacctaaaaaggaaaaggattgtgatttgtgctttgggtacaatgaggcaaacaatgtgaactagaggtcacactcaggctggttccatgccatagagatgtgcacttttgccttcacagtgtaggaaccccttgccccacgcaacccaaaagaagaatgtaccgtagtaggttaatgggatgtctttggattctagcatattccttcatagcaaccaccatgggcactgaactgaagctgcctcctttaggtgcatatcagtcccctattttaactctcataggtcaggcccacacattgacattcctgccttgtccctgtagaatttaattttgtgacccctgtgtagatatctatccacattccatgtttacttggcatgaagctcattttattctagagcctacggtggaagagagtacaagaggtcatcaggttcatcagagaaccatctgacttctaagccctgttctttccatgatgccgtattgctggcatagaacgctgaaaagtctcttttgatgatgctggctgatggctcaccagctctgggagccacaggcctggttactaaggggtacgtttcacacatcaaatatgggacaaggacaaagtcttctttcagtacgtgagccttttcacttccatactgctgtttggcctctgcttttccccaggggctgctctggaagatggtttgcgactcagttctagttgtacagagtcccttctctggcttgtatacagggatccttgaccatcctcatggctggattaaggacctggcccttgcatttatgggcatattggctcggcatgctgctggcatctcactactctgtgagatccctccatgccgtgagaatcctcacctaaataatagaagagaaaagcattcccctggcactttttgcagtgaggcagagattcaaggagtctgataaaggcagttgttgatcaattggtgaaaatgccacaaggtttgaacttgaggaaaaaaaatttgataagaatttagaaccccaaatgagggggtaaagtggctctggcctctctgtcccttggtcagtgccatttcctgatttactcaatgttccagtccctttccctgtttccactttcctggcaaatgcttctgccctgggaaagccagttgcatcagattgcctggtgtatctcaatgtcctgacatccaaagtaatgatggcgatgatcatctgcccacagcaacctagggaatcaacaaaggccaggcttgtggcaggctgcaaaatccccaaagcccgtttgagtttacagtcctatctctaatctctctgccctgccactcagactctcgtgctctctggacgacagcatttctacagagctttgatgtcaggtcagccctggtcgttccatgtgatacaatttagcggcacaaggatgttttcagcagcctcttgtgggaattagtgagggtcaagatagagtcactaccttctctctctccactccacatggtcagcctgagccactggccctgggcagtaacaggctctttttaacctttttataggcaaacctgtagtttaagctgtgactctccttgtaccttgtcaaaggctgtcccccagatgtacctagaaatagcacatgtacaggtatactcaaagaagtggcaactgtctttgcaaacctgaaaagctaatgatgagtactgggtttggtctgggattgcctctgtgaaacaaggatattcctaactttagaagaagagatgggactgggagcttccagatggttttggaactgtgttgtgttcatcagaaatagtcattgttcttacagatctcaggggaaggcaagttcaaaactccaagtgtgattgaactgggggactccctctgccaatctacttctcaggtagaccaactttgttccatttgttctgccttccatgggaataaggaagtttgcaaatacagtgcagccagtgcacctgtaatgtgagaggcttatccatatttgaggcaaggtaagaatgacggtgaaaacaatgactagtgtgaccagtgtttaggggtaacagatatttcattcaaatatctgttttctccatggccacgttttcatcatgatagcacagagctgtgcacgagagcccaagcggatttatttgcttcactggctaatcatggaacacgggtgggctgaggtgagtgtatgaactcagcagggtatggatggaaggcggtgctaactctgggcacagatttcccatttagagcaggaagggaccaggtgtgccatgtgcatgatggtggcatgtgttagctgctctaggaacccatgagtgtggcctctgtgaaatctcagatcagagccctgatcataaattccaaatagccttctctctgcaactacaagtaacagccccaaacctgaagcccagtcaagaaagacaattaaaataagagtgagcacacattctggtgtacctggaatagtctcagagtccatcccttgtcctggcataattactcagagcagttcctgttggtcgtacgatactttatacagtctcctcattaaacccagtaatggcctagaggatgatgagaagaagagcaaatgccagaattctaaaattctacattttagagtcaaaagagaccttaaagattatctggtgcaacctcttcaattaggcattcatgaattcaaggtttagagaggccagaggacttgcccaatgtcacctcattaatgacagaactggtactagaatgcagatctctctcttcccagatacccttagccctgtctctagtcccacactgtactaaatttcatccgatttctagggaatgcatcctgatttaaagccgatttcagttgattcagtattgatcatgataatcatttctattagttctgatggacacaagaatctgctaaataatggtgcttaggctgggaacaggagactaagaaagttggatcactgggtggtggaaggccttatctctctcagtttttagaaactgaaaatgcagagtcactgacatctcactttacagaactataggatgttatatctagaaggtgccctacatagtgacgccaccaagcaaatttattcagataacaaacatcccttgagcacctgccgtgtggttggcattgggttcagtacaagggaaaccataaggaagaaggtaaacacacttttttttccttccgtctacttccagtaaattacaatttatagacaaataaaggggaacaccatccagtgaagtaacaatatgatttgacacataggaggaacctaacctgaaggaatgtgtggcctgcaggtgagtagcagttagttaagtggggagggaaagaggttccagtggtggggaatgcatgtccagaggctgagaggtgagaaagtgtgtacactgatggagaaactggaagtagttttatggatctagagcacagagtgcaaaagagtgtgggtgtgaggagaggacagcaagaatgtgtggagatgatccagggccctgtgggctgtgtgaagagtgacgtggagtcctgaggctcttccagcaggctaagtcacatgatccgacctgtgcttaggaaaatcattctgactgtggagcagaacatgaatcagagccagacaagggtggaggcagggagaccagttggaaaactgtttcatgctcagaagagttgcatgcaagagaagcagctatggcacatcagagaggtgttgagaacacagaatcactagccctgggtgtctggtcggtgtggatgggtggtgggcactgtgctaggatgtagaccttgggtggcatgaaaaggcaacaatcaaagtccctgtccttggtctcagtatcatcagagtgtagattttagatccagagagaaccttagaggtgaattccagtgtcctcattgtatagacatggggtttcaggttaagggagtttcagtgatttccatgagatcacattactaaccggtgacagagacagaattagaatttaggtgtagtaactctaaagccaatcctatgcatttaatgagggttggcagcttgttcttccaaacacaagaaaaaaaacagccccttcctttcttccttccagcccttcctccctccttctctctctctctcttcattccttcctctgttcatttgtttgttcctttcttccttctcctctttcctctggggacaagagctcttggcttagaggaatggacagacctccctgcatgacagccataggccctctcttctaatcgcgatctgtctctcctaggagccctgggcatctgcctccactgcggctgtaattggaaagaaagaaggtgttcatttctctatttctctgctccagctgctgatcctcagtttccccctagagctgtgtgagccccctttgccaagtgacctcttcacattacttctggaatcctgttttggacagaacaggtgcctgtctgactagtactgtcataccttccagccccagctcagcatttcttgccacttctgtaccttggtctcacactccttctcctgggccgatggccacctgctttttaaataaatcttttgtattattctagtccttggtgattctcctgtctctcattcattccctttactctccatcttgagtttcctctctttgtgttgcacatcttgtattcctagagaggaaatctaataagctgaagagaaaaggcagtcacctttaagactgtaaagtaggttttaaatcctacgttttaaattttaaaccaggtggtaaatcctggccctgccattgttgagcattgtgaacttgggttaagt

SEQ ID NO: 347 - DNA, 1602 bp, Homo sapiens
ggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctgtggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtga

SEQ ID NO: 348 - protein, 465 aa, Homo sapiens
SSLKRKTTVTANLLPSRTSPTPGTMKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 349 - DNA, 44972 bp, Mus musculus
  misc_feature (1)...(44972): n = A,T,C or G
acccccatcccacttacacccaattaaatcctcaatgactctgtttccaacaaagtcacatttttaggtagatccacatagtttgaggggacataaactcattacatgactctctaggatagagacagtagttgaagccatgagacgagatacttgctttcctgctcctagggaacaagtagaaagaagatagacagggaagctagctttgaaaatggttttgttggccgggcggtggtggcgcatgcctttaatcccagcatttgggaggcagaggcaggcggatttctgagttcaaggccagcctggtctacagagtgagttccaggacagctagggctatacagagaaaccctgtctcaaaaaaaaaattgttttgttggactaggaggaggaaccagggcacaagactggaagaggagagagcaggtaggagttaggggtccctgagagcccagacagaaagtgtcctgggggaaggggctggggcccagagatgaagagaggatgcagcagagagtaagagagtaagaagcacaggggaggagagatggctcagtggtccagggcttgccttgttcacctgagttcaacccctggaacagactacaaaaagttgtcttacagaagagttgggaaaaagattgagggaccccaagagaagagggactccacaagaaggccaacagagtcagctaacctggacgcttgtggggctcccagagactgaatcaccaaccaaagagcaagcacaaacaaaagttggcctaggcccctgcacctatagcagattagcagcttggtcttcatgcaggttctccaacaactggagcaggggctgtccctgagactgttgcctacctgtctgcctgtatatcctgcacccctaaatggacagccttgtctggccttagtgggagaggatgtgtgcctagtcctgaaatcctcttgtgtggggctgtgggtgtgtgggtatgagggtatggggaattaagatgggtgtgggggnnnnnnnnnnnnnnnnnnnnaaacaagtcccagttccccctgtatccctttcttttccactaccccctggtaggtggtaggttgaaagggaggttaaatcgtttaagattaggtctgaaaaaaaattaaagttacacctaagtggctcactctcttcctgctgctgatgaatccaggtatagaattctcagctgcctctccagcaccatgtctgcctggaggctgccatgcttccctgtcatgatgacaatggactaaacctctgaactgtaagccagccccaattaaattctttttttttataagagttgttgtggtcacggcatctcttcacaacagtgggaacccccactaagacacaagccaggtcctcagagagctggcagtgatgtgctcccacatatttgggagtggggttagtttccttgggctgctgaactgaaggagcacaaaccggaaaacttatagatgtgtctgatctcttggcactgtgactcgatgttgtcatctacaaagttcatttttgagaaatatgcaacctagttacaaaaaaaattcatgttttaattaagtttgtgattctatgtggagatcttgctggcctggggcacacagagcccagggatgaaggggagaccggcagtcatcatgtgagtaactggggagccactttgcctttgccgatgggccactccaggatgtcctggagtgtaggggaaggtcattgcatggtgtcctcctgccttgacatcatatccatgtttattgtgtttttaatgaaaatgtccctcactgggtcatatatttgatgctttgttcccagttggtagagctgtttggaaaagattaaagtgtgtgaccttgttgggggtatgtccctgagggtgagctttggggtttctgaaggttcatgaaccctcaaagctttctctctgcctcttggttgcagatcaagatgcaagcctccctccaccatcatgtactctaacatctaaaactgagagccaaactaaaggcttctttttataaattgccttgttcatggcattctctcacagagacagaagacaacttctgtctttttataaagacacagaccacactggactaccccatcccacttacacccaattaaatcctcaatgactcctatttccaacaaagtcacatttttaggtagatccacatagtttgaggggacataaactcattacatgactctctaggatagagannnnnnnnnnnnnnnnnnnnccccttcccttcccttcccttcccttcccttcccttcccttcccttcccttcccttcccttcccttcccttcctttcctatcccttgtccttcccctcccttcctttccttccaggatttcgttctgtttttcaggctggctatgtcccaaggctgaccttgcagggatcttcctagcctggctcttttatagaattgtgttgcaacgaacatgattatggctttgaaggctgtgccaaactcacaacacattatctgctttataccgagtcgcagaatctcaaggttgaagaggcccttctaactcccagggtgaaatatcacagccttcttgaggcctaacacatcttgacaatatctctggccttgagcactctggctgctccagcctcttctcgctctgcaggcctgtgtgtcaggaagccaaaagattcttcctgcaatttctcctgaccacatgaaatgcgctgcctgttctcccagaggtcctggattctacacttacacggcagttcacaagcatttgtaactccagtcccaggggccctgacaccctttctggcctctgcaggcaccaggtacaaatgtggtatacaagcaaaacagccatacatataagtaaaatttaaaaagaatgtagaaattattttccaataatgtttcctagtatttatttcttagctgtatccaacaggaaagcagactgctggccacacaggtgacagaggctgaggctgagacctgtggcagagaagaccagccacagggaggaggaggcgtggctcacatgtctggagctatgaaataagaggctggaatcttgggagggaagctggagtttgatggctgctgtggtctaaggcagggaatggatgctcacagcggatccccggctctcccttcccttgagcctgccaatctcaggcagcacttccccgtgatggaattcaaaggaaactctgctctaaagactttctgatggctcatttttattccctgggctctgtgaacagtgtattagcactcaatatactaattagtaactaattgctaattagcaatgaacatgctaattgataactaattagtattagtaacaaatacattattcacaaccaatgatttacaagaagtaatttaaggaaataaaggtttattttgactcacagttttggagattccgtcccccagggtgggaaacaccctgggatggggataggccgtgtgtccacacctcagcaatcaggaggcagagaggaaaccaccagagttacttactttttctttcaccatttctcttcatccctggacccccacctgtgcaatgtgctatccacatctgggacaggtattctcctgtctggaaaggccccacagacacacataaaggcgtgctgaccaacactcttgggttcttcattcaatcaagttgacaatcaaagtcaaccaccacaaacaggtagcgatagtttcatattacccataaggctactgggtacaggaaggttaaatgaccttactaagacaacaggcccagagcagagcagagatagaacctgatagggtatcagggtgccaggttatcgatttcactagctcttcctctgatgttcctaggtagactttgagtgcagaaatggcacagacaactgggcatacaatttgtggtttgaataaaagtgtttcccataggcccttaggggtgggattattaggagatgcggccttgctggagtatgtatggctttattggaagttcctgggggcaggtttcgaggtttcggaatttcaagccaggcctagttgaagtagaaacttaagggttctttggaaagtcagttgtgttggatggagttttgttggggcaaacacgtgaaggagtgttttctgaagtggacagaggtctgaaaggctaagatgatcatgaaggaatgtttccctaaagcacacataggagaaaggatgttctgttaaaacaaacaaaaggacacatgataaaggattctttactaaggacaaacatattttggttgaccttacattgtgtagttgagctccatttgttgggactccacagagagaaacacatcaaaaaacttctggtggtgtgctgtggcttcttgttttcgtggacttgggctgagtgacagtgatgtcagctgagacagatgcatgtgctgaggcgagacccgtggaggacacgtgatgtgtggagagaggataaagagggtgcgacagacaccagggactgaggctgagcttggcttgcttatagagctgcctgtgtaatgtttgttctcaagccctcactgatcttcactttgctgacaaaggcacagccaagaacttctcctcctggtccctcctgttgacttgtgctgagtctgaggcctggctgtctctactaggtagtgccacagctgctgattggtgtttgctatccacactctatcgaactagactgctggtgtatctgtgaagtgtttgagagtggatctagctgatgctgctgacctgtgaactgacaacacagatgggatttgctccaaaaaaacctttctaaacaagtccagttcccctgtatcctttcttttccactacccctggtaggtggtaggttgaaagggaggttaaatcgtttaagattaggtctgaaaaaaaaattaaagttacacctagtggctcactctcttcctgctgctgatgaatccaggtatagaattctcagctgcctctccagcaccatgtctgcctagaggctgccatgcttcctgtcatgatgacaatggactaaacctctgaactgtaagccagccccatcatcatatccatgtttattgtgtttttaatgaaaatgtccctcactgggtcatatatctgatgctttgttcccagttggtagagctgtttggaaaagattaaagtgtgtgaccttgttggggggtatgtccctgagggtgagctttggggtttctgaaggttcatgaaccctcaaagctttctctctgcctcttggttgcagatcaagatgcaagcctccctccaccatcatgtactctaacatctaaaactgagagccaaactaaaggcttctttttataaattgccttgttcatggcattctctcacagagacagaagacaacttctgtctttttataaagacacagaccacactggactaccccatcccacttacacccaattaaatcctcaatgactctgtttccaacaaagtcacatttttaggtagatccacatagtttgaggggacataaactcattacatgactctactaggatagagacagtagttgaagccatgagacgagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagggaccccaagagaagagggactccacaagaaggccaacagagtcagctaacctggacgcttgtggggctcccagagactgaatcaccaaccaaagagcaagcacaaacaaaagttggcctaggcccctgcacctatagcagattagcagcttggtcttcatgcaggttctccaacaactggagcaggggctgtccctgagactgttgcctacctgtctgcctgtatatcctgcacccctaaatggacagccttgtctggccttagtgggagaggatgtgtgcctagtcctgaaatcctcttgtgtggggctgtgggtgtgtgggtatgagggtatggggaattaagatgggtgtggggggagggttgacatccagaggggggcttccctttctaaggtaaatggggggaggacttacttgagggggtactgggagtagaggaagggctgatattggtttgtaaagtgaataaataaatttaattttaaaagttgtcctctgatctccacatacacaccacacaccatcacacacacacacatactagcaatgcataagacaaacaagaagggacatgaggaaacagccacctggcctgaaaaacagaagtcacacacttctgaagcatgaccctgggagaagagtccttggggacctcaagggctgaaacccctattttatgttctctccacactcgttccacagagccacaggaatgagggagctgggtgtcttgctcatttctggatccggtgtggatgcggcacagtgtatgtgtgttaaacttagttgactatggcgttagccagtagtgagtatggcctcagatctatctggttcttctcggctattaaatcctatatggcacattctatcagctacccttttatcaacacagtgggaaatttaattagttcctggtatttttttggtttggtttggttttggtttttagtgacagggtttctctgtatagccctggctgtcctggaactcactctgtagacctcgaactcagaaatctgcctgcctctgcctcccaagtgctaggattaaaggcgtgcgccaccaccgcccggctgttgctggtatttttgtttggtaaatgtctttagggtttgaataactctgataaaatgctatgatcaaaggtaacttgggaaagaaagagtttaaattcaccttacagtttaaaaatctatcacccagggaagtccgggcaggagctgatgtagaggccatggaggagtgctgcttactggcttactcctcatggcttgctcagcctgctttcttattgcacccaggaccatcagcccaggcagggtggcactgcccaagtgagccgggccctcccacatctatcaccaaccaagaaaatgcaccacaggcttgcccaccggccaatacagtggagtcagttttttaattgactttcactcctccaaagttgtgtccagttgacataaaaccagctggtacaataacattcattaaatgagatgtaaactggtattccattaatgaacttacccagaattcgttaggtacctacatggtattaagcgctacacatactgactgtctatagctgcttcccaaagttttggcaaccatcaagtgcgcatttgtctacattctggcccatttaatagatggaagagcagaggaccaggtggcagggcagggaagaatggtggtaagacacaaagagaggagcccacttctccctggcacactttgataaaaatgttaaacttttaccagagatctgctaagttcttaagtcttccttccgatgctcattctgacaaataagcaacagcttttaccagatgaggcaattggatgccatgaccaatattaggctggaacccctgctcaccccctgcacaaggtagggaaaccacgcctgctctccttccccaaccctgcccccacagagacaccttaccgccactcctgtctgcttggagaaaactcctggctaacacatcatcactcctgtctccctgtttccagcatcccaccaagagtgcccacccaggggcttaggttttgaccatgtatggacacaagactagctcctagctggcaggtcatcactccttgcctaaaacctataaaactgccttgctttattctaggagtgggactttgctgacccccacctgtgagattggtgaaccctcctgagagctgccagctaataaacccgtctttatctatttttaatctggtctaatctggcctatatctgtgtcagagagagagagagagagagagagagagagagagagagagagagagagagaatgtctatcaaccaagagcagatcctgctgggctccaccttctgccctggctgtcttacatagactcagatagccagctgactacctcatggcggtaccagccacaggtacttacacacactctacaggaaccttagtaaactatacaactattgcaacccattgcttggctctggaaggtgcaacctgagccagggttgtttcacacagtccatatcagactgctggctgtcacaagccttgttgaactctagaattttgttattcctttctcagatgaaataacttctcgatcatcactctctccctatccttactgacagaaggtatcctcattacctcagtgtactaatctgtaaaatagagagagagaaaaaaagtttcctttgcaggattccttgaaggatcaagacgtaagcgtacggagagcttggtacacaaagggctctttggatatttattgtcattataaaccacaaggcccagtttcctctccccttactgggcgctccgactggcctttgtgccatgctgcactcaggcactccatttttctgcctgtaacaaagagaggaagtgcgaggctattgcttgcctctctagtgggaggttgagcccagctggttctttccccaccgctcccggcacctagaactacaactcccagcgtcgcccgcggcggcagcaaaagatgcgcatgcgttgagcgccgccacgcctggtcttgggcggtagactagagcgggtcttgcttagtagagcgggcacatcttggagctcgcgcctcctgcggcgtcgcggtccctggtgagccgtagagggccagtgccatgatccgacaagaactctccacgtcctaccaggaggtgcggaccggacgggcgcggagggcgggcagggcgccgcgaccccggtgcaggtggatgattggcactccgtggcatgcgggctctgcagcaggtggagcccctgcgtggtcccggcacgcggggataacaagggaccctggagtctggctgtggggaacgcgtgtggccagcagctcctcggcagctcctcgccttccccagaaccccagcagccctttgtctgtcgcccgaacctcccgcttcccttcgcagagccgcgctggctccgggccccttctgttcctctggtgtggggcttccccggctctgccctgcctgggtgtctttccgcgacgccgcatccttagccgtcagccaccactgtccaggtttgctcgaggccgtgcagccgccccatgccgttagaccttgtccaaccggagcagcccaaccttagcttgtctccatgtccgtctccacccacggaggccctggccacactggaaactcacactctccaaacgagttagcagcgtgctgaactcagcgccctggggtcactgatgatcccgggtgaataccaggatgcagacagctcttgcttctgcggagttttggggtactagcttcagaggaccgcagtgtagcagagcttataagataatgtattgaaatacaggctgttgtcctgttcgcagagcagggccacaagtagatagattcaggtgctcactggaatcgtgcctaatggtagaaggcgttaaagaggccccgcctccctttgcgttcttcagatctgtttgaagtcccaagaagactggcttgcatctttcttgcccgggttgttttgagagcggacctaatgaaattaggtatttgctgaggttccgctctagaaaggagctttctgagaagtttggcctgggataggcaaaggcttgtgctggctgctgagtatcaagaaggcgattggagggacggggattgccactatacctgggttcttgggaccactgtccctcttgagttttgttttgttttgttgttgttgttttggttttttttttcttttatgtaaatcatctagggtaaatgtgaaagatctctgagggctgggggtgtctgtagccgagatggttcagtacttgcttagtactaggaggtagaggctgaaggcccagaaattcgaggtcattctccactatagtgagtttgaagccagcctggattacatgagaccctgtctctgagtggagaaaaggtaccttttcatgtgatatcccgatgagcctgggctggacccctgcaaaccacggggttcacctgcctaaaatgatgggacactgatcccggactttgctttctcagcagcaagatttctcccgtctgacaggtcatgtgagaagactgctgagctagattgcggttgcctggtacctggacatctgtcgcccctgctttgccatttgcacccacatctgtgggctttagtgtcccacggagacaccagttttgctgttgtcagttttttttctctgagtggactctaagccacatttcctcttcctctaggaagtggttaggaccgtgggctttggaatgagaccaaggtggcgtgatttctgtttcactaactgactgtggctctgggagatgctgaagggtgactccagtacttgtcctgtttggactcggaactagagtcactttgggttattgcacaatgacaagcgttgggctctgaatcgatcattatgattgtccttaaagatgtaccccaagggggtgcacactgcaggggaccctgtaaaaatggaggcaggggttagacatcaggcacagctaccaatagccctgagaatgccagggtaatcagcagaagctaggagacaggctgggaatacaggtctccctcactgctcatcgagccagccctgctaaatcctttcctgtagtttcccaggaaacttctgtgagagaagacagaggacttggtctcacacatcctgtgtcatgtggcctttgtgcatgtgtgacggttatgtggatggcagcttctgctttttttttttagcctagaaaggcaaggccagtccagctaaactgttcacgccttctccttcagctcagcgaggagttggagcaggtggttgagaactcggagcaggcagacgaacgagacaaggagctggtccaagttcaaggtccaggtgtcgtgccaggtgagtgggtttaggatgctggctgtgtgctgctacggctggaggcccagtctaggcaccttgccagcagagggaggggacatctcctctcctccacacttgtaccctggagttgggtctcaaggtctgcccggttctaaagctctacatatttaatcagcctccagctggaggacgtgccttttcaaggtctgtgttcttgatagtggggttggaaccagttcctgaagccaggccattctttttccccaaggaggtgctggccagcatgtctttaatgccctgatcatgtcccagagccccatgggagaaaacctctcgtcaggcctccccagccctgctgcctggtgggtggctcacctaggctgtttccctgcttcatactctacttaggctcatgcctcagtggtttccttgagctgggtatatgcgtcctacatgtctgtgtgcccatgggtaccacctctgttgtttaattcctgcttctggaattctcaaccccatttttaagacatttctatttgtgtgtctgtgtgtctgggcacatgccccttatgtgaggatgctcacggaaaccgggaggtggcattggagatgtgagcacctgacgtgcatagatactaggagcccaaacttgtatccatgcttattttgtgtgaaagagggaagggtagccattgtggaggtcaggggacagcttgtgggaatcagatctccttccactgtgtggattccaggaattgaactcaggcggtggggcttagcaagtgtctttgcccaccaagacatctttctggttcctgctccttgtgggagctggggtgggcaggtggctaagtgagtgggttagcaagtagacagagcccagcctggttccagctctttggggaagctgaggaggtatgctctgtcttttagttcctctgtcttggggggacaggaagtcctgtgattctgcccactacctacaggagaccttggaagcagtagagcagctagcttctctcccacaactttcctaacaaccatatttcattctcaaaagaaccctgctagttggcgtcttcattttcttttcttttccttattattttttggtttttatttttttttaaagatttatttatttattatatgtaagtacactgtagctgtcttcagatgcaccagaagagggcatcagatctcgttatggatggttgtgagccaccatgtggttgctgggatttgaactccggacctttggaagagcagccgggtgctcttacccactgagccatctcaccagcccctgctagttggcgtcttcattttcttttcttttccttattattttttggattgaatattttctttttttcttttatttatttttgtaaaagatttatttattattatacataagtacactgtagctgacttcagatgcactagaagaaggtatcagatctcattacgggtggttgtgagctaccatgtgcttgctgggaattgaactcaggacctttggaagaacagtcagtgttcttactgctgagccatctctccagcccgcatcttcattttctagacacagactgcagactcagacttggtgaagcatggagacagacctgacccctctagacactctgacccctctctacctactgactggtggctttaaaaaaatatttgtttattctgtatgaaagagggaagggtgggcattgtggaggtcaggggacagcttgtgggagccagatctccttccactgtgtgggttccaggaattgaactcagactatggggctttgcaagtgtctttgcccatgaagccatcttactggtctggtttgtttattatacataagtccattgtgtagctgttttcagatgtaccaggcatcagatctcgttaggggtggctatgagccaccatgtggttgttaggatttgaactcaggacctttggaagaacagtcagtgctcttacccactgagccatctcaccagcccagtctggcttatttttaagttgacccataactgtctgtatttgtgggtttcactgtggtatttcagtacatgtgtacattccctgaggattctatcatggaaatcagtgtataatctcatatgcttatcactttgtgttaaaaaccattaaaaatctcttctggttattttgaaatatgtgacttattgctgctaattggatgtccctgctgtgcagtagtgccttgggacacactgctcctgtctactgtcttaatacccttggctcccctctctcacgctcccctccctgtttctggcatccactggcgaggtcagctgttttagagtccatgtgagtgaatgagctcatgtgatgtctttctgggccagtatcagttcttaggtccagccatgtcacagataaaaagactcaagcttccttttaaagaaggttttatgtagcccaggctggtcttgaactcgctgaggacggcttggaacttgtaatcctaccttcactaagattcggttggaggatagtctgcataaatacggactctctgccctgttgttttctttagagttgatgttgactccaggacacagggagccaacagactgccagtggacttctagattgttatcttgtaattgatctactccaaaccctggtttgcaagatgagagcggcccagtttccccttatttttcagactcttcccagccatttgggatcagcaccaggaggtatcttgcctggtgtggtcattttttaaacttgtgagcttctagacttggtttgccataattgggtctcctgggccactgtggatccatggcactcctatatcttctttttctcactggcctgtctgtctctctcactgtgcaggcaaggctggctggccagcgagcccctcagagagatgccgtctcaacctgcccagctctgggactacaagcatgatgcaccagacatggcttttttacatttacagtcctagggattgagctctcatccttatgccttgaacctaatttaagatgggtcacatccctggctttgtgaataagactgcagtaaatacaggagctgactcttggacgaggtgattttgtcttctctgggtacagtgcactggcatatggctggatcacataatatttctcttctttcttcttgcctggctttgtttgtttgtttgtttgtttgtttgtttgtttttgaggcagactctcctgtatctcagcatggctttgctatgaaggggaagatggctctcatgatggagcaagcaccagcatatctccagcctctgcttttcttattttgatgtagatatttgctgttgggaaccccctttttgaagctgggttacactgtgccgtccaggctggctttgaggtctcgtgaccattgactttctggttgcttgggttgcagaactgggccaccacacttgactgtgcaccgactttattcctcccatcagaaacctgcagaggagttgagcttgcttcccaggactcatgttgggcaacttacagtcccctgtaactctaactctgggggacccaacaccctcttctggcccttggggggcaccttccccaccaggtatggcacgcatccacaaaaataagtcttaggtcttggaaattgtgatgcagtaatgtagcattctgaatttaatgtgagcttacccctcccagagagtcaccctgtgtgcatcactcctgtgtctctggctaaaacaattccaactgtttcttattaggccaggacaatgatgaagaatcctccagctttgtttgacatggaaggatttttttttttaattttctttatttctgagaagctgtgtcactgagggtgatgtccttggctgggcacttcctctagcattctgaattcacctcctattctgtccctttctggccttccaagtgtctgcctgtctgtccatccatccatctgcctgcctgtctttttgtctttttggttttaaattcttctctccctctcccctcgtctttctcttctccctctcttctttttgtctatccatccctccattcttttatccatctatccctttttttttctgagatatgatctccctgtagccaggttggccttgaacttgtactccctacctcagcctccccagtgctgggatggcaggttagaccttccacttctgcctccaggtctctctctctctgcctctgggcagcttgcctaagttttcttgagagaggaagctctttgaggtaaatagaatgtgagtgcctgtccagaccttactcagtggcttttagctgtcctttaatggtctctgggccttcctccatgtcctcctccgtaatttccaccgtgcagatcttttctcggcggctttccttagatgctacaagcgttctttgcggttctctcctcaccattgacaactggcttatttcaataaacctgacttcaggtctggagctcactctgctcggtgtagcctgtttgtttgcactgctgcctctattcatagttttcattcattggcatcttcatctcttacaccttcccttctgcaccctggctgttctctgagtccccagctgtcctggcctctgttacatagctctagctgtcctgggactcgctctgtacaccaggcaggcctcaaactcacagagatcacagagatagcgatccccctgcctctgcctcccgagtgctggcattaaaggcgtgcgccaccaccgcccggccatctttcatttcttaataactgagtctgtcctttagaaccggtgctcctctggtttcactgaggaactgcctgtctgcttcctctcactgtgcttccttgattgttacttggaattccttctcctgcatttctgctaagttcctggagagttactgtgtcttttttagtgtcatttccttgctgcttgtgcctcacgtgacgttccatggagttccatacatgaatgtaaaatgccagtaaaaacctacttctgcctgccctctgcccttctagcctgttactggccaccggtgtactctcaagctgacttggatccaggggtgaactaatccagcctatgaatggcgccacccaatctccatcttttctcctcagtcagacctccctggaaatgacctcagcgtccgaagtttgtttcttaggtgattgtaaatgtagtcaggttgtaatgcagactctgatcctgggcaggggagatggtggcttagcggctaaggagcctgcagacctgagagtattcctcagctgttggatgggctgtctgtgacatcaagggctagccatgggtgtttgacctctgttgaactgtggtctggctgagctgtccatagtgagggtgtgtgttggggctgtgatcattctgggcccacttccccgtcgtgtggcggggttttgttttgtggaattgatacgaggtaaacagagacctgtatctcctgagtgaattgatctctgggtcattgtgtggcgaccttctctgtcctacagttcttgtcttgacgtctctgttgtcctgcagatatggctactcttcataatttccctgattcaggtttctgtttgcttagaatgtccttttccaatcttttacgttaagcctgtatgtctttgtgaagtcaagtttcttctaggcgatgtgtatatttaaaaggtttaaaaaaaaagatttatttatttattaatgtatgtgggtacactgtagctatcttcagacacaccagaagagggcatcaggtccccattacaaatggttgtgagctaccatgtggttgctgggatttgaactcaggacctccggaagaacagttggtgctattaactgctgagccatctctccagccccctatttaaaagttttcaaggtttatttatgtgagtgaacatctaccatgggagtcatgggagtgcctgagaattaggtggttgtgcatcaccatgtaggtgctgggaatcaaaccagtgccacaggagctcttaaccgctgagccctctctctagccccagcagtgagtgcctgtatcccctccctctctgcatccacctgttccttctggttttgtcccatttagatccctgtacaggccaacgacttgttcccagcatcctgcggggttcttcctgctgttcccagcatcctttgctgtctctgtgctttgctgcctgtggtttagtggcttctcactgtgtaggtgaagttggtagctttggagttcctgctcttccagtgggacttacctccctcatagctgtttggctttatgctggtgaatcttgattgttgattggctttgagaagggacagcaccagtgtagtacactccttctgggtatcgtgaccgtgacgtgattctctaaagaggaacgagggaggaggaaccaccctggatgtagctgtcagtagcccagatggagcagagagggagggaagccacagcaccctctctgcttcctgatcctgtgaggtgagctgctctgctctgtggagttccccctacacacaggagagtgcagcctctgagatgcctgagccagataatcctcctgcatatcatttccctagatgatgctgtcacagtgacacaaaggccgacagagttgcctagaacttctgtaaggccagactgtgggcatggatgccttcagtggtttgtcttagaagacccatacgttctcaaaagatagaccgcattgctgggtataatattcttggttgtagggtttccactgagggatctgctggtggtttaatgggatacctttagtggcactttccacttccgtggttcagattttatagctttgtttgtacttttggcaatatcactataatgtgccatggtgtagatctctcctggccatgtctgcactgtgacatctatggtgtagatctctcctggccatgtctgcactgtgacatgctgtggtgtagatctgtcctagtgagatctgtttgggctccaaaagcctccatacatcagtgtatacatctttccaaagattaggacagttttctctctctctctctctctctctctctgtcctgctcttctcttctcttttcttttcttttcttttcttttcttttcttttcttttcttttcttttcttttcccttcttttctctttctttctttctttctttctttctttctttctttctttctttctttctttctttctttctttctttctttctttctttctttttttccttttgagacagggtttctctgtgtagtcctggctgtcctagaactcactctgtagaccaggctggcctcgaactcagaaattcacttgcctctgcctcccagacagttttctttcttgtttctctctcttagtgttttcacctagccatcaaagtattccaaaaaaacattaagatgagcaagccctgtgcctttcctgctagtcctctcgctgagcccccgtgtttcttgttcacatcctgccttggttttctacttcactgaactctgtaataacatttcaaatcctttaccaggcatttatctatgcgagtttctttgggacctcttgctaataggcacatccttttggaagcatcgtgcaaccttgagttctcatctctttgtaccagttaagatttatgcacggtggaccagatatttctaccatttacctgatagcctccataataattggccttctcttgaaagtacatctcagttagtgggtttgttgtgtgatgccagctccagttgcagctgggtagtgcagtacccgcccatagcttccttcgtttgttctggtgagtttagggcacagagaggaagggagcagagaaggcctggccaatctgaacctacggcaccagaattttgagagaaattaatttgttctttggactgaaagactagatttacagtgcacaggttgagagcttgagctgatatggatttggggtctcctaactacttgagagcctggatgcttgcagctgcctaagtctcacttggaaagagaatgatgattttggtggcacagggtctttagagagtattgtagcaagcaagcaagcactcactgggggcagcagtgttggtgagaactgaaggttcttttttccatcctatttgacagttagagtggcagagatgggggctgcagagccacagctgtaactagaaaagatatgtcttggagatgacacggagagggggaggaccagcagtctggggcagacacatgacctcgccatgtctatccagtgatacagcttatctgatcattggtctctgtggatgcttggtgttcgagagcatgtcatattctctcttccctcttttttaaatgtttattgtgtgtgtgcacgtgtgtgtgtgtgtgcatgtgtgtgtgtgtgtgtgtgtgtatgcgcatgcctggtgcctatggtggtcagaagagggtgttgaattccctggaactggagctagagaggcttgtcagccacgatgtgggtgctgggaattgaacctggtcctctgtaagagcagccagtgctcttgtctgctaaaccctctctgcagccccacatgtcaagtaaattttttttagatttatttatgtatatgactgttctatgtgcatgtatgcctgcatgacagaagagggcataagatcccattacaggtggttctgagccaccatgtggttgctgggaattgaactcaggacctctggaagagcagtcagtgctcttaactgctgagccatctctctagcccccatgtctagtagtttttgatggaacactggtgtattaggcatgttcttctaagtgaacagaacgaatacactgcatgtgtatatgtgtgtcttgtgtgtgtacacatcaaagagcctttgttagactggcttacctgacaaagtctagcagtggctgtctgtatgtgggagaggcagagacccagtgcctgccccctcccccttcccctccgcagtgacagacctggaagctttctggagagcggctggtgttctgcctggaaagctggagttaggtgttagcagaggttggcagtacacactcagaaagcagccaagcagaaatgctgcctttcctcggcacaggtacagctcatattgacagcagatcctccctctggaaagtctcagaggtttgtgccccctagtcagatgggaggagaccaccgtcacagccaacgccgattggcacagtatgggctctggaccctctgaggtcttctgaagtgcgttttgtcttggcaggtaggcagcatggcaaggctgaagttctgaggtcctgcctgcctcacagtggcagccagagttacccatttgccctcgtactccagccggcgatcccagcatacccggtatttgcaaaatcagtgacctctcccctctgcggctcgactactttcaggatttctccttcaccttcagccctgaactctctctctctctctgaactacatcatttaggggttggtatgaaccctcaggcaaaaagttagacatctgtgctgttctttccagaggtagattccctgtactgtgttagcccgttctttaacgccttcattacatttcagatacgttgttcagatcttatgggctgtcaactgaggctggtgtgaccacgctgcttggtccctgttggaagccacagccatctgggctttccctcagggcaccgtggtcggagctggggcgcagaagcaccttggaaaggtgaacccagcttgctgtaaccaccctcatgttgggtggctctcaacaggaaaccccctacacacactcctagcaccatgtgtctacccacagtcaagtgccgcagagatgttctctaatgaaagctcccttctgcttagaaaaagccgccttcccactgcccttacagcctgggctctgcactgtgttctggtgccatgtccgctaatgccccgtcctaaggaactcatttacattaacccatcctcagccccaggtcaaactcatcgcctcattgtggggtaatgcagatcttacctttctccttcctgtgacaaaaatactcggcaggaagctacctacggaaggagggaggggcttgttgtggctctcggtttgacaggacacagtccgtcatacaagatgcagcttcaggaacagaccattgctggtcatatggactctgcatcaggtgcagagggtgccaagtcgggtgcttagcaaggagacccccagtcatgttagccatcaagggacggtctccttgggaaaaggcttaagaaacggggcagagtgggctatgagcagttcttcaggacaggcctagggatggcagacgggagcagctctgggattgaaggatgagaacgttgttgagtagggggaggggagcacatggccctgactgattgagatgtcatgttggtggccttggctgggagagatgaagttgatgtttctaggtgcccttggtgatgagggtcggcctcacctcctccacaaggtaggtgagggcctggcactgctctggtgaccctggtgtcctgtcagcaggcgtggacaacgagtccgcctccagcagcatccgcttcagcaaggcttgcctgaagaatgtcttctcggtcctgctcatcctcatctacctgctgctcatggcggtggccgtcttcctggtctaccagaccatcacggacttccgggaaaagctcaagcaccctgtcatgtccgtgtcttacaaggaggtggatcgctacgacgctccaggtagggcctgctgggccaggcatctgcgctccagctttggggtttctgtcagcaggcactgccttgcctccctgagccaacactgtcagcacaggcagagtggagccgggcagttgttgtaggcaggcatccgagagcctgtgccaggccctggtgccctggagtcctggagccctggggccctggagccctggagccctggagccctggagccctggggccctggggccctggagccctggggccctggggccctggagccctggggccctggagccctggagccctgggtgggtgttggagactggctttcttaggcatgaggtcaacacaagggtttatgggaggggcaaagctggacgccaggaatgaagggcagcatgttagtctcttttcttttgcagtggcaaagcactgtgagcaaggcgacttttttttttttttttttttttttttttagattacatgtaagtacactgtcattgtcttcagacaccccagaagagggcatgagatctcattacgggtggttgtggttgctgggatttgaactcaggaccttccgaagagagcagtcagtgctgagccttacggcttataaaaggaagctttcgattggttcgtagtttcagagggggtagagaccaagatggtggagcaaaggcttgctggcaggaagggctggaatggagagtgggaagcagagagcacacggaggaggcggcggaggacaccagcctcctgaatcctcaagcctgcccctccagtgacatacttcctccaacgaggccacacttcttaatccttcccaaacagttccaccaactgggggctgagtgtatgacacatgaacctagggggctgttgtagttcagagtgcctcaggcagtgagagtcaaggctggagtatggtgcaggaaggtgatgggatgtagaagccagtgaacagccatctaggcagagcctagcctagaggggctccaggctgctctgtgtacctgcctccacatgttgggaacgactgatccttattgtctgccagagtgggtgatctggctggcactgtaagttggcactggagaaggaatgtggctcaggcttgcccactgtgagtgtgccacccactttgaccctgagtgacacccaggacatcctgtgcacaggctggagagggagttgggagtttccctgcaggagctcccagctcaccctacagccaggcccgattctttctttcctccctggctttgctgtgtctgcttctggctctttgtgggcttttcttgcggtgtcctctctcctccctcagctctgcctccattgcctatactatcaccagtatctcctgggagcccaagccgagagcacacagaaccctctatgtgctgtgtgatcccagatctcctagcagaggagagaaaaggagtcctggggagatccacagcctagagcctctgcagcaccaggcgggcaggcctgggaggcaccggcgtgctgtgaggggaggtgctcgggtgggagtattatgagccctggaagccacgttccaggcagggtgtggagtgactgaggtggtgagtgccctccactggagtaggactctgccttgccacccccacccccagttttggctgccgccctagtactttcccaaggaggttggggtgcgattctgttgggtgctcaggactgtgactgctgacacttgccaatttctgtttgttccagggattgccttttaccctggtcaggctcagctgctcagctgtaagcaccactatgaggttattccacctcttgccagccctggccagccgggagacaggaactgcaccactcagaggatcaattacacccaccccttcttcaaccacaccatggtaatgcctgcttccctgggttctggtagccacacaccctgaggactccagcctttcttccctgtagcctgtcggcaggggcccttggtccccggcagatgagaagggtggtgtgtgtgttactggggcttcatgccctgagatgggagggtagcaggactgaaggtagtctgcctgctgcttgtttccaggaactgcctaggaagccatactttgagaaattttgccaatgtgaagatggtgtgctggtgtggtggtgaagattgctgacagcccacaccacacagcacagctcagctggcaaaccgtgcacagtgtataagggtcctgggcagggagatggctttgtattgttatgtcatgacttcttcctcctttaggagggactgaaggggccatatgcgagctccccatcaacgcagaaacttcctatgcacaagacattgccgactatggtggtttgagtgagaatggcccccattttgaatgcttggttcccagttagaggaaccaattgagaaggattaggacgcgtggccttgttggaggatgtgtgccatgggggtagtctttgaggtttcaaatcccttgctaggcccagttgtatgttttctctctctctctccccccacccccactgcctgtggataagtatataagccttcagctatttctccagcaccatgtcttcctgcctgtgtgataatggactaaccctccaaatctgtaagctagtcccaatgaaatgctttcttttattgccgtgatcatgatgtcccttcacagcaacaaaacagagacaatgatcgtggtgacagagacaaccaacactgtagctgtgcctctgggcaaggtggaggtggtggtggcttagaaggtcttgaaagagaatctgagctgtgtctagggacagaagcaaaggacagtgcgtgtgtcctgctatgggcagtcttgcccaccataagtaaaagaaggaacaatgccaggccctggttgatcttcttcagacctctcaaagcccgatgaagtggtttctactccttgcaaaacaggatagggtagggcatgaggacagccctgtgtaccgagaaaggctgcacaggtagaccagaaggccggaagagctagtcagagtagcaaatgctggcttctagcccccagctcagggggactgagtttggaacaggtctgactgatgtgactcaaggattttgtccctcctggttgcagagctgttgggcaaggtgcttccctggatgccaggccccagagcggtctctgtacaggctgagggaagacccactgctcaagcatggagacaggcctggggttagatcatcagtgctgcaagaatgtcctctgttgattggcgtgcttcctggtctgccagcaggcaagggagagcgttaggcaagcagatgtaagctagcagatgtaagcaccgggggagatgtcccactttgggccactactcggtcagtatctgaaccctttattcctaactgagaatgggcagttggtggccaccagacgtttccatgaactcaagttgaagtaaaaggacttggaatgaaacagcagcatccagtcaggaagatgggctcccggctttcgttattccctatgagaagcacagtggcaccagggcgcagctgtgcccgttctgggaacctcttcccctgttgattggcgtgcgtcctgggatcccgctgcccacacccaacacttttattgctgtatacttcatagctcaaatgtaagtttaagagagagaagaggcacagaaggaagagtgtgctcatgggaaggaagatggatgcattcactaccccagcctgagggatggttcatcttctttgtcagctccttccagccacacgcgatgacctccaataaattctcatgtcccctttcaactgcttcctgggcaaaaatcggcatgtgatgatgtatcgagactgtcgtgggagtgtgcatgcacccaagtatcccgggcacgaggaccttgctcaagcccaggagttcagcctgagcgtcacagtgagactccatctcagagaaaggaacaagagtacgattcaggggctggagagatggctcagcggttaagagcactgactgtgcttctgaaggtcctgagttcaaatcccagcaaccacatggtggctcacagccatctgtaatgagatctgacgacctctcctggtgtttctgaagacagctacagtgtacttagatataataataaatagatcaataaaaaaaaaagagtaagattgaggcaccagagtgtccatgaggcagggatggctggagtgttcacagctgcttacaacccctggtgatgtccacacagggtccgcatgtccgttgtaatgtgcaggcagtcctccctgctgctttctgagaaacgccaatgattgccttggcctcaccacaggttgatctgcattgctggaagccttgagagccacatccgactggacttaggaagctgccctccttggggtctgcaccagcctctttgcagtcagcttccagcttgagtcgtctggggactggggctgaggtggcctgttctcaccctgcctttcccaccacccttctgcagtgagctgttaatgtgcaggctttggctggctgagtcctgagacagcgacccccattgagggtcttgttgtgtcacatggcataagtcttcaggcttttgttgccttcctggtttcttgtgctttggatttcatgtggcttgcctgtagccagtgattttcttttgtacagccagggctgccacctttccagtctgtttcctcattgctgggttctctaccacccacaggtgaagctcacgctatctctggggcttctctagctcctgaaatactcatctgacagagtgtgacaccgcgttcaggcttagctcctgtatgtcaacacccttcctgagggacccccctcgaggccaaggcagcttctgagagtggcctgactggcaggccgacaggcaagctcacacgggcaccgctgcttcatgggactgcccagcagcactgtttcttgtgctgtccacacggtcatggtcagcttctgagcacatgcctgctccctgggaggtgaggggtagcgaggaaatattctcacgttactccatcaggtcggctccgtctcagtcaaacgtcctgacgtatttagttgagcggtacaagctagtttgaaagcacattcagaagagaggagagcacataccgcaacaactaggctgttggatgaataatgtgggagggactggcccaggccggagttaccttacagaacaggtaaagtagtcctggctcagggacagaccagtgcattcatgggctgcattcaggccaggaccagtgtagggtgccgaaagacagggttgagagctggttagctatgatgccacattcaaaactaaagccaggcgtatgcagtatgtacatgaagatttaaaatcacaacggggtgagggagagatggctcagcgggttaagagcacagactgctcttccagaggtcctgagttcaattcccagcaacgacatggtggctcacaaccatctgtaatgggatcagatgcccttttctggtgtgtctgaagacagctacagtatacttatatacttaaaataaatctttaaaaaaaaaaaaaaccctttaaaatcttgaaaggggcatacttgggagtgctgagttattgacataccttagcaaggaggcatccgagacagatggatggacagacttcattcactttcctaacttggaaacccccatgtaatagacatcgggacaaagttaactgggacacccctacccaggaaaggtgttccatagtgtgcacagcccgtgaagagagcatgtgtcacatgcagctgggctctgggttgcggtgctgagatgtctccgggaccagcttgcatccctgggcaggagggcagcagttcctggaggctgctggtggcctgctgtgtttgcctggcagggcttatggctgaagtctctgtgggcctgtgtgagggtcggggcagctccgagcgaacactaaggctccggcttttgtctccctgcagcagtcagccctgattgtccaggggccccaggaagtgaagaagcgagagctggtgttcctccagtttcgcctgaaccagagcaatgaggacttcagtgccatagactacctcctcttctcttctttccgggagttcatgcaaaggtggctgttcagagttcaggggtctcactgtctcctgccttgtgcgtgtccatgctggaaatgtgggggtgaaggtagagagggggagcagagttggcccagaacaggagctaccctaaggacctggtggcccatcacactgtctgcagtcaagcaaacatggatgtagtattgcttgctgtctgcgtgcatgctgtcctggagagggttcttggttagcctgggctgctgaggagctgagggaactgccctccctgtggtccgtgagccttcttgcctgcagagtactacctgcagacagttcctgttggtttcaaacactggggaacattgcagtgccatctccagggcctaaaacactgggtctggccctgcctggccctgccgagcttcaggcttcacttttatgatgtaggaagatacattacagtgacagtgaggtgacagtccccctgaacagcaagtcacacactgcctctgccgtccttccaccccagacctcctagcaagcaccttccctgcttatggcccatctgtcttgtctcccttctgggagccctgtcaccctgagctgctttagtgagaggcctcagtcaggcactgttgcttttgcctttattcttcaactggttcaccagtgtataatgcactttgttcattttctctctcaacctcccctcgttcccactgggccccactgaaaccctcatttttcacaatgaatccctacctaccttcctgtctttccctgtgttaactacagtttaattagagttgtctacatgtggctaccctactgaaggaaatgatagcttctctcccagcaaccagtcactaactgctgatgatcccagaatgcagtgtcagcaggcccagtcctgggcagacatgcagtaaggtcaatggccgccatgttccgagatgtcttattgtatatgtccttatcttctggctcttatattcctcctgttctctcttcttcagtgttccaagttccctgatccttcaggtggggtgtgttacatctgtcccttttgggggccagcaagccctatttttgaggactggtattactccgtagcccaggctgtcctagaactcataatcctcctgcctcagcctcccaatggctgggctgacaagcatgcaccactctgcctggctctacactgcagtctgtgcttgctcactcgggctttgcttctgctgtgcatacagcgcccattgctgggcctttcagagggaggctgaggtcactgaggagtgcagcgagccatacttgagggagctccaggagacctagggggtgtggatgactgagatggtgagagggatgctgtggaaaggggaggagtgtgccacagtggaggtggggttgggggcaggaatcatgctgtggccctcctacgggtggagctgtttggaaactaaatggcggttacaggtggtccaggcgctgcttttgatgccaactaacctggtaaagcagccagatcggagggagaccggtatagacttcttttctgtagcagaaaagaaaccagcttgagactggactggagtttgctttggccacattgggctcctgctgtcaggcaggcccggattaacctggacctcccttctctctcttcgccaagcccggacaaggcgggcttcatgcaggcctgtgagagtgcttactccagttggaagttctccggaggcttccgcacctgggtcaagatgtcactggtgaagaccaaagaagaggacgggcgagaagctgttgagttccgtcaagaggtagtggctgtgttttgttttctcggcacatgtgatgatctccacacttaaattgggatggagggagacttttgagtggaacgggcttttgggtggggacccgggaggagaacccgtgtgaaggtgtctcatgctggaagcagtctacagcagcctgcctgttttccacagcaccatttctgtgctgtgtagaggtgggaaacatttcctaatgctgccagggattgttgcagatgaggggagaccaggcacagtgaggggtgtgaggacctgctaggatgcaggagatgatgagctagtctgaaagcttttggttcttgaccgggagccaggagaatgctgggtgttgaggcaggaggattgcttgttttttttttttttttaagatttatttattattgtctctaagtacactgtagctgtcttcagatgcaccagaagagggtgtcagatctcattacggatggttatgagccaccatgtggttgctgggatttgaactcaggaccttcggaagagcagtcgctgctcttaaccactggagtcatctctccagcccctgcttggggatttttaactgttgtctgggaagagccgaggaagacagaacaggcatgctgtgggggatgtagagggatctggcttgcttccttgggagccctgcttcaccacaagcagacccctggaggttccagtgaagccgcaaaaagccaggctctccttgtgcacatggagccctggcacctaggtctagtcaagagagaagatttttcccgctttagggagcgacaacccttgaaagcaagactacaagatgttattgtaaggtgactgccagccccacaaaggctggaggtgtccctgaccacctactcaggggcagccctgcaacagatctcggcatcgtcttcctgtggccagtgtcacatgtcaggtcacaggtggccctgtgcctctggagcccatctcccctccactgtgcagcacagcttctattatagatcatcggctgatcacttgtgccgatcacgtgtacctactaagtacttacagagccctaatatggactggggggctacactttgtcccctatagactcgaaggcttagactacttggctcttaaataatttgtcctctgaagtggactgaatatggcttgagtgtagacatctgagagcagattttggtgacagttcaaagcactatcaggcattgtgatctcttctctcccaaagaccgaggcagctgcagtaaagccctggctcctggaccatttaaaaggtcttgtatgtgagtcttgtcttttccctccccaaaggatgctgttaggagagccaagggctagtagtcctgcctgctctcacttccctgggtccaggcaagggagggcccagaagtggttaaaaaaaaaaaaaaaaaaaaaaaaaaaaaagtggtaactgcctgttctgcacctagaccagcgtggttaactatattgaccagagacccgcagccgagaggagtgctcagttgttctttgtggtcttcgaatggaaagatcccttcatccagaaggtccaggacgtaagtactgctaaaagtggttttcctctatcatcacaagatgtcccagggtgatcgttgcaacaggcaagagattccaaagctcaaacatgggcccttcgggtcccaggatggagtctgagacagacatattttgctgtcactcctgaccctcaagtttggcccaggctttgtgtgaggggtgaaggcttgaggcttacgaagatgaaaagggtgagaggagccagtttgtagctgtgcactgattttcttgaacctgatctacctgttatataagaggcttctgggccaagtagagcctttgaagtcccttgaatcatgcaggctgaggtgtgcctactgtacatatgtaaacaacacggggtcatccatctcaggccaccccacttatcctggcttacaagtggattttcttttttctttttcttttctctttctccctccttcactcccctcccccctttcttttctctcttctcttctcttctcttctcttatcttctcttctcttctctttcctctcccctcccctcccctcccctcccctctcttctcttttcttttctttcacacaggggagtttgaaaatgtaagaaccctgcctgagtttggagagggggtagactgtgtggaagagcacttatctagcatgcacaaggcctgcagtccatctattagcactgcagagagataacagggtatttaatgggggccaagctatttctttacatcatacccgacagtgaacagctgtcacagggctctgggggataaacaactttgttgaaggaaaaagggttttggccgagtggatagagagagtgctgagtcggattaagtccggataggagaacatcccagagcaggaaagaaggaaggtgcgttggcctggtggcagagtccccaggatgagtgtgaggggacagctgaaggctgaggtagctgagatcagacagagggaccaaccttgaggctgaggtatagtttagggaaatttctttgggtcacttgttagattaagcacagtatgaatgtcttatttacacaaagatttttgaggcggaatccttttacgtggaggggctcacagttcccttctgagcagtggtagggcagaagcagcatgcgtctctgttggctccaaagtctgagacagacagagtcaaggctgccgccaaccagcaatcccggtcttgtctgccccacagataatcacagccaatccttggaacaccatcgccctgctctgcggggctttcctggcgttgtttaaagcagcagagtttgccaaactaagcgtgaaatggatgatcaaaatcaggaaacgataccttaaacggagaggccaggcgacaaaccacataagctgaagcgcccgtgccacggcactccgacagagcgagacaccagcaatcctgaactcacttgaagggaccctgcagggaaggacagtcccgtccatcgcactggaggctcaaacccggcccgggagggaaacgcccagtgaataacctgaaacttatttaagtacttaaattattaacggacatcttgcagagctgcctagtgccttggagaggttcctcctatttggtcactaaatagttaaggcttcttctttcccttagggctttttttctttaaagcggactgatgtgccctgtacgcagaattccttttagaccatctactgttacttaacaagaacttgttagagcctagatttgacttttttgtttttccttaaatgtagccccgctgtaatcactgtgtagaccaggccttcctcgtgccttcccattgctgagactaagagcctacatcactccccgcaagctttacacgagaccttaaaggctactagaaacttgtgattgtatttctgatgtgctagaagtgctagcagaggtatatacagtaggcacctacttagtgtatcttgatttcattaacaggtaaataaggttgggcaagcacaaaagggatgggagtgaatacccagtaagccagcgggcagcaacgctggacgctgatgctgtatggccagcaaacccagaaggtagtgtaagtctggaccgcagcataatggctctgactcagcacacatcactgccaacagggaggtaagctgtgcactgtccacaggtggccaagagggatggccacaccacatgagctagtccctgcgtcctacagaaacacacacctaaaagggtggcctttagggctttgataaacagcacctctacataaaaccaaaaactctataatagagttccacatgtggccagaggtaacattgaagaacttgtaattatgccttagggaatcggaagggaaatactcacaggtataaggaggacatttttgtctctaaattagcagcaagaaactgttttgcccaaatccctagaaataaacttgtactgtgaaatattcctgctacctttgtctcacatatatacaagaatttagatttttagcctaaaacttttattataaaacaccattttagcacaaatgccaagcataaagcatcagtgacattaaaaataagtgaaggacagaaagtcgaggggcaggggtgcagtccagtcacaggatgtgtgcttaccacgcagggcccttaaagttcacagttgcatagcacttcagtagttaaatatctgcctcagtgaacactaaagctttattttcctgtattgtgaaagctgagctgcttttaattttgctttagataactaggaagtaatttttgcctattcatagaataaaaacccgacttccactttctggaaaggcaaccctgtgttttgttttgtttttttttaagatttatttatttattatatgtaagtacactgtagctatcttcagacactccagaagagggcatcagatcttgttacagatggttgtgagccaccatgtggttgctgggatttgaactcctgaccttcggaagagcagtcgggtactcttacccactgagccatctcaccagcccgcaaccctgtgttttgtgtgggtcgcccagggctattctgcagaggcctaaagggagcagcctcattggactgcaacaatggccctccctgggatgcccactgcttgaaaagagagcaaaaattacaggccactgtattacaagggagtttgtccagaggtcatggaggctgctgtcacagcaacaaaaaacccctgtgacccttctaaactggtgtttagttgaaaccatgttacagtctccctgcctttcccagaactgctactgccatggattctgagatttcccgttttagttaaaactagctttaatgttaaactgtcctagaacacggagggacaagaagcttgggattttatgaaaagatcggttagatggctagactcctaatccctggaccacaagcaacctaattctaattagagtacatccgtaagttataattctctaatataaatatcttccagagacaaaagagcaaatgacataaggcaaaatacaaacatagactttattaaatgctgctcaatcctcagtaaagatctctcattataaaacagttttccatacaactgcatggcaagaggctggaatggtactggtaacaacagtgtgaaaaatacctgaccaggtaaaaacagacaaagcttctacatagtcagctctgaggacacctgctgcagttcctttaaataaagccaggcagtgacagctagcagtctgcatcacactgtgggagggacccagagctccaccctgcaggcaggcaggcctggggactggcagggtgaggactgggaaggccctgcctccagccttggaggagaggaatgaaggaggtgagcctcgggtccacccgtggcctgtgctgctccgcacacgctccggggagccgctgctgaaggggggatttgggaacatcagaattttggtttacttcccccccccaactttaatactttgtgcttcagaagcctggaaatgtcagatgttgtaaaacccagagtatggcagtgtctttaatgaggctgggctcttgtcccctgcccacacctctctaggagaggtgagggaagggcaacccctccgcttatcttacgaggctctttcctcagatgtactcaaggtgtgcagcaccaaggtgtgcagcacggtgaaaacacatgataaaggaagtgtgcagaggacggcttcatctgtgtgtgcagcacaaccgggctcaagtcgcaacacacgcttgccactcccacgatcacctcactcaacagagacagtgacacaatccatgattagacagagtttacaatatactgtggccgtgatacagcacagggctatgttttagtccataattctttcgcttttacgcttgccaggaaaaactggcctcctaattatattatactgatgaggtctgctctgaagtttttatatattcaaaaaaaaaaaaaaaaagtgtacaaaacgaccgcccagcagggggagctgatctttatttggcactggtactgctgcgaatactgtgcatgttgtaagcattgttctgtttctctagagccttcttcagctgcagctcctctagttttttccacaactcttcccgttccagttctttcttcttctctctgtagagagatcagcagttttaatgggaagctcaggaaagacactggttggtggctttgtggggagcgagcattacaatgcccgtggcttctgtgacacgcgtggtattacatggcactaattcaccgtagtcactcgaggcctctaggtcagctacagttaacactcaggcctcctagggagaggtagaagccccacccttccataccagcagaaaggcaatctacccacccgtcagtttatgttcaaactgagtgagctttaaaactagataagtaaagaaagtacaggctgtaaaggagggcttttatttctaggtcttggttcccacacacctctcctgcctgttgctttgtggacttggatcctggttctaatttctacctgaaccttgtgaggtttttgtttgtgtcttcctggccttaaaatcacagagctctgactcgcttcctgacagtgtgctgacttcagataccactctctgatgatccacagcaccaggactatcaagctctcgggaaaaatcttatgtctcagctgagatcaggacgaacacgatccgcacttaaaccacagtctaactgttagaggaggaaagtcttaacaaatttataaaaataccgggattactttcctggacaatggctgtagtgctcagaggcttccaaatgataatgcctaacatattcaccatagatccaccgactaagagatggacctttctgaactgaagaacacagaattttcaaaactcatcaagtacctctgtctttcggctttgtaggaactagtaaggtcgtcaaaaagcttgccgttcatctccatgagggttttcagcacattgtacaccagtgctacaatagtcctgaaagaaagagaagacagttctgggttagaggccagcaacactgaatgcataattaatgccagatgctagaactaaagtggaaacagtctagtctcacaggccagagattctaatgtttaccctcttcctatgtagatacaatattctggttctcttcatgtgagttttgtagtctcatcctagaccctgggtagcaagataaaaatgtcacagaagtcggaatgtctgaatgccatgtctccctttggtcctcagttcctagcttggggaggccggatacagctggctcagccgatggcactggaccgcaagctggttagaccatttgctgaggagcatccatagacagctttataaggataagcagtatctacaactatgacactcaccttcagtataggttacagatctgtccaggcttcaactagcaaagtaaagacacgtgaagtacacgcctgtgatctcagcgctgaggctgagccaagagttcaaggctagcctgtgctactgagactgtatgttaaatggaacccaacaacaacagaaacttactgattccagtgttctttggaaattttatacaagctggcaaacatgattggcaggattttatcaatattctcttcaatcaaactaagaatatattcattattccagaagtacagtgctctttctgcaacctaaaaagacaccagaaacctcaaaatccgcaggaaaaaggatggcacaacaacagaatgtcacagagaaaggaagctggtacctggaaatgagagctggagacgcacttggatatctgcttaaaaagcggctcttcaatttttttgaattgtgttggttcaatgacatctaagatctcttcaatttctcctaaaaacatcacctaggtttaaaaaaaattttttttccttttaaaaaatttacaaatgatgctaatgtagacaaggcaaatcggtacattaggaaatgggtacagttcacagagcaggtcaagattgcagtcctaatgtaaatacatttatttttattattattaaaacccacctctttctgactgcatgtttttggccaaaatttcagcagtcctctgatcacctacaaaaaccagcaaagtttagaatgaattcaacaactgggtgtgtggtacacgtctacaatcctagcacttggaggtacccaggcaggagaattccaagttctagaccagcctgggatacagccagaccttaccacttctactagctagactatcccaagatatttcactcatcctgacgtcaagcatttagcactcagtacatgaaaatccctacttagctgtggacttgaacctgggccgtgccagacactgctctaggtactacacggctgggcaaagtctgtggtcttcatggaacgggaccaacgtgagtggacacttaaagaacaagaaaatgatgtctggtgtgaaggaagttaatcttcgagaacatttttgtttttccaagaccgtataagtaactggtggttgaacccagggcccggtgcatgctaggccagcaccctaccaactgggctcaagcctcagctcatcacagctaacagataattctcattatctagagtgcccgaacctgttttatggctgacaaaatcagggcaaactgagatgttaaaaggagaccatctatttcaacaattaggccatgcatatcaaatttcaagcacccctatggttagcctaaatacatgaattctagtccttcagtttcagtacttatatttgaagtgcttaaaaagcattctaccgaaacactcattttacttaagggtacaatcagtggtttgtatagtgagttgggtgagctcaaaatcccagcatttaggaggctgaggcaggaggatcacaagtttgaggccagtctaggctaaatacagttctagatcagccaggctaaaggttacagagttcattagggctgagctgctgagccttctgctctcacaccggctcatcttaatcatttttctcaatgactaagtatttctaagactgaactccaaactgctggaggggaggaaacacctctaatctttttatttctgaacaaaactcaagggaatggttctgggactcggtgtgttctcaccgtaagaagtgacagaaggattgagtgaggagagctaagagttcaccgttgtctctggatcttacctacatcttaaccatcagtccctcagtttatgcctcctgcctcctgagcatgctccgttctcaggctcccagaagctgctctctgtgtgagaactgactacccaggctgcaatgaaacaccagtggccagacaagcgcatgaacaggaactgaacactcaccggctctgtcagcgttgtgtctttctccaggaactgcacaacacagtacgccagctaacgggcagaggcaagtttaagagatgttagtgacgtaacactaggggtaaggggatagtttcacactgacacaaaatgtcactccagttttaagttgcagtataagatgaatatattcttattaaagttctaagttcaacatattgttagctctagacttaattaacttaaaaacacccatttagtcttccagtgctaatgttaacagcgaccaagacctaacagatcattagcatcattctgcatccctgtgagattcattcagggtcacacaactaagcacttcccagacctaaatataagaagcaaacttttgataatcttttctatatctaagttaaaaccgcagtagtagtatgtaaacaaactcataataaaaattttgccaaagcacattctttaattttacaagaaactagcaccttaatacctctcagtttttttgcctttatatttgtttttggaaatatccatttgtaattgttctgaaatttacctgtgcgtgaaacaaggccaatccttttgcagtatgcataggaataagaaccttcattagaaactgcttatgctctgctttcagtggcaatgcaaagccattgatgatactggagggaagaaaaggcagggaagggttaagtagtcactttgcttccacaagttacatgacctacagcactggggagtggtagggcagcctgctgagctgtccctccagggcagcctggaatctgacatctacactgtcactacagagttctgcacagctgcctttaatttccctccttaaagcaacaggagtgactgtctcaatgctgttagaattcccagcatgcacagtgataatggggggtgggggtggggtttccctgacatttctgaataatctagaattaagataatgctatcattactggtgtgtagtgaacagaaaggacgtgtatagaaaaccgaagactcttctaaaggaaaagttagattggggatggcctatcgacatttggataagatctctctctccctctcccctccgactgcttctgcctcccaagtgctgggattaaagccttgtgccaccactgcccggcttgggtaagaatttttgtagtgaatgaatgacaacttcatctcttccaggcttccagctgggaagaacttccaaggggcaaggctatgtagatccaacaacacacaacagtgtannnnnnnnnnnnnnnnnnnnnnnnnnnnnnnnnnnnnnnnnnnnnnnnnncacacacacacacacacactgttagggattgagcccagggcatctagcattgtgctgtaaactctcaaataggaactcatttcaactccagctgttttgtatataaaatactctttcagtaacttaattcttaaaaaataacaaaaacccccacccctgacctaccttcccaatatttccaggagctcagccacaccattgaaatgttccgtttcatatataaacctgaatttgaaataaagatagatgtaataaaatgtaaacaccaaagaacaaggcaggaaggtgaaaaaactcagcccaaggcagcagtaacagcaagcagtggctgctcagcctcaaggcttctggttcacaccagactctctgttttgttttgagactgccacactgcctttaagcttgctgtgtagccagtcctgaccatctgaccctgttgtcactacaggtgtgtgccaccacagcaccaaatgagctacatcccagcccaaactgagagcagtaacaacacaggatctatttcccgagtcacacagtcctctgctaaaatctgccacatagtattattccaccgggatcattatattacgcttaatataaaagaaagacagattgcctaaagaaaccgtttcaaagtaggagaccactattcacataaaaatccgaggaaagggggtccattttttcaactgttcagaaactttagacagtaactgataggctatctagttatctactatcacaactgcctttaaagcaaatgacagcatgagttgggggtgacatggggctgcagagctgaggagatggaacactgatttaagactaggggaggcaacagccccctcccatctcccatgctagcctaattttgcatcttcaataactgacataaagaaaaacgaacttgaaacacagatattaatgtgaagtctgatgtgaagcacgggtttcaccagtatttaaaccgtggtcccaaacagattttaatcagctttatcagaaccgtccaaaggaagcacttctacaggtattggcttaaatagtgattgtttaaaaaaaaaaaaactcagagagagtttgagcaaattattctttcaactcaaacacagtcacccatccaacactgtcctgctaccactgctgagggtaaaggtggcagggttctacgttaggctgccaccgtgtgagaaccacggagtgggcagggatgcctgaggtgccatcagctctgtcgggtttcagctgaaggagcctggctcaagagaggaggagactgctctcggtgatgaatttacctgaggaaaatgttgttaatttgctttctgatgaacgctctcaggccaaggaacttgccgtaaatccgatgcaggacggtcttcaggaagtcgcgctcccgtggatcttcactatcaaaaagctccaggagcttgaagagaaatctgacaaattactttaaaaaaacaatcgagctaaaaccgctcttttttctaattctgattgtaagataacctatgaaatattctgccttactagatttttatctttgctaagtaaatgaaactaggaaaagtataaatattttcactaaattcataattctttgtattgtttgaaagaatataaacactttctaaaaatataatttttttaaccttgccagtgactttaaaattctttcctagaataatttttagtgttatgtttaatgttttttttaataaaacttactatttttatttatttatttttgagaccgagactcattatgtaacccatgctggccttgaatttgcaatcttcctgcctctgccttccagagtactgatatttggaggccaggctgttcgaaagttccatggtaagattgccttgaacatctccaaatgcgtaagagtcttccagaactgcacggacccttctgttctaaactgagatgctgggcatagccagggaaggtggcgagctctttcttcattgtttctgtgcagattccaaacccaagcagacattctgaggcactgataagtcacattcacgtgccttaaacaagcaacttccttgtggtttgcactcatttttggctaggttaagatactgcgtgaggctccagccaaaaatacctacaaagcactggtccaaatgatcataattaggaatggctagccttctcattttagccttaaactcgtgtttctgatgttggtttacttgagatggttttgttcaacgcagacttagctctaagggggcacgaagctcaacagcagttgttagctctgagtttcaaatctagacatattttgaagtattgtaattaaataaaactaattagaaataatatactcatgccaggaaacctggtttttctggctctgttgccctcaaactatttttaagaataattcagtcaaaatcagaaggtcctgttccatggttctcaagccgtgggtcacgacccatttggggatcccatgattcacaacagcagcaaaattacagatatgaagtacaataaaataattttatggctaggggtcactacaacacagggccgcagcattacgaagggtgacactgctctagttcaaatccagactgtgccatttacaagctgtgtggcactggatgtgggctctttttacaataagcataacattgatgaagtatccaatgacaggtctgtgtcacaaaaaacaacgaatatatcttagttttcttgggagattatcttatttgaacataaatttaaattatgtagtatgccgccatcttccccaccaccacccccgcccctgcccccagctcttttaacttaaatctcttctactcttctgaattttaactttcaaaagctgagaattctcacatggtagttttcagaagcacacccccacacccccgatacctcagagacgcagctgtgtgcagtacacggaactgttggaatcagatagttaacggccttggctttccagatacttcaggagtttgaggtagaaggcaggaaaccgttcctgctctactgggcttctgtctctcctcagagaagcccagcagtctaagtccctagagcaccaggttactgcagcacaaatgcaaggtcccctcaatctgctgtcatcagagatacagtctaaggtgtgtggcttcacaagagcctgagtacactccacagcaaaccatacaagaaagtaaatgtgcgtttgtttatctgcaattgccccaaaggccccgttgtatttggactgactttacccctggttgat

SEQ ID NO: 350 - DNA, 2191 bp, Mus musculus
tagtagagcgggcacatcttggagctcgcgcctcctgcggcgtcgcggtccctggtgagccgtagagggccagtgccatgatccgacaagaactctccacgtcctaccaggagctcagcgaggagttggagcaggtggttgagaactcggagcaggcagacgaacgagacaaggagctggtccaagttcaaggtccaggtgtcgtgccaggcgtggacaacgagtccgcctccagcagcatccgcttcagcaaggcttgcctgaagaatgtcttctcggtcctgctcatcctcatctacctgctgctcatggcggtggccgtcttcctggtctaccagaccatcacggacttccgggaaaagctcaagcaccctgtcatgtccgtgtcttacaaggaggtggatcgctacgacgctccagggattgccttttaccctggtcaggctcagctgctcagctgtaagcaccactatgaggttattccacctcttgccagccctggccagccgggagacaggaactgcaccactcagaggatcaattacacccaccccttcttcaaccacaccatgcagtcagccctgattgtccaggggccccaggaagtgaagaagcgagagctggtgttcctccagtttcgcctgaaccagagcaatgaggacttcagtgccatagactacctcctcttctcttctttccgggagttcatgcaaagcccggacaaggcgggcttcatgcaggcctgtgagagtgcttactccagttggaagttctccggaggcttccgcacctgggtcaagatgtcactggtgaagaccaaagaagaggacgggcgagaagctgttgagttccgtcaagagaccagcgtggttaactatattgaccagagacccgcagccgagaggagtgctcagttgttctttgtggtcttcgaatggaaagatcccttcatccagaaggtccaggacataatcacagccaatccttggaacaccatcgccctgctctgcggggctttcctggcgttgtttaaagcagcagagtttgccaaactaagcgtgaaatggatgatcaaaatcaggaaacgataccttaaacggagaggccaggcgacaaaccacataagctgaagcgcccgtgccacggcactccgacagagcgagacaccagcaatcctgaactcacttgaagggaccctgcagggaaggacagtcccgtccatcgcactggaggctcaaacccggcccgggagggaaacgcccagtgaataacctgaaacttatttaagtacttaaattattaacggacatcttgcagagctgcctagtgccttggagaggttcctcctatttggtcactaaatagttaaggcttcttctttcccttagggctttttttctttaaagcggactgatgtgccctgtacgcagaattccttttagaccatctactgttacttaacaagaacttgttagagcctagatttgacttttttgtttttccttaaatgtagccccgctgtaatcactgtgtagaccaggccttcctcgtgccttcccattgctgagactaagagcctacatcactccccgcaagctttacacgagaccttaaaggctactagaaacttgtgattgtatttctgatgtgctagaagtgctagcagaggtatatacagtaggcacctacttagtgtatcttgatttcattaacaggtaaataaggttgggcaagcacaaaagggatgggagtgaatacccagtaagccagcgggcagcaacgctggacgctgatgctgtatggccagcaaacccagaaggtagtgtaagtctggaccgcagcataatggctctgactcagcacacatcactgccaacagggaggtaagctgtgcactgtccacaggtggccaagagggatggccacaccacatgagctagtccctgcgtcctacagaaacacacacctaaaagggtggcctttagggctttgataaacagcacctctacataaaaccaaaaactctataatagagttccacatgtggccagaggtaacattgaagaacttgtaattatgccttagggaatcggaagggaaatactcacaggtataaggaggacatttttgtctctaaattagcagcaagaaactgttttgcccaaatccctagaaataaacttgtactgtg

SEQ ID NO: 351 - protein, 354 aa, Mus musculus
RASAMIRQELSTSYQELSEELEQVVENSEQADERDKELVQVQGPGVVPGVDNESASSSIRFSKACLKNVFSVLLILIYLLLMAVAVFLVYQTITDFREKLKHPVMSVSYKEVDRYDAPGIAFYPGQAQLLSCKHHYEVIPPLASPGQPGDRNCTTQRINYTHPFFNHTMQSALIVQGPQEVKKRELVFLQFRLNQSNEDFSAIDYLLFSSFREFMQSPDKAGFMQACESAYSSWKFSGGFRTWVKMSLVKTKEEDGREAVEFRQETSVVNYIDQRPAAERSAQLFFVVFEWKDPFIQKVQDIITANPWNTIALLCGAFLALFKAAEFAKLSVKWMIKIRKRYLKRRGQATNHIS

SEQ ID NO: 352 - DNA, 71048 bp, Homo sapiens
  misc_feature (1)...(71048): n = A,T,C or G
gtctcaaaaaaagaaaaaaaaaaaaaagaagagcagcttataggatgctaaaacagcacctatgagcttgtccatttatccctgtgatcatacagtctcgggatgataaagcctcttcataatgtgccaaaacagagcaagcagcccctgtatagagaaggaaattaatattcttacctgccacttcaagggttaccccaggatcctccagatacatggttttgttgcccaatgagagctgtggcagaaggtcttgagccccatcactcttggccttcagcacctaaactaaggatgtctgagcaaacccgagagtgagtggtgcgcctcttcctaatggccagttgtcttacagcaagcacattaatttatattcaagttgcggtgatctggaagcccagattggggctttctgccttctagcttcccttgccaaggctgagaagtgtaagggcaacccccatatgtgtggcaagcttaaggccacagctaagagctgttccttttgagaagctgtcttaagtttttctgctttctctgtcttgtccttgttattaaaaaccataaatgccgtgtcccaaaactggttcatagtagtctggggaaccaaggctgctttttttgcagtttccaatggatatcaagggcagactggattatacaatgtacccctaatcaggtttgtccttttgaagtgggatcagtgtatttcctaattgcctcaattgtccctgaaacaaagccagattctcatctttaccttgggtaacttccttcacgttatcataattaacatgttttttcgtacatgtgtttatcccttctaataaacaagtgatcatgtgatctctcttctcagtcttcactattcctttgatcattccatcctcgattttgatcaggaactgcaatacccccaaccctgtagatagtatgattagaattgtgggatagcatttcatctgcatgtgtcctagctatttccaaaatccactgtttttcttccactgtacagcaggtggataacaaaatatgcaaatcctgccaggttaaattatgtcagagttagtttctcaaactcatctataaattttcctaggtcttcagagaaacaaccaaatttttctttgcataatgccaaatcagacatagaaaaagggacacatacccttatagtgccctgttccccatttaccacttctctaagcaaagattttcctttgaaagttgctaagaggctccactatgggtaatacaggtggggctgggttcctcagggagtaacgggtacagaataggactaagcatctcagaaggaggtagatgtaaaatagggctagacgggtaaggaggatgagatgaagaggtctcaacagaactactagaagggctagaagggacaggggcagatgcacctgaagcattggaactgaccaaggcttgcattgaaagatcatctagaatatctaattagttttcctcttttattttcattaaatatgcacatgcttgttttaaagttttatcctgactaagcaatagaaatgtttgaacatatggtatttcaccccattttccctcctgcttgcaaaacaaatcaagttgaagtataactattaaaggctgtagttccattaggtggccatttttcttgactttccaaataacattattattatttggaataataacattattatttggccctattagggccaaacaatattacataaaaataaacatttctttttcttaagcccacctaatttaaattggtcccaatgctctaatatgtaccctagtggtgagctttttaggattaaggctgtgttacccatgaagggagcaggtaaaggtgaaaatagagatcattgtgaataaggttgtactgccactggccaagctccactaaaaaggatgaaagagctttcagagccaaatgagcaagggaaaatgatcctgtgatcactttttttttttttaataaaaatagaggcggggtcttgctatgttgcccaggctgctcttgaactcctcagctcaaatgatcctcctgctttgggctcccaaagtgctaggattacaggtgtgagccactatacccagcccccatggtcactttaattcagctattcatattacccaaataatgagttgggccatttgcactagagagaccacaataggggacttgacaaagaaatgtctcattaagcaagggaaatgacacagacccgggaaggaatgtccaggctcaggacagtgatggcaagcagggtgaaacttacatggtcttgctgtccgtaaccaagaagtaaaagtcatttgattagtgagcagatgaaaaggaactgctaaaaacaaatctccaattccctattctatagctgtttgtctacatgggactggcataattgctgcctggctcaatcatacaccctggaatttttcatttaaaatttgtaagtactggctgggcgcggtggctcacgcctgtatcccagcactttgggaggccgaggtgggtggatcacttgaggtcaggagttcaagaccggcctgaccaacatgctgaaaccccgtctctactaaaaatacaaaaattagccaggcatggtggcacacacccgtagtcccagctactcgggaggctgaggcataagaatcactcgaacctggggaacggaggttgcagagagctgagatcacgccactgcactccagcctgggcgacagagcaaaacttcatctccaaataaataaataaataaataaataaaaattggaagtaccaagtttcaattttgagagaaggggaggcaataaataattcatgtaaatgggctacatatagggaaagtaaatcttgcagaaccattcatccccaatgtaccttaacaggatgccggagcagacaggcgaagagccgataatctgaaggcaaatgaggaaagtgaaaagttaaaaatatcaggactggtcaagtgaggcctgtgaaaaacagcaggaaaacacagcagtaaaacatagacagcaatcaggaaactggcaagtagcagcctttaacgagcagccaagagtgcaaggagggctaatccaaagggagtaatggttaatatctcgtcacactgaatccatatccagctatgaggatgtggagggcctccaacccttcctagttggacctctaaccagttttagacaagtaccccgtcctttaccactataaaaatatattccactacttacccaaagttggccaattggtgctgcacagtgtatttcctctgggttggagggtctcacctcattaaggttccagtggagatgcaatgggaaaatgttaccagaaaaggggtctcatccaagaacccaagagcaggttcttggctcttgcagggagataattcagggcaagtcacagagtatagtaaagtttaaatagtttattagaaaccactctattacagagtagggcatgctcagaaagcaagaggaggaatgcctctaccttaatgtaacgcttgcttacataggatattagggctaagaatagtgtactttattataaagtcctgtgatcagcttgtgacaggatattagtattcatgttctcttgtgtaactattgatttcagcgagaatttatgggtgtactattaatagcatcattagagtaaaacccatttttaaactaagaatgcctttttccattaacttgtttcctcagccctagacatcttgtgataaagagtgcctaacttcctgagaaagtcacccagcagtttttttttttttttttggctttatatggcctttattcaagatggagtcattctggttaggacacctgtgacagaataagtttaaatgttaatggaataactctggctgaagccgggaggctactgcaataatccaggtgggagatgatggctgcttggaccagggtggtgcctggggatgtggtgagaagtggttgactatggatatgttttgaagatgtggttgatagaatttgctgacagatgagacttgggatgtaagaaacagagaggagtcagaggtgagttggaggttgttgccctgagtaactagaaagatggaattgccatttattgatataggagtaggttttggaggagaagatcaagatcaatttggggcttgttcagtttgtgatgtgtgttagacatctaactgaaggtatcaaattggcaattaaatatacaagtctagaatgaggggagagttctgggctggagatagaaattttggaattcactggcataggtgttgtatgtaaagccacaggaatggctgagatcgccaagggaagtgcatgtggacagaggggactgagctcctaacatttggtggttggtagaactggcaaaggagaccagaaaagggctcactgtatgccaggtactggtttcagcactttgatgtttataagctcttttaatcctcactttaactctgggacataactattactatgtcaggggaccttaagtacctcacgtagctctcacagtaggtgacagagccaagtcaagcacaggccatgtgtcctacagcctgccataaccaccaggctatccttccccccagcgactataccaaatgtttatacttttacttatttaacaggatgggtttctagtgcagagtgacttaaacaggatctgtgtgcattaactttactctgaatctcaatttccacattagtaacatgccagcctgcctctttcataggactgtgttaaaactaacaatggtagtggaattgtaaacctcgaagtgcagtatctacattacactgtgtcacaagatctctggggatggaggaggcccttgaaaacccccgaattgaatatcatccccttcctgatgcatgtcacgataacatccctatcataccttgtactgcctctctgcttgggccctttctctttctacagttctgtttgtaaggaacatctttaagccaaaagacccttctaatttctactgatcccatataactcccccctccctgagatgctgaggataagtctatacatgaataacatgcttataggcccttggatttctccaggcacccctctgattgtcattttctacttgaacccagacatatttttccaaagcacttggaatccgttagtcaccggcaagaaaaatggaaagtattctttttctttaaaattttattttattttaagttctgggatacatgtacagaatgttcaggtttgttacataggtaaacgtgtgccatggtggtttgctgcatctatcaacccatcacctaggtattaagccccacatgcattagctatttatcctgatgctctctctcccaaaatagaaaccattctggatagaacagaatggctgaatacagggagccagttacacaggtgatgaaagaagctgagacaataaccctgaggcaaccaagagtatcaacagcaggaagtcaccattccagccaatggaagggtaacaggggtgtttatttatttttatgtatcttttctgagatgaagttttgctcttgttgcccaggctggggtgcagtggcacaatctcagctcactgcaacctccacctcccaggttcaagtgattctcctgcctcagcctcccgagtagctgggattacaggtgtgcgccaccacgcccggctaattctttgtatttttagtagagacagggtttctccatgttggtcaggctggcttcaaactcccgacctcaggtgatccacccgcttcagcctcccaaagtgctgggattacaggcgtgagccaccacgccaggcaacagtggtgtttattagagtctaagggcctgagtcacctggctgaagctaggaccacaaaaagcctttgtatcaggggctggagccatggaagggaaactgtgagaggcagagaacagggaaaaaaaagccctggcttctcccttgccctgactcctgaaaatgcctcctgctaaggtatacatgtaaatgattgccagccattattctagaggtcacaagacattgcaacttccccaattactcctgcagataacgtcactatcgtagaacctcagcttggctttttgaaatgtcttttcgggttttttgcatgtccgacactgatggctccacctggacccaccaatcactcctgtggcccccacccagcagtgactaagtgcactggaggaccatttcccacacccctgtgattgcaaccccaaccaatcaatagcaagcacccacccctatcctatcccacaaactacctttgaaaacccctggcccccaaatgcttggggagattgatttgtgtaataactctgtctccctgtggcctcagtcagttaaactctttctttactgcaatgccatggtctcagtgaattgatattgtctatacagcaggcaggaagaacccatcaggtggttacactacatgcccctagtggtcctctccactgacactgccttctgcttggcttcagcctagggcctgtgtactgtacctgtgccttctgcctgtacccgcacagaccatcatgtgctagtcccttcttgtcatttaggtctcaactcaaaagtaactgccatcaggaggcctctcttgacatcccccagatatattagcatcctaccaccctggcccatgtcttccacctttttataaggacgagtcatattggactgagagatcaccttactccaatatgacctcatcctagttacatctgcaatgaccctatttccatctaaggtcacattctgaggtactgaggtctaggtcctcaacatattttgggggaacacaagtcaattatagcaggaatctttagggtatagatgataattcaagccatgaggctagaggtgaccacttcactagcccctacggagtgaatagaaaggaggtggaaaatctagctttggggctgggcgtggtggttctcgcctataattcccccagcactttgggaggctgaggtagacagatcacttgaggtcaggagattgagaccagcctggccaacatgacgaaaccccgtctctactaaaaatatgaaaattttagccaggcatggtggcaggcacctgtaatcccagctatttggaaggctgaggcaggagaatcacttgagcccgggaggcagaggttacagtgaaccaagattgccgcactgcactccaccctgggtgacagagcgagactccatctaaaaaaaaccaaaacaacaacaacaaacctagctttgggaaagtccgccctgtagagctgagatgaggagaagtcagcagagaggctgagaaagagcagtaactgtaactgtaataggcctgttgcctgatgtgtgcagcaagtcaatatgccaagacggagttgcagtagaaaaagaggcttaccaatagggcctccaatcgaggagatggaggggaacctcaaaccctctctcaaggagtttgcggcttttctaagggtttttaaggagtaggctgaagtgtggagactgctgattggccaaagggaacagggtgaaatcattggacagagagagaagcagctgtattctcatgctgattccattcctctgttggtgtcttcaaacttgttggtgtcagctgtttcactggaatttgtgatctgaaaaacattttaagcaatttttttttttgagacagaattttgctattgtcgcccaggctggagtgcaatggtgtgatcttggctcactgcaacctctgcctcccgggttcaagcgattctcctgcctcagcctcctgagtagggaggctagggaggctgggattataggtgcccgccaccatgcctggttaatttttgtatttttagtaaagatgaagttttaccatgttggccaggctggtctcgaactcctgacctcaggcaatccgcccgcctcggcctcctaaagagttgggattacaggcgtgagccactgggcctggccttaaacaattcttaagcaaaagccttatgattccaatgtcagaaatcctacctgtaggagcagtggagatgcaaatggtcagtatctagtgctacatgacttttggctacaaggaagtgggtcaaattacagcctgattaatgcttaattataactctatttctgtgcagaattcgtgttaaccctgtgaggatggcttcaaagtgaggtaggagcaagccgggagtgtgtggtgtcctggaagccagggaggaacgcgtatcaaggaggagggaggatcagccaagtccactgtggctgataaatcaagaaagaggaggatgggaaaatggccatctgatgtgacaacactgaggtcacttgtgaccttgacaagcactgttccagtggagtggaggggagtaaagcctgactggtgtgtgctcatgaaggaatgggagagaggacttgggggctgcaaggacagaacattatttacatgtttatgatctgtctctccacagttgcatgaaagagccacgaaagccaggacccaagggtatcttatccatttctgtatcccagtgcccagcacattgtatttgttaagccatattttatattttattagccagtatctccttcaaatgtgggagcccataattttccagtttggtcacaccaacaaagactagagaggaatgacagggttggaatagaattctctggttccttccagctctaatattctatgatggtgtgaacttgttctatcaagtaccattgtattaacacagtaaggaatttaattagtggtctgctattgttaatttgttttggtaagcaactgttaaatgaaatggctggaatcagtgttccattcataaatttaacaaacatttgtcgagtgcctacaatgtgttaggcactatatatattgtcccatataacagatttaagagcagagggcctaggataggggtgagtggtcaggagaggtgatggggacctcccattgctaatgctccaggaggtccagggttctttgatgtggctggcactattctgcttatcactgaggagagaagaggctcccagtggcctgagtggaggggttaccaagctgcagctgcaagggacacagagcagcattcaccaaggcacaacaagcagcctctatctgcttcaccactgaggagccgagggccctcacacaacagctgtttcaggcagtgggaggagaggaagatgtggtcttcaggtccaccctgccacagggccaacaccagatttgacgccacatctagcgcttgaggcttcttctgtggctgaacagcggctttaggctttctctgcacgatccttcctttctgctttcatgggccttgtcaggcagggcagggtttagcagttgcattctaaggcgaggagaggagggctcagagcattgcaagacctaaaggggagggtcagagccaggacaagaacctaggggtactcctgcccctggaataatggagagaacatgggctccgcagtctacccctggatgaaataatcttcatttgattaccgctccacccgcatcctttctgaaacaaagtacctcagtttcctcatttgtaaattagggagaaaaatgtccttcttacagggttccttgcagaatcaacggcataatgtgagtgagagcgctttgtaactaacatacaaagtgctctccagacatttattaccgttttaaaccgccaggccaagcttcctcttgcaattatagattaggggctcctactcatctgactttgttccactttccactcctcttctccgtccctccccctccaacaaagagaggaagtgagagacgcagaggcacgcgtctaaggaccagcttagctggcccagggtcacatgcaggcctccgccacaggggtgagagctggtgtgaggggcgcccccgcccagaactacatttcccatcaacactttcgcgactcctgggcggcagcggccaggcgcatgcgccgagtatcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggaggtacgaggttgtgagagacggaagggaagtttgaggcggaggagcagggtcccgggggcctgggcggatgcggggcggggggtgtcggggctgcgcggcagagggctcttccgagggaccgacgggtgcgtcaggggagggctcccggggtgcagaggagcggcccaggggcaggaaggaagcggggcagcggagcgggcgcccagcgttctccgtatgctgcgggttgcatggccgaggtccggagtagggtccccggcgccgcgacccgtaaccagcaggtgaatgattgaagctacctgaggcccagccttccgcgctccccgccggagcggcagcccaatggcccagaggaacccggcgttctttgcaacaagtggagcgcccgcgccctcctcccggcgagatctgatgcgcggtcggcatcgtcggcatcctccccctccaagcccaaggcctcgctgtccccgcggctggtgacaggattgattacctgttttttggtgaccacctaactttgaaaaagtgccttcatggactctgctagttctcgctcctcttcgtctctccctccagtctcacctcctcccacgactttatcactttccagttctttgtctcttctctgtcctgcgctgcaggctgtgcgtccagcgcttccttcaagcaagccctgcctcctcacttctccagctgtattagtgaaactgctctcctcctccgcctccacttctcggcccccaaaccttggtcatctttggcaaccgtcctcttctgtgcccctccatcgtgccgcctcattggccaaagtcaggcagttccaggtcggtcctcctccagtttgtgtccctgtgtttgctgtaacctctgagtgcgatactgtgttaccatcgctccctttagtctcttatactctccagatttgccttgaggccctgccttcacctcggagcattccttttttctcagacctgacgctgcccttcgtctgcccagaacagtccagacttctcagcaggctcccaaagctctgaacagcacagcagccatgtctcccattacctttgccacctcctaacccacctagggtctggcacagtggaaactcagttttaaaatgtgctcctgcctctgtgcgtgtgctcactccattccttcatcaacgctccgccaagctccattgggtaaaatgcccccagaagtcaagggctacctcaagttccatgtgttccataggggtccgctttccagacccgtctgcatttctgtctgtccttctcataatgaacttgctgccttctgtcttagtcaatagttactgctgtacatatctccctttgtaaaagactgattcacagaagggctttgtggactatataaagcaggtggcttagccctacagtggagggagaagccaacttgaaggcagatgagatttgcctaaggcttgccattttttagtgtaggatcttggctggaatctggccttggacagatttctatatttctcctcccatcccctttattccatctgtttcctttgtctgaaaggagtctgagggattttaaccagtgctgtggattccatgacccctagattctgtaccctaaacagtgggggaatcctggggaatgagatgtgtctgaaagtttttaggtttatagggtgtggagcacagtggataaaagtcagaaagcccacgttcgtgcctggctgtgcctcttgctgtttgtgtgacttttattgagtcacataactttctgagcctcagtttctttgtctgaaagatgaagataataaaagtccctacctcccagggttgtttggggattagataagttggtgtggaaagcgcttggctcagtgtctggcaaatggtgaccccacagtgaatgatagctcttgttaacggtgtgggcagctcctgcgtccaggatgctttggggtcctggcttagcaggaacatgtgcctcaccatccacacatagccagcctagcagggcttataaaatgtttattaaaatataggcacttaccccgcttggagggccaaggcccagggtagactcagtttctctttggaggcatctccaaagtgggaggcactggaagggtgccctccccttgccttcttcagaggcctgttctggagtccctgtctctcacttcctcagagaatggggccacccagaaaatggccggcgtctttcttcctgaaccattctgtgagtgtacctagctctgagtaggtttatttgctgaggggggatttttccttggggagggtgggatatactgagaatttggccaggggcaggcaaggaggcaggctcattatggctgtgggtagtcaggaagggaacctggtgggagggtgttagcacctgggtcagggtgaacctgagtgaggcttgaatcagggaactttgagatttcccaggactaacatcctcctctccctttggccagtgagacctctttatctgtgctcctgctagtggcttatatctcttggtgccttcaccagcctccctgccctttcccactggttgcttttcttttctttcttttttttttttgagactgagtttcactcttgtcactcagactggagtgcaatggtgcgatctcggctcactacaacctccgcctcccgggttcaagagattctcctgcttcaacctcccaagtagctgggactacaggtgtgcgctattatgcccggctaatttttgtatttttagtagagatggggtttcaccatgttgaccaggcaggtctcgaactcctgacctcaggcgatccgcccacctcggcctcccaaagtgctggaattacaggcatgagccaccgtgtcaggccccgcacctggccttttcttttgtgcttcgagggctttaaactggagattttgcctgattctaaggggcaggagtggagtcgtggagagggagatagaagaatagattcgtaagagatgtttttcacttgtctcttggaggtgagtttttaatgaaaatgtctagaaaccttaaaaccttaaacactgatgctgtgaacctgacaaagtgcttgggaaagctgtcccctctccctcccaattcagggatggcttctcttctaagctctggtcttgagctctcttgccctcctccttaatcctacagagacttgttgattatcatggtatcctttccgtccttcttcccttctcagtggtataattttccccatttgacaggtgagaccactggtgaagtgaggttgaggttgctggctaccaggctgctgattataatcagcacctatccctgtggtggactgcctgcccttcctgctgtgttctgccatttgcagcccaagtcagtggacttcagccagagtgccagagagagctctgacaccaccttcactgttccctcttttctctcagcagactctaagccgtatttcctcttcctttgggaagtggttaagactatgggctttggaactagaccaacttggattttactcctgccatatctttccctggctttatggccatggaaaatattgtgggttgaattgtgtttccttaaaaaagatatgttgaagtcctaaccccaggtacctcagattgtgaccttgtttggaaatggggtcattgcaggtgtaattagtgaagatgaggtcatacaggagtagggtgggcccctaatccaacatggctggtgtccttcaagacgatgaccatgtgaagacacagagagagcacaccttgtaaagatggcagcggagagtggagattggatgcctctacgagccaacgaactccaaggattgctggctgtcaccagaagccaggagagaggcatggaacagatttcctcaccactcgtagaagaaggagccaaccctgccaacacctcaatttcagacttctagcctccagaactgtgagagaagacatttccgttgttttaagctgttcggtttgtggtacttgctacagtagtcctaggaacacagagagcagaaagtttattgagctttctgagcttcggtgtcctcatctgtaaaattgctgtaacacactctatgtcatgtggtttttggtgacaattaagtgacaagcagcttctgctttcttattctagtgtagaaaagcaaggctgacatagctgacttgtctttgctctctttgcttctccctttagctgagtgaggagttggtccaggtggttgagaactcagagctggcagacgagcaggacaaggagacggtcagagtccaaggtccgggtatcttaccaggtgagtgcgtttggtgctttgctgtgctgttgctgcagctggacaccccagtctaggcgccttgccaactgtgggagaggaggagcccccttccctgcaccctggtgtcaggtctcaagtattgccctagttttaaagccatacatatttaaccagccttggaacagaggatatgtctaggctggtatctgctcttaactccaatttgagccacttcctgaggtcaggtcattgcatacaatggcaaatgctttggatctctgctcttctgttcctctttccctggaaactgctagcaggtgagcctctaatatccgggtcaaagaagatctaataggccccctctttcagatactaggcctgtccagtaatgctgctcagttgggtaagcagggtcccatcagtcagttggcatcttatggagccctacggcaatgtttgacactgctgactacttcttccgcccggatacacgctgctcccttagcttctgtgatgcagcatttctcaggccactccttccaggctccattgcggtcactctccagctcttgggcatgaaatgttggttgcaggcccctttctctcactctcatagacagttctacccaggcctgctcccttgcttcagccactgcttgctcacacgtgactcccatgtttacatctctagcccagaggttacctacaaaccgcaaatttatatatcctgtatttccaactgcccatgtcatagttctgcttggatctcccaaagcttccctcaactccacatgtccaaaattgacctcatgatcatctcagtcccagcttggtcctctcccagtatttcctgtttgcaggaatggtactaccacttaacgcagttgaacttcagagtagttctccattccttccttcctctcatcccctttttctctggccctcagccatgctgatctttttttattttaggcctcattccctctcaccacagggcctttttgttgttttatttctctgcctggaattcactttccttcttcacatagttaatgcctaatcattcttcagctttcagctcactcatttttttccacagagccttctctaaccttctggccagattacctcccaccctccagcaccgtctcatagtccacgcgcctctcctttccggctattgctgttggaatggtgcgtttgtttgtctgactaatgtctgtctgttctactacagcagtccccaactttttggcaccagggaccggtttgtggaagacaatttttccacagatggaggttgggggatggtttcaagatgaaactgttccacctcagattatcagacatagttagattttcataaggagcacacaacctagatcccttgtatgtgcagcttacaataggatttgcactcctatgagaatctaatgctgcagctgatctgacaggaggtggagctcaggtggtaatgctcactcactgctcacctcctactgtattggcccagttcctaacaggccatggacccgtattggtctgtggcctgggggttggggacccctgttctactagaatgaaactccctgagggcagagaccagtctgttttgctcaccagcctagccttgaccacgccataaagatttgttgagtgaatgaatgaagccccagcctgacttcaacttcttggatggatcccatctgtttgtgggagaggggaacaagacaggaactaatgtggttctgcctgctccttacagaagactgcatggaagggaccgggcacggtggctcatgcctgtaatgccagcactttgggaggctgaggcaggtggatcacctgaggtcaggagttcaagaccagcctggccaacatggtgaaaccctgtctctactaaaaaatacaaaaattagccaggtgtggtggcacatgcctgtaatctcagctacttgggaggctgaggcaggagaatcgcttgaacccaggaggcggaggttacagtgagacgagatcatgccactgcactctagcctgggtgacaagagtgagactctgcctcaaaaaaaaaaataaaataaagtaaaaaaagactgcctggaaggaaggaggctggaagggcagctaacatttcctgactgcttctcctgtgccaggatctgtcgtaccccatttgccccatttaattctcacatcaaccctgtgaagtggttatcccccttttacagatgaggcccccaacctcagggaggttgagtaaagcatggggaggtcatatagctggtaaacacagactgagtcaaactctgcccaaccctaaactctctctactacaccagtggtgttttcttttttttttttttttttttgagatggagtctcactctgtcacccaggctggagtgcagtggcacagtctcggctcattgcaacctctgcctcccaggttcaagtgattctcctgcctcagcctcccaagtagctgggactataggcgtgtgccaccacacccagctacttttttatttttagtagagatggggtttcaccatgttggccaggctggtctcaaacccatgacctcaggtgatccgcccacttcagcctcccaaagtgctgggattacaggcgtgggccaccgcacctggcctacatcagtggtttataaaaactattttaagtggtggtaatcccaacactttgggaggccaagatgggaggatctcttgaggccaggagtttgagaccagccttagcaataaaatgagatcctgcctctaccaaacagacaaaaaccaaaaacactcacacaaaacaataagcattcttttattaaagcccaatatgtaaaagatagtagcacggctaatcctccctctgacatgaggcattgcctctaaagccctaaggctcccgggagaacaacttgaaagacctgtatattagttttctattgtttctataacaaattaccaaaaacttagtggcctaaaaaaacacaaatttattatcttatagttctggaggtcaggagtccaaaatggatctcactgggctaaaattaagctgtcagcaggcctgaattcctttctaggggcttgaggagagaacttggtctttgccttttctagcttctggaggcctcctgcattccttggcttgtggccccttcctgcagcttcaaaaccagcagtggctcgtcgagtctttctcacatgacatcactctgatgctgactctcctgcctcccttttctgtgtttaaagggcctttgtgatcacatcgggcccacccaggtaacccaggataatctccctgctttaaagtcagctgattagcaaccttagtcccatttgctgccctaattccccttttccatgcaacttgacatattcacaggttctaaggattaacacttggacatctttgggagcctttattctgcctaccacaccttgcactaccctcttgcccccaaccagaagtgcatagatggaggcaggagaaagaagaggagggaggccagacttggaaagatgaggcttgtctttgtgtttcctttcatagagaagtgcccaggtaaatcaggaggtggccctaatgtccttggaccttagcagcctctcttttgcctcagattcctggggctgcaaagcctggggtcaatcagaataggaagccaggcctcaggcagagcaaattttgggtagttccatcaactggcaagagcattcccacttgctttggggtagccttcccagttgctttgggggaaccagatgagctgggctcatctcctttctaaatcacagaagattcagatctcaggagtccatttggctgggtcagtagtgagttggctcaaatttgatggactgatacacaactctcagagctcatttcttgcctctgactcttcttttttttttgagacagtctccctgtgtcaactaggctgcagtgcagtggcacgatcttggctcactgcaaccaccacctcctgagttcaagcagtcctcatgcctcagcctcttgagtagctggattataggcacttgcaatcattcctggctaatttttgtatttttagtagagacgaggttttgccatgttggccaggctggtcttgaactcctaacctcaagtgatccacctgcctcagcttcccaaagtgctgggattacaggcgtgagccaccatgcttggcccctttgagtcttctaataataataataaaaataatggtaatggtgatagtggttgccattttgggggtgctttcatgtactaggcctgtgtagggctttagggctttttttttttttttttttttttttgtggggtgggaccttgctttgtggactgggctacagtacagtggtgtgatcatggctcatttcagcctcccgagtagttgagactacagacatgcgccaccatacctggctaatttttaaattatttttagagacaaggtcatgcagtgttgcccaggctggtctcaaactcctgggctccagtgatcctcctgccttgacctcccaaagtgctggaatcacaggtgcaagccattgctctgagcctatagggctttttatatacactttatcctgtaatcttcacagccactctgtgaggtgaacggttagtcctagtttatagatgaggaacccaaggcacagacgttaaggaatatgctcagagctcatgagtggcagggctcaaatccatacccagagctgtctcgcaaggtgttctgactctggctcagttgttcctagatgagagctttcctgctccaaattctcccctccctgtagcagatcaattaaggactgcttcacttgttatgccaagtgctgacaccacaaagagggtgagtaagttcctccaggaactcaggcatatagagacagaaggccggttacccaaggaagaacttgtccctccttctgagccttccttgacttccctgatgaggtccctttctccctgtgatatgctttcctttgtaacagttaacacagttgataggtcacatttattgagtttaattattcagttaattgttatccatcccttggcactgccctacaagttctgtgaggcacacagattttgtcttctcctcctttactgtaactccagtgcctagtgtggagtgtagtatggaagtatgactccatagaagtatgagtactgtaggtactcagtacctatttgtcctctgggggagagcagtggagatttagagcaagagagcctctcatctaggagcaactgagctaactggaatgaatgaatgagggccaaagaaatggtagagtcaggtgcttcaaaattaatgaaggggcctggcgtggtggctcacacctgaaggggctcacactgtggctcatcccagcactttgggaggccaaagcgagcagatcatctgaggtcaggagttcgagaccagcctggccagcgtggtgaaaccccatctctactaaaaataccaaaaaaactagccggggcatggtggcagatgcctgtaatcccagctactcaggaggctgaagcaggagaatcacttgaagccgggaggcggaggttgcaatgagccgagattgtgccactgcactccagactgggtgatagagcaagattccatctcaaaaaataaaaatacaaatacaaaaattagccaggaatgatgcacgcctgtaatcccagctacttggaaaaaaaaaaaaaaaaggaaggaaggctggctggtttgagaaagtgggactactctgaaggaaaggtaacatgtaggtgaaaaagaaggggctggctagggaagggagatgacatgagcaactgtatagagatgggaataaaataggacatgtcagagatcatgaatagcatggtatggttggggcagagggctggtgagcaaagtagagggagatgaggtaggaaagatagacttggtcagattatggaggggtctgagtgtcagggtctgtacattatctagtagggagcagggagtatttaaaaggattggggctgggtgcggtggctcatgcctgtgatcccagcactttgggaggctgaggtgggtggatcacgaggtcaggagatcgacaccatcctggctaacacgatgaaaccccgtctctactaaaaatacaaaaaattagccaggagtggtggtgggtacctgtagtcccagctactcgggaggctgaggcaggagaatggcgtgaacctgggaggcagagcttgcagtgagctgagatcgcgccactgtactccagcctgggcgacagagcgagactctgtctcaaaaaaataaataaataaaaaataaaaggattggaacaggacagtaagaggagtaaagtgaggattcagatgaatgtggctggattaaggcaaagggagacaaccatgctgcggcaaaggctgatgtgagagggtgctttgctgtagcagagggggagaaggaagaatcaaagaggattcttaattttgaagccaggcaaacgggagaatgatactacatagagatggagcctagagaggcaaatggcttagaaaagaagatggccaggtgtggtggcacgcctgtaatcccagcactttgggaggctgaggcgggtgagtcacttgaggccaggagttcaagaccagcctgggcaatatggcaaaactctgtctctacaaaaaacacaaaaattagttgggcatgatggcatgcatctgtaatcccagctacttgggaggctgaggtggaagaatcgcttgagcccaggaggcggaggttgcagtgagctgagattgcactgctgcacaccagcctgggcgacagagtgagagaccctgtctcaaaaaagaaaaaaagcctatttgttgttggcatacggtcagttgaagtcgagatggcccagaggcagtgacagttacaggatggacaggagagaagggagggctggagttgtgcaacctggagaaatcccatgggggcaaggtcacagggacagatggaaaatgagcaggggggccatgaagactgaacctcacaaacatccctgtttgggggccaaaagaggagctggggctggaaaaggagttgaatggagggcctggaggtaggagctgcaagaaaggaggacagtgtagcagagattcaagttaagcacccaaacgtgcagggttgtaaatcagttttattctctggaatacataattccataccataatgcactaaaagctttagtctattcatttcctgtctatcaagtgaatcagaaccaattagtattctgttcaaagggagaaatgacatcagacatgctaatagaataagcactttcttacatcagagatgtaatcaaactgaggaaaacccttggttaattagtcattacaatcagttctccatagaaacaactgtatataatgggatagacaaagaaaaaattcatagattagaccttatcaagatgaaaaccttggctgggcacggttgatcacgcctgtaattccagcactttgggaggtcgaggtgggtggatcacctaaggtcaggattttgagaccagcctgaccaacatagtgaaactccacctctactaaaaatgcaaagttagccaggcatggtggctcatgcctgtaattccagctactcagaaggctgaggcaggagaattgcttgaacctaggaggcggaggttgtagtgagccaagatcgtgctgttgcactccagcctgggtgacagagtgagactccattcccgtccccctcaaaagaagaccttttgtgtatcaaaggacactatcaagaaagtgaaaagacagcccacagaatgggaaaaagtatttgcaaatcatacacctgataagggactggtatttagaatatataaagaacacctacaattcaacaataaagacaaataactcagtttaaaaatgggcaaagaatctgaatagacatttttccaaagaagatatacaaatgactagtaagcacatgaaataatgccaacatcattagtcatcaaggaaatgcaactctaaatcacgatgagatagcacttcacacccactaggatggttataatttttaaaaagtggataataagttttggcaaggatgtagagagattggaacccccatacgttgctgataggaatgtaaaatggtgcagctgctgtggaaaatagtctgacagttcctcaaaaggttaactacagagttaccatatgggccagcaattccattcctaggtgtatattcgtgagaaatgaaaacttacgtccacatgaaaacttacatctccaaaaaatgtgtacatgaatattcatagcagctttatttgtaatagtcaaaaagtggaaataagccaaatgactatcaactgatgaatggataagtaaaatggtacattcacacaatagaatattatttgacaataaaagaatgaggaactggctgggtgcggtggctcatgcctgtagtcccagcactttgggaggccaaggcgggtggatcacttgaggtcaggagttcaagaccagtctgaccaacatggtgcaaccccgtctctaacaaaaatatgaaaaattagccaggtatggtggtgcacacctgtaatcccagttacttgggaggctgaggcaggagaatcacttgaacccgggaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttttgaaacaagaatctctgttgcccaggctggaagtgcagtggcgccgtctcggctcattgcaacctctgcctcctgggttcaagtgattctcctgcctcagcctctcgagtggctgggattacaagcatgtgccaccacaaccagctactttttgtatttttagtagagacgaggttttgccatgttggccaggctgttctcgaactcctgacctcaggtgatcctcccacctcagagtcccaaagtgttgggattacaggtgtgagccaccgcgcctggctgtatctcgaaaacatagtgagagaagtcagacacagccacatatatgatgccctttatgtgaaatgttcagaacaggcaaatccatagggacagaaattagattagtggttgccaggaaaggggaagtaaccactcttgggtatggagtttctttttgggtaatgaaaattttctgtagatagtggtggtggttatacatcttgtgaatatacaaaaaactgctgaatatatttactttaaaagggtaaattgtatggtatgtaaattatatctaaaaaagagaaacaaaattgaccacactaaacagaaaaaaaaggtaggcaaaaaattcagaatgcctcttagcctagtgctccctgcaaggtggagtttcacaggattatggcagacaaccaagcccccttcctctaaatagaggttccatgatattttcagtaactgaattgcccatcacagatccccttagtggatgaacttgcattctggggcaagtttggggttttgaaggaattctgtcttgaattttacaaagcatataaactacctttcccaggaacatcttgtgcattatttttgtcttcctactaccctgagtttgcattcatttaaaggatgatacttttaaagcacattcatccagtttgccacaaaaagccagtgttagttttctcactacatagtgcgtgggacattttatcaaataaccagcactgttttttttttatgataaagtataatggtgtctagttttggaattggagtgttacttatagcaagtgtggaggataagtaaatagttttacagtttttatttagatcacactcctatttgtggatcaagaagaggcctgtaaagaagctaaacttggcttctgtgagtaaaacagaagagaaggcttttggtcaatgttcccatgcaagtaatttgttccaagtacctctcccagatgaattgcagtgatagaattggcatgtgatcttcttgttttatgcctatttttagaattttcaggaacatgtagggagaacttcatctctttccttaaccaaggccatcatgaaggcaaaacatttcaaatcatgtttatctggcttaatgcagagtggacacacctgtccacagatgccagtcatcgttcgtctttattatattgttcagcctggatgtagtatagagtttgtcttagaagttttctgggccaggtgcagtggctcatccctgtaatcccagcactttgggaggctgaggtgggcagatcacctgaggtcaggagtttgagaccagcctggctaacatggtgaaagcccgtttctactaaatatataaaaaattagccaggtgtggtggcgcacacctgtaattccagctacttgggaggctgaggcaggagaatcactggaccccaggaggcggaggttgcggtgaaccaagattgcaccattgcactctagcttgggcaacaagagtgaaactccgtctcaaaaaaaaaagttttccaggtcaggtacagtggctcacgcctgtaatcccagcattttaggaggccgaggcgggtggattgcttgagtacaggagttctagaccagcctaggtgacatggtgaaaccccatctctacaataaataacaaaaattagctgggcatggtggcatgtgcctgtagtcccagctactcaggaggctgagatgggaggattgattgagcctgggaggtggaggttgcagtgagccaaaaatcatgccactgcgctccagcctgagtgacagagtgagaccccacttgagtccaggagttcaaggctgcagtgagctatgatcacaccagcgcactccagcctgagtgacagagtgagaccgtgtctcttaaaaaaaaaaaaagtgtttcagacttctctacttgttacgaagttatattctttcaattacatcttttattattaatgactgtaattgtaaaaatgctcacagttgtgtagggaaagagcattgggctaggagtcaggactcttaagactctctcattctgattgtgccagttactggctgtgggatctggattgttgtacaaagagtagagttaggccagatggccttttaggtccctgtcaactcttaaaaattagattcagatgttatgcaacaaatcagtcacttcagagttccttcagttttatcttgtgatcttttcaaaccccgttagaatgtagtaagctggtactcattgccactgcagttatgagcagctcatgacagtgaatgtattttcacccatcaggttttgaaggatacccatggtcccatttggaccatgggagttggttgtaccttccaagctaaatagctgtgggtaggttcctgtgcatagatcctgtggccctgcagcccagctacagctgactgctcaggggtcagcacccaagaaagggaagccatctataggctgggcttgaaggaggtcagtgtcttgtgaggtatctggtggaacaccctatacaggatactttctcggggagaatttgagtgcaagactcacggagaaggacttagtaaagtggagcagggtcaagagagaaacatggagagaaggcagatagcaaagccatgaaggagcagaaattgacacagtgtctattagcaataggtagaggcaaaagtgaaatcaaacacaaaagaggctgagatgagaaagaattgccttaattccttttggacaactagagctgctgtggaccttggtggcttagctctcagctacccattgggtttccccagttctcacttatcctcgtacctgtagagtaaacctccactgcccacagtaacctgttccttaaaacctaaaggggcctcactgacagttctggaaatttgcatttctgtgtaaagtgaaaaccttctaaagtattttgccaaaaaacagcaaggaacattcactggtttatagttttacatgcttgattgcactaatattctctgatggattgagttagcatggcaagacttagttcatctattatttaggttatttattcattcgacaaacatggaaacattacattcctactatgtgaaagatactatattctgccctgcctccattttattttcaatgtatatcttttcagatttatttttcaaaagagattatagttctatgatctttatttttgctattttcataaatgagcacttcattttttgaagggtagagggtacattctgtttctttggtaccagtaattgttaccattgagcaggcactgtgtaatgcattttgcagcgttctgtcatctgcttctctcaaaaatcctgtaaaatggaaatgattattttctttttacatgaaaaatgtaaggctttaggagcactgagtaacttgtctaggatcatggagtagttagtagcaaagctgcagctggagctcaaaactctgactctaaagctcatgctcgtaaccactgcacagtatatctgctctttcagtcagaaaataaatgaataatggaaaccaaattatttcttccttaaaattctccttgtggtttaggtgcagaactaacatgaccccctccacagagtctttgctgataactgcccttctccctgtgcttcccattcttcctgcagttgaaggaaacctcatgttttatatccttatatgtttctgaattctgtagcactttggattagagaccatcagtcctccatttgatatctccctgaagcacctagtacaaaatcatgcatgtagagttggtgcttgatcttgtagaagtaaagaatgaattatttccttgtctttaccaacccaggagactttgatagttctgtgctgagcctgcttttgtgctttaaataaagtaaaattaaataattatgagcagatattcttttgtgtctttgtatttgaaatctgctatcaaagcatatggttgggttttattcttaatccagactgacagtctctgctttttaattggacggtttagtccatttacatttgatgtgattattgatatggctggatttggctctaccattttgctgttttctacttgtcttgctgggtttttttgtttgtttctctgttttttctttcttgcaagttataaaccttaccatattgttgagtaatttctgctgtaggcagtcttaattttttttaagtagctttttgttttactcacttatttaacattttcagtgctctttacatctgagagttaccatctagtgtcaattccttttagctttcagaatttttcttagcatgcagtttagtgcaggtctgctagtgatgaattctctcagccattgtgtttcaaaatatctttatttcatcttcatttttgaagttttgctggatagagaattatactggtagacaaaaaattttttttctttcagcatttgaagatgttccattgtcttctggcctccattgtttctgttcagaaattagttgtcgttaatatcagtgctctatatgtaatagatagatagatagatagatagatagatagatagatagatagatatttttttccctcactgccttcaagatttttctcttttctttacattagcactttgattattatttgcctcgggatggttttttttttttttttttaagttatcctggttggcgtttattgagcttcttggatctgtaagttgttgtctttctccagttttgggccatttttttttcagatttcttttttttcaatatgtatatgtatatttttattatactttaagttctagggtacatgtgcgcaatgcaggtttgttacatatgtatacatgtgccatgttggtgtgctgcaccaattaactcgtcatttacattaggtatatctcctaatgctatccctaccccttcccccaccccacaacaggccccggtgtgtgatgttccccttcctgtgtccgagtgttctcattgttcagttcccacctatgagtgagaacatgcagtgtttggttttttgtccttgtgatagtttgctgagaatgatggtttccagcttcagccgtgtccctacaaaggacatgaactcatccttttttatggctgcatagtatgccatggtgtatatgtgccacattttcttaatccagtctatcattgttggacatttggcttggttccaagtctttgctatagtgagtagtgctgcaataaacatatgtttgcgtgtgtctttatagcagcatgatttacattcctttgggtatatacccagtaatgggatggctgggtcaaatggtatttctagttctagatccctcaggaattgccacactgtcttccacaacggttgaactagtttagagtcccaccaacagtgtaaaagtgttcctatttctccacatcctctccagcacctgttgtttcctgaatttttaatgatcgccattctaactggtgtgagatggtatctcattgtggttttgatttgcatttctctgatggccagtgatgatgagcattttttcatgtgtctgttggctgcataaatgtcttcttttgagaagtatccattcatatccttcactcacttgttgatggggttgttttttttttcttgtaaatgtgttggagttctttgtagattctggatattagccctttgtcagatgagtagattgcaaaaattttctcccattctgtaggttgcctgttaactctgatggtagtttcttttgctgtgcagaagctctttagtttaattaggccccatttgtcaattttggcttttgttgctattgcttttggtgttttagacatgaagtccttgcccatgcctatgtcctgaatggtattgcctaggttttcttctagggtttttatggttttaggtctgacatttaagtctttaatccatcttgaattaatttttgtatacagtgtaaggaagggatccagtttcagctttctacatatggctagccagttttcccagcatcgtttgttaaatagggaatcctttccccattgcttgtttttgtcaggtttgtcaaagatcagatagttgtagatgtgcggtattatttctgagggctctgttctgttccattggtctatatctctgttttggtaccagtaccatgctgttttggttactgttgctttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccatgttcatgatattgattcttcctatccatgagcatggaatgttcttccatttgtttgtgtcctcttttatttcattgagcagtggtttgtagttctccttgaagaggtccttcacatcccttgtaagttggattcctaggtattttattctctttaaagctattgtgaatgggagttcactcatgatttggctctctgtttgtctgttgttggtgtataagaatgcttgtgatttttgcacactgattttgtatcctgagactttgctgaagttgcttatcagcttaaggagattttgggctgagacgatggggttttctagatatacagtcatgtcatctgcaaacagggacaatttgacttcctcttttcctcattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtaggtttgtcataaatagctcttgttatttttagatacgtcccatcaatacctaatttattggtgtttttagcatgaagggctgttgaattttgtcaaaggccttttctgcatctattgagataatcatgtggtttttgtctttggttttgtttatatgcagattatgtttattgatttgcatatgttgaaccagccttgcatcccagggatgaagcccacttgatcatggtggataagctttttgatgtgctgctggattcggtttgccagtgttttattgaggatttttgcgtcgatgttcatcagggatattggtctaaaattctcttttgttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcgtagaggtgtttatagtattctctgatggtagtttgtatttctgtgagatcggtggtgatatcccctttatcattttttattgtgtctatttgattcttctctcttttcttccttattagtcttgctagctgtctatcaattttgttgatcttttcaaaaaaccagctcctggattcattgatattttgaagcgttttttgtgtctcagtctccttcagttctgctctgatcttagttatttcttgccttctaccagcttttggatgtgtttgctcttgcttctctagttcttttaattgtgatgtcagtatgtcaattttaggtctttcctgctttctcttgtgggcatttagtgctataaatttccctctacacactgctttaaatgtgtcccagagattctggtatgttgtgtctttcttctcattggtttcaaagaacatctttatttctgccttcatttccttatgtacccagtagtcattcaggagcaggttgttcagtttccatgtagttgaggggttttgagtgagtttcttaatcctgagttctagtttgattgcactgtggtctgagagtcagtttgttataatttctgttctttttcatttgctgaggagagctttacttccaactatgtggtcaattttggaataggtgtggtgtggtgctgagaagaatgtatattctgttgatttggggtggagagttctgtagatgtctgttagatctgcttggtgcagagctgaattcaattcctggatatccttgttaactttctgtcttgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactatccaatttgccagtctgtcttttaattggagcatttagcccatttacatttaaggttaatattgttatgtgtgaatttgatcctgtcattatgatgttagctggttattttgctcattagttgatgtagtttcttcctagcattgatggtctttacaatttagcatgtttttgcagtggctggtaccagttgttcgtttccatgtttagtgcttccttcaggagctcttttagggcaggcctggtggtgataaaatctctcagcatttgcttgtctgtaaagtattttatttctccttcacttatgaagcttagtttggctggatatgaaattctgggttgaaaattcttttctttaagaatgttgaatattggcccccactcttctggcttgtagagtttctgctgagagatcagctgttagtctgatgggcttccctttgtgggtaacccgacctttctctctggttgcccttaacattttttccttcatttcaactttggtgaatctgacaattatgtgtctgagagttgctcttctcgaggagtatctttgtggcattctctgtatttcctgaatttgaatgttggcctgccttgcttggttggggaagttctcctggataatatcctgcagagtgttttccaacttggttccattctccccgtcactttcaggtacaccaatcagacgtagatttggtcttttcacatagtcccatatttcttggaggctttgttcgtttttttaaattctttttttctctaaacttctcttctcgcttcatttcattcatttgatcttccatcactgataccctttcttccagttggttgaatcggctactgaagcttgtgcattcatcatgtagttctcatgccatgggtttcagctccatcaggtcctttaaggacttctctgcattggttattctagttagccattcgtctaatcttttttcaaggtttttaacttctttgcgttgggtttgaacttcctcctttagcttggagaagtttgatcgtctgaagacttcttctctcaacacatcaaagtcattctctgtccagctttgttccgttgctggtgaggagctgcgttcctttggaggaggagaggcactctgatttttagaattttcagtttttctgttctgtttttttccccatctttgtggttttatttacctttggtctttgatgatagtgatgtacagatggggttttggtgtggatgtcctttctgtttgttagttttccttctaacagtcaggactctcagctgcaggtctgttggagtttgctggaggtgcactccagaccctgtttgcctgggtatcagcagcggaggctgcagaacagcgaatattgatgaacagccaatgttgctgtctgatcgttcctctggaggttttgtctcagaagggtacctggccgtgtgagatgtcagtctgcccctacttgggggtgcctcccagataggctactcagggttcagggacccacttgaggaggcagtctgtctgttctcagatctcaaaccctgtgctaggagaaccactactctcttcaaagctgtcagacagggacatttaaatctacagaggtttctgctgccttttgttcggctatgccctgcccccagaggtggagcctacagaggcaggcaggcctccttgagctgcggtgggctccacccagttcgagcttcccggccgctttgtttacctactcaagcctcagccatggcaggtgcccctcccccagcctcactgccgccttgcagttggatctcagactgctgtgctagcaatgagcgaggctccgtgggtgtgggaccctctgagccaggcgcgggatataatctcctggtgtgccatttgctaagaccattggaaaagcacggtattagggtgggagtggcccgattttccaggtgccatctgtcacagctttgcttggctatgaaagggaattccctgaccctttctgcttcccgggtgaggcgatgcctcaccctgcttcagctcacactcggtgcgctgcacccactgtcctgcacccactgtatgacaagccccagtgatacgaacccagtacctcagttggaaatgcagaaatcacccatcttctgcatctctctcgctgggagctgtagactggagctgttcctattcagccatcttagaacccaatatcaatagtcttttttttttttttttttctttttgagatggagttttgctcttgtttcctaggctggagtgcaatggcgtgatctcaactcactgcaacctccgcctcccgggttcaagcgattctcctgcctcagcctcctgagtagctgggattataggcatgcaccaccacgcccagctcatttttgtatttttagtagagacggggtttcaccacattggccaggatggtttcgatctcttgaccttgtgatccgcctgcctcagcctcccaaagtgctgggattacaggggtgaaccaccacacccccggcctcagatattttttgtgacccattttctgtctccagttacatgtcactacactgctagatactgtaacaattttccgggctccatttggttttttttttccttcaatattttcttcaaattggatagtttctgttgatttaactttgagttcacaaactctttctctgccatcttttgctattaagcctatacagtgaactttttatttcatttatttcttgtcagatctggaatttccatctgtttttttaaattttatgaaacatttttacagtggttagatacacgtaatgtaaaactcatcatcttactcattaaaatgtagagttcagtgatattaagcactttcatattgctgtgcaaccatcaccaccatccatctccacaatgctttttcatcctgcaaaactgaaattctatatatttggccattgttattagtttctgtttctctattgatcttgtctttattccttattcagatattttcctttaagtgctgtaaattttctctctgctaaattgcaacactgggtcatcttggtgttggtttctatagattgcttttttcttgagtacaggtcacattttcttgtttcttagcatgtctagtgatttttgattgaacactggacattatgaatgatatagagattctggattctgttatgatcttcagaagggtatttttttttcttggcatattgttaatatggcaagatttaagctctaaactcctatctccactgcattagccgtagttgaaatctccatgcagttctttcaatttccagttgttactttttgctggccccccctgggttctccagccaaggatctgaacatatatttagttgcagatttgggagtttcaccccctgtgtggctccctccctttcatggttttgtcttaactttctggctgctcttccagccctgaactttgtccctgtcactctgaaccatgccttatagggattggcatgtattcttaggcaaaaagctacagatgtataaatctcaccaagtacagttcttctctttcaagggtagcctctctttcaatttctacctgcttttgatcattctcccagtgccttcaaataatttaaaatatgttgtccaaagtttataattgttttctgtggaagggtgatgtgacactgctactctgtcactgttggaagccagatgccaagcagataccttttggggcttacgttcagatgcttcccttgttctcagccttgtgctcagctgggctgtggaggaaataggacttcttctcagggagctccattttcagctgaggagcagagagggcacagggagccctgtgggagtatcttagtcagctcagactgctgtaacaaaatgccacagttgagtggcataaacaacagaaatttatttctcacagttctggaagcgagaatccaatatcaaggtgccagcaggattgaattctggtgaggcctttctccttggcttgcagatggctgccttctcattgtgtcctcacatggccttttttcctgtgtgcatgtgctcctagtgtctcctcctcttataaggattctggtcctattggatcaggcctcatccttatggccacatttaaccttaattatatccttgaagtccctgtctctaaatatactcacattgagggttagggcttcaacctgaatttgagggtgggggatacagtttcgtccataacagagattaatctagcttctagcctcaggattttgtgagggaggtaggggagacagagttgtgttgtaccaatagcatcaggacgtgttcaatcagtcaccatgtaaatgcagaatgttccaggcatagcatgaagggctaaggattcagttagggataagactggccccatccctgccctcatggaactcacagcctaggaggataaaagatgtatagacatgacattgcagagtgatgaagtaggggacgtacagggctccctgggaacactgaggaagaggtgcccaaataaaggttaggggtcaggagaggcttcctcaagaaaatgtctttctttcttttttcttttttttttttttttgagatggagtttcgctcttgttgcccaggctggagtgcaatggagtaatctcggctcactgcaacctccgcctcctgggttcaagcaattctcctgcctcagcctcttgagtagctgggattacaggcatgcgccaccacgcccagctaattttgtatttttagtagagacgggggtttcaccatgttggtcaggctggtctcgaactcccgacctcaggtgatcctcctgcctcggcctcccaaagtgctgggattacaggcttgagccactgcgcctggccaagaaaatgtctttctaaattaaaatgcttccatggaaggatggcgtgaccaagctactctgtcactgttggaagccagatgccaagcaaaaagctttcggggcttaggatgagtgaagcatcagctgtggaagaaaagaaaatcaagcagagggaatggtaagtgtgagggaatcccgggttgagaagggcactccagaagaacagaaagtcgatgagtagaggtggagctagagctgggagaactggggaagtggagcagtgagggataaggccagagaggtaggttggggccagctcacttgttggattgtaactgcctatccctctagagagtaaactccttttttctgttctttttgtttgttttttgctttttcttttaacatttttatcgttttttatcttttatcttttttcttttgagagtaaactccttaaagacaatgaataagtctccttcagcttggtgtcctctacctggcagagaagctgtgtagtaaatgtttacaggtgccctttgttatgatttgtggggtgaggtggaaaggttgggcgtgcaggtgacttcacctccttggtgaggcaggcaagggcctggaggttgctggccatctctgtctgtaccttgtccctgtgccctgggtcacatggtgttttgttgttgtcaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtagagcctgcccctgggccaggcatcagggccccagatctagggtgtcagctggcagatactccctgagctgccgttgtatttgtggtactacgggcagggcagaggagtccaaccaagcatagtctaggtatagagtctatgcccaaggagctgctgttgggagtgtgttacgtgctgaggacagaaatggacagagcctggagcagctactgcaggctactagaggggtcagggaaagcttggcagagaggtaggatttgagatgggcctcgaaaagcacatagatgggaagagagtgtctttgggatggggatcagcagagcgaaggggtgtctagggaggcagagggcttctctggagaggatgagactaacttggctggggccagagggcagggatgaggagaagcaggagtcaaggctggactgtggggtggggaggatggcaggggaggcgaggccattcaaccctgcctggagagggactcccaggccacactgggtatacctgtctcactggggtgtctggtccctgagtggggagtccactctgctatagagcaagctatctgctctgggctgcagggctggcactggatgttctaggggctgtagagtaaatgaggaggcatgagctgtgtgacttgggccctgtccacccagtgtgtgccacctgttctgcccacagatgcccctgagtaacctgtgggagggcctgctcacatggcagagccagagtccgggtgccctctctctggggcttcctgccagcctccagcagagtcaggtgtgctggtcatggctcctctgcccatctcttcctgtcttgtgtttgtccctcttctctgtgtgtctgcttgagtcttctttatctgtacgttttactttctctgtctggtgtcttagtgtctctgaagtctgtctgtctctgatgccatgtgctgctgtcttagcattgctgcccttgaggctggacagctactgtcagtagaggtgcctgggctgggaagagggagggactcttgggatgtgacttgcacacttggggctcccagtctaagagacaaaatgagttctgaggagttccacagtttagagcctcccagtgattctgcaggtgggtgttggcccagaggggtggcacaggggctgagtcaagagacactccttcggagggtgtggagcggggctctgaggtggagtgggttttgatgtgggcatcagggcggctggatcccaggttggccaggggcttactgaggaggggcttgtgccctctgctacagcggggctttctgaggccaggggatgtggctcctcaccctctgaaacccttttcttctcccttccctgcagtcctccagggagtccagaacgtaggttgttggtaggtgtgagatgatttcagggatgtggtcaggagtgtgatttctgacacttgcttttcctgtttgtgcccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtggtaattcctgtctgcctgagctgggtctgggcagctgctctgttagccccgcaacccaaggccccaagtttcctttttcctaggagtccttcttccactcactcagtgtggggccttagtccccaaggagacatgcggctgtgccatgtggacacttggctgtggttggctcacttgcattcagggaggacagtgaggcctccagcctttgctgagtaatgctcagggattcctgacagtgcggtgagaccctgtccccaatggaagaatggcagggctaaagggtggggctggtgcgatatagcgaagtgggtcccatacctgaccacttgacagaattgccaggatactttttgaaaatatgaatttctaggttccatgtgaagccaactgaattataattccttaggtggggcctgagaatccatagtttgaaattaatacgccagcgtaaaggagcgtcggtctggggacaaggactcctgggccctgggctggccatgctgtcgtgcacaacacagcacggctgggaaggatgactgagggatggggttaggagcgccctggaggagtggcactgcacagggtttcaaagacagggtaggcgttttgtattgatttacatctcatctttttcatttcatattcttgcttcagaaagcattgaaaggggctacaatagttttccagatgaaattgggaaggaaaggttttctaggcagaggaaattgcaccatgacctaaagggaagagacgacatgttgtacttgtgcctctgggcacaattgcagttggtggggaaatgtttcatagggtcaggagccctggaagactgatgggtgatgaagctgtggacagagtaatggccagatgagaaaagaacatgcatcgtgctgtagagccacacttgctcccttgggtaacagggaactgttagtgggttttaagatgaaagaataacactaattttttttttgttagtatgtgaacgctaggccccctcctaaaatcctgctaaaatgattctctaaggaatgagatagaacagactagaacatcaataatagctttgcacgtgaagaaaggatatcaccagtggaccagacattttgaggaactggtataaagcataaaaaacagcttgggccagattggtggagcaaacaaattagagcaaatccctaacccaaaacagatgaaggagagacctgctgtagaggtacaagctttccttccaaacccccagcttggaatcagcaccgttagagagcagggtagtcattactggactgcctgttggctgggccagacacaccctataccctccccaggtatgcagagccgctggggatggttgcctctgggtaaaagaccctggaaccattctctacagaagcgaagggaagatgattctttgtgtaggcataggaaacagagcagacttctacaatggaaaaggagagagaactaaaggaaaggactcttcccagagtaaaacacactggaatactcagtgtgcttccacagagcatacttagctttcccatgcaagggagaggcctattagagaaacagaaatttactactttggaagaaaccaaaacccagacctatactagtcaacctaatccttcattcataaataagaatggagaattaatggtcaccagacatttgcatgaaaccaatgacagaaaaggaccaagatgaacaaatagaatggactctagaatagggaagtagaagctaattaaaacaaaaaggaaagcaacttttaaacaattccaatgtggagttatatgtataatagaagctctttgtctggattcccagctcccttcatctctctgtaaaacacgctaatgaaaactcgtggctgcttccgtcccactaggtgcctattctctggatgccctcctctcctcccccagttgaagtgtatgcttaggaggagtcagtgagggtcatttccaaacctgtgtaggccagttgcacttgttacaatagttacataattcgactaaagagtgtaaaaacccttgaaataagggcacaaagagagagttgtttttatggaaatgaagttgaatgcagctactgcccccaagtctgagtgttggttcatctcctccatcaatttcttgaagtccacaagctataaactaacagagaagttatctcctccctatccaccaagtttcctacccaaaccagcatatagcagtggaggaagaatatgatgagagcagtagagctcccatttggaaaaggaagaaggggaagggcccgcagctctgctctgcagcagtggtggaaccctgcagggtgggaccggtgagacgccttcttggcatgaagtaagctccttggtttgaacctgttgctgccctcagaaagagactcctgtgtgctctggcctcgtcccctgggagcttctgccttggtggtaatgctctgtggccatatctgaagtggacattagaaaatacgccctccctggtggctgcacagcttgtgccactcacttcctgcttgtgtgagcagctttagggctaaacaattgcaaacttggagggcggcttcttacctgcctcctgccactgcctatgtttgcagtgagatttcagaaatgtgtaggcttctggctgttcgcatctaatcaagttcatgtgaaagtgaccccagtcgagggtctcatcctgttgtatttgtaaaatcttcggaattttgctgattttctggtgctttctttcatgctctcaatttaatggtagttattttttaccaaatgctctgctctggcacaataaggtttgccacctttccagcctgcgggatccttatctatttccttactgcccgccattttcccactgcccaaatgtttggctgttccctcattttgattttttttgcaaccataaaacactccagccgggcgtggtggctcatgcctgtaatcccagcactttgggaggccgaggcaggtggatcacgaggtcaggagatcgagaccatcctggctaacatggtgaaaccccgtctctactaaaaataaaaataaaaaaatcaggcgtgtgtagtggcacgtgcctgtagtcccagctacttgggagggcaagacaggagaatcgcctgaacccgggaggcggagcttgcagtgagccgagatcacgccagtgcactccagcttgggcaacagagcgagacaccgtctcaaaaaaaaaaacaagaacactccagtgtcagctaacaaattgtgtattagtcagagtataggctaagctaccaaataaaaacaaaacctgcaaatacaatggctgagatgagggagaagcctccttctctctctgagaacagtcctggcatgcaggccgtgtggcgtagtgggcagtactgcctcataggatagtccagccatgacttttgtcttgtcactgtgctgtcccctgggcattgttctggtccatgtgggcagtgtgtgtgtgtgtgtgtgtgtgtgtgtgtcactgtgctgtcccctgggcattgttctggtccatgtgggctgtgtgtgtgtgtgtgtgtgtgtgtgtgtagtgtgtgtgtgtgtgtgtgcacatgcccaggcctgggaaggtggagggcaagcagttcccttttcaggaaatggggtggagttgaatgagtccccttttctttcgcacattaggaactttatcacgtggctacatttgagggcagagatgaggctccagcagggggagtggattctgctgaaatctgggttgggaaagccattctagtactaaaggaagaaatggataatagaaaccagggacagtgctttctgttgcacacttaaaacaaaatggtacagaaaggttgaaaaataaatagatggacaaagctgtcttgagaagatgcaacgaaaaccagaagtgacaatattaatagtgtggaattccacgtgcaaaagtttgcaagaaggatgtttaatattgataagaggttcaactccatactctccactaagacgactgaacagttccaaaactttatgtacaaaacagcatgacatttatatattttaagcaaaacccgttagaagtaaaaaataccatcactttagagcacgatttaaacacccctctcagaaattcacagatcaaatagacaaaaactagaaaggataagaattgaatagtgcagttaataaatttagagtatgtatgtgtgtgtatacatgtgggggcacaaaactttgtaactgacagtgtactcactctttttcaaatctctgtagagcatttatttataaaagttgatgtaaaagacatttttttctaaaattaatctataaattcagtttctatcacagttaaaagtcccagtgaatttttttgtggaactaagcaagctagtcttaaagcatacttagaacacgttcaaaaataaccaagacaagtttggggatggggaagagtagtagggagagcaccttcccagatctcagaacagtggaaaaaccacaggaatcaaagtggcacagtactggacagagacagacaaatgtgtgggctctgctagggccagaagcagacatagatattggttctgcatggaatttagtataggataaaggagggaggggaagaggcttcaaaacctgtctctatgcattgtttgggaagtaggagttagagccctatttcacactatatacagagcttaaagccaggtatataaagtatctaaatgtaaaaaagattaaaaagtgctataaagaaatagaggagaatattgatataattttggctttcctcagcaagcaaaacccaaagccgtaaagaaaaggatttaaggttttactacgttaaatttaaagtttccataggacaaatgacattggaaacaaagttaaaagaaaaatgacagactggaagaaaagattggcacacataacagatgaaagtgatcatccttgctaaattaagagcttccataactcaaagaaccaatgagaaaagtggacagaggatgagctgcattcagctctggttgggcatcatatggggaaaactccccaggaatgagcatgagtcccagcccagtcctgttgttggctagtggtccctttggagaccactgggcaaggagctatgggctttccagtcagtacttctgccctcagacccagaggcctctgtgtactctcccaggactgagactctgtcctttttctctctgcagaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaaggtgggcttttagagttcacagtgggcttactgtctactttttatcttattccagctgtgtatgtcccaaggctagagacggaggggtgagggcagggaagggaaggggcattctcagatgacccactggcccaggaagggacctcatgagcttggccggtccactcaacatcttatcacaaagttaagcaaatctggtgtggaggagcatgctggctctccatgcacatagtgctggctggttctagagagatcatttggtctcaccattgcctggggctgctgaggagtaggggaagttgcctttgatttgtaagtccctttgagagcaagttcttgtgtggttccttggtttcccccacagtgtgcacaggaaccacatcttgcccttagtgcgggcttaatgtatgtttgcctgaaatacagttggtccttgaacaacttggggtttggggttaccaaacttaaccactcctgcctatgcagccaaaaatttgtgtataacttttgacccccaaaactactaacagcctactgttgacagaagccttaccaataacataaacaacacatattgcgtggttatatatatcatagactgtattcttacgataaagtaaactagagaaaaaaaatgttattaagaaaatcatggccaggtgtggtggctcacacctgtaatcctaccactttgggaggccaaggtgggcggatcacgaggtcaggagatcgagaccatcctggctaacatggtgaaaccccatctctactaaaaatacaaaaaattagccaggcgtggtagcgggcacctgtagtcccagctactcaagaggttgaggcaggagaaccgattgaacccaggaggcagagtttgcagtgagctgagattgcgccactgcactccagcctgggcaacagagcgagactccaaaaaaaaaaaaaaggaaatcataaggaagagaaaatatacttactattcattcagtggaagtgatcattgtaaaggccttcatcctcatcgccttcatgttgagtaggctgaggagggggtttggtcttgctgtctcaggagtggcagaggcaaaagaaaatccgcacgtgagtggacccagccagttcaaacctgtgttgttcaagggtctactgcatctctggtatgaggatataagctctgccacctctcttagtcttcgatttacagtgatgaatgtcccctgaccatcagaaagttcttgtctgctccacacacactgctttggggtcacaccgtggagcctagagggcaggagaattttcttcatgtgcctgagttgagagggactcagttcctaccaggtcctgctgagcccagaggctccattcagagcaagcagggaggcagctacaggggcagggaggctgctccccagctggacatgcagcgagctgcctccattccacaccaccactgctttgttcttccaccccagagctcggagcctctgccttagcattttccaccctttctgccacctagaattccctctcccttccctgcttcaagctggccatcttgccttcctcctggaagactttccccgggatcccgcccccactccacgctcctttcgtgagcttcctcggtatgctgctgcagtttttacttgtttttatgttcgctttgattttgctgcatctgcaccgtcttggggctgatgctgtaggtgacccatctggctgagacctccccaaggaaccctcttcccctctttgggccttccatgggagctgacaggctggtgagggcttcctcaggctctgctgaagtccagagttctctgaggagctgtgagcgccatgttctggggagcttctgccaacttcattgccgacagctttggtagccatcgataggaatgatgggaggagggaggaagatttctcccactgggagcttcaaggatcatgttcctgccttgaggccagtgactacccctccatttggaaaccaaatggagagaaaagagggatgggccttgcttttgctggtgactgacagccctgttgaggcaatcacaatttggagaggaggcagggagtgggcagcatcctggttgtgccagcaaagaaaccagcttgcagtgggggcttcgactcctgctgccagacctgcattgacctggatcttccttctccttccttcctccaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggaggtaggtggctctgggtttgcttgaaactgctggtgacttttccacattcgagtctgaggtggagggaagctttgcagagaaggctcctttgagcagggccttaagggtgagtaggccttggtcaggatgagaagggactcccatggagggcttcatatgctatgccagggagtctgtgtgtgcttctgcaggcagcgcacataccggccagtcctcacggaatgcatgtgtggggcagagatcattgtggcttgcagagaggtcagtaactcgcccagctgtgtctgatgtcttgcatctagcagcactttgaggggctggcagtggcctagcagattgattatttgcagggaagagagactagacacagtggtcccaagtgtgcatgttgatccttttcctaaggtcctcttcagctctcacaggtgtcacagcgagagatgccaggtgtatctcctggctgctaggccagtgggctgaaagctttttgatcagatttcccattagtaaaaactttttgatcatatactccatatacatataactctgcaggtgatataacatactattattgtcttagtgttatatacactttaaacattcaaaaatagaaatgttaaaaggatgagataaaaataaatagtaaaaaaagctagtcttttcttcttgtatcccagtggctcgggatgctcatctggagcagaaggacacactccagtcaactaggccatcactggccagaagttaggccggagaagactgtcttgggttagtcttaaacagggccctgtcatgagccctagctcctcagactagtccaggctggttacttggaagaggctcaaagccagttttcttcaaggaagcaaggctatttttcctgccttgggaagtgacaacccctcctggtgactggaccttaaaatcttcctgttttgtaagataactgtcatctcccagatttttacctccaaatttgctccaagaaattcaagtcctttcttatctggccccacagcagctctgaggaaggagactgtgttcacttaccttacaattaagttcaaccccatctaccctggattttctgatagctcccactgtgatccgaaaccaaagggtgaaaactctagtgaacctgtacattaaagaaattttagcatcttttattactgtctaaattggaagtcttttgttggcattatgagctcttttgaacaaaactaaaaaatgtgttttaaaatcacattttagagtttagagtgctctcacataggtatgcccctatactgtagtgacgtaggcattttgttcagctttgtgggtggcaaagctgaggctcagcttcgatgatggatccgagcctctgggtggagctggtttctgcctttgttacctgtctgctctccgttacaccacacagcgtctttagtaattgacaaccagatctcaccaagcacacctactaagtatttacagggaatgctcagctgtgtggatctatgcagctgtgctttgtccctgtaaacttgaagggttgaaacaaaggttgaaaattcagagaaatacttgatctgaaaaccaagtactttgaaatttggaatttttattgcttttaattgtgagtcttacatggtagtttgaatatggtttatttttaatattttattttttttggagacagagtcttgctctgtcccccaggctagagtgcagtggcactatttcggctcactgcaacctctgcctcccagattcaagcgattctcctgcctcagcctcctgagtagctgggattgcaggcgcccaccactacacctggctaatttttgtattttcagtagagacagggcttaaccatgttgaccaggctggtctcaaactcctgacctcaggtgatctgcctggctaggcctcacaaagtgttgggattacagacgtgagccaacatgcctggcctgaatatggtttaattgtgagtacagatacctagtgacaaatttcagtgacaatccaaaacacctattgtaaatcacagatcccatttccccagagaactgtggaaaccaaggtaaagccttggctttgctaccaatgtcaggatcttgtatatatgagatttttgccactctctctccaaaaaatagtgtgaggagaaccacagactatgatcccctgcctactctctctcctttcgctgggcacaggcaagggaagggcacacagaggtggtaacactgctttctctcctccacatctagacaagtgtggttaactacattgaccagaggccagctgccaaaaaaagtgctcaattgttttttgtggtctttgaatggaaagatcctttcatccagaaagtccaagatgtgagtatttaagattatgatagtattatttaagattatgatagtattatttaagattatgatagatgtattatttaagattatgatgctgccctgaagtcttttggctcattcttgtagactgataagtctacctacctgtcctcatcttttttcatagcacaaatcagcttgtaatttatatttatgacatcaatgttatatattctttgtgtttggtcttgtcttcatcactagactttctctgtaaaggagggggactttcattttgctcaccataatttatctgggatatagtggagtgcttagtgcaaagtagctgcttagtagtaatgttcgttgaataaattgagtagaaagcattaagttaccactatacaggttactgcagttgcaagttattctttttcttaatggttccctgtaggataaatactacttgtagtaagaacataatggtacaaataaaatattaacaaagcattaattaatgccatattttaaaaaaattgatacataatatacatatttatgtggtacatgtaatattttgataaatgcagacaaagtctaatgatcaaaaatcagggtagttgggttatccatcatctcaaacatttataatttccttgcattgggaacattcttctagctattttgaaatatataatacattcttgttaactataattgctctactgtattatcatgtcatctatcttactgtatttttgtacccattaaccaatttctcttcatctcctgcttcccccaacccttcccagcctctggtaaccaccattttactcgctacctccatgagactcatttttttttaagctcccacatgagtgagaacgtgtggtatttgtttttctgtgcctggcttatttcacttaacataatgttctccagtttcattcgttttgctgcaaatgacaggatttcattctttaatggctgaataatattccattgtgttttatatatatatatacacaccacattttccttatccattcatcctaagtgttgatggatacttgagttgattccatatcttggctgttgtgaatagtgctacagtaaacatgggagtgcggatatctctttgatacactgatttcctttttttttttttttcttttcttttttgatttcctttcttttggatatgcacccagcaatgagattgctggatcatatggtagttctagttttagctttttgaggaacctccatactgttttttcatagtgagtttaataatgtaaattattacattcccaccaacagtatacaagcattcccctttttccacatcttcaccagcatctgttacttactgtctttttgatagtggtcattttaactgaggggaggtgataaccttattttggatttggtttgcatttccctgattgattagtgttgttgagcatattttcatatgccttttggccatttgaatatcatcttttgggataaatctctattcaaatctcttgcccattttaaaattgaattatttggctttttttgctattgagttgtttgagttccttatatattctggttactaatcccttgttggatgcatagtttgcaaataatttctctcattctgtaggttgtctcttaactttgttgattgtttcctttgctgtacagaagctttttagcttaatgtaatcccatttttctgttttcgcctttgttgactctgctttttgaggtcttaccaaaaagatctttgtccagaccagtgtcctaaagcattatcccagtgttttcttctagtttcataatttcaagtcttagatttgagtctttaatctattttgagtggatttttctatatagtaagagataggggtctagtttcattcttctgcatatggatatccaattttcccagcaccatttattgaagagattatcctttcccaattgtattttcttggtgcctttgtcaaaaatgagttcgttgcatatacatggatttatttctagattctctgttctgttccattggtctatgtgtctgtttttatgccaataccatgctgctttgtttactataactttgtagtatattttgaagtcaggtagtgtgatgccttcagctttgttctttttgcccaggattggtttggctatctggggttttttgtagttccatacaaaatttaggattttttttctacttctgtaaagaatgtcattggtattttataggaattgcattcaatctgtagattgctttgggtagtgtggacattatgctagttcttccaatccatgaaccataggatatttttccattttttgtgtcctgttcaattttttcatccctatttttacagttttcattatagcgatttttttacttctttggttaaatttattcctaggtattttatatttttatagctattataaatgggattgctctcttttttattttattcttgcattgctataagttttttagattgctcgctgttagcatatagaaatattcctgatttgggtgtgttgattttgtatcctgtgactttactgaatttatcaggtctaccagttttttggtggagtgtttaggtttttcaaaatataagatcatatcatgtgcaaacaaagacagtttgacttcttttcaattcagatgccctttatttctttctcttgtctaattgctctggctaggacttccagtattatgttgaacaaaaataatgaaagtaggcacccttgtcttgttccagatcttagaagaaagactttgaatttttccccatatgatgttagctgtgggtttgtcatgtatggcctttattgtggtatgttccttctatactcagtttgttgagttttttgttttttttttgttttttgttttttgtttttttttttgacacagtttcattctgtctcccagcctggagtgcagtggcatgatctcagctcactacaacccctgcctcccaggttcaaatgattcttgtgcttcagcctcctgagtagctgggattacaggtgcacatcaccatgcccagctaatttttgtatttttagtggagatgaggtttcaccatgttggccaggctggtctcaaactcctgacctcaagtgatctgcccacctcggcctcccaaagtgctgggattacaggagtgagccaccatatccggcacattgagagtttttatcatgatagtatgttgaattttattaaatgcttttttaccatctattgaaatgattacatgatttttgttcttgattctgttaatgtgatgtattacatttattgatttgcatatgttgaatcatccttgcatctctgagatggatccctcttgatcatggtgaatggtctttttaatgtattattgaatttggttggctgatactttgttgaggacttttgcatctgtgttcatcagagatatcggcctgtagttttcattttttgttgtgtctttgtcttgttttggtatcagggtaatgctggccttgcagaaccgagtttgggaatattcttcaattttttggaatagtttgagtagaattgctattaatttttttttaatgttagatagaatttagcaacgaagccatcaggtgctgggcttttcttttattactgcctctgtcttgttactcatattggtctattcaggttttctgtttcttcatggttcaatcttggtagacaatgtatccaggaatttttccacttcttttaggttttcctttattggcatatagtttttcattaagtctctaatgatcctttatattactgtggcatcagttgtaatgtcttttattttggtgtgattttatttatttgggtcttcattatatttttcttagatagattttgtttaacttagattttgtttaacttttcaaacaactaacttttctttcttttttttttttttttttgaaatggagtcttgctctatcacaaggctggagtgcagttgcgatcttggctcattgcagcctacgcctcctgggttcaaacgattctcctgcctcagcctcccaggtagctgggattgcaggcacccgccaccatgcccagccaatttttgtatttttagtagagatgggtttcaccattttggccaggatggtcttgttctcttgaccttgtgatctgccggcctcagcctcccaaagtgttgggattacaggtgtgagccactgcgcccggcctcaaacaactaacttttcatttaagtttcagtttcatttatttctgctctgataattattattctgataaatttgggtttgttcttttctcgttctttgaggtgatcgttagcttatttgaaatctctactttttttgatgtaggcatttattataaacttccctcttagtactgcttttgctgtatctcataggctttggtatattgtttccattttcatttgttcaataaatgttaaaatttccttcttaatttcttcattgacctttggtcactaaggagcatcatgtttaatttccatgtatttgtacagtttccaaaattcctcattattgatttctagttttattccactgtggtcagacaagatacttaatatgattttaatttttctgaattagttgaaacttgttttgtggcccaacatatggtctcccctggagaatgttccatgtgctgatgagaaaaatgtatattctgtagcagttggagttttgagacggagtctcgttctgtcgcccaggctggagtgcagtggtgtgaactcggctcactgcaagctctgcctcccgggttcacgccattctcctgcctcagcctcccgagtagctgggactacaggcgcctgccaccaggcccggctaattttttttgtattttttggtagagacggggtttcactgtgttagccaggatggtctcaatcacctgacctcctgatctgcccaccttgatctcccaaagtgctgggattacaggcgtgagcctccgcacctggccagatgaaatgttttgtaaatgtcagttaggtccatttggtctagagtatagtttaaatcccatgtttgttgattttctgtctagataagctgtccatttttgtgagtcggacgttgatgtcccctactattactgtattgcagtctgtctctccctttagatctattaatatttgctttatatatgtggtttctttgatgatactggatgcatacatatttacagttgttgtatcttcttgttgaattgactccctcatcattacataatgatatttgtctctttttccagtttttgacttgaagtctattttatctgttacaggtatagttaaacctgtttttttatttacatttgtgtgggatgtctttttctatcccttcactttttttttttttttttctgagatggagtcttgctctcttgcccaggctggagtgcagtggcatgatcttggctcactgcaacctccacctcccgggttcaagtgattctgctgcctcaggctcccaagtagctgagattacaggcatgcgccaccacacctggctcatttttgtatttttagtagagacagggttttgccatgttgaccaggctggtctcaaactcctgatctcaagcaatctgcccaccttggcctcccaaagtgctgggattataggcataagccatcacgcctggcctgtctcttcactttcaatctgtgtatctttacaggtgaactatacgctgtatggcagcataccgttgggtcttgttttttaataaattcagcaactgtgtcttaagaatttggtccatttacattcaatattattactgatagagaaggacttactacggctatttcgttttttgttttttggttttgtaacttcattcttcttactgtctttgtggataaatgattatctctttaaattccttactttttatttttattatatccattataggtttttgctttatggttaccataaggcttataaaaaacatcttgcagttaaaacaagttattttaaattgaggacaacttaactttgatcacaaagaaacaaaaaacttttaaaactacacttcaactccatactcctcacattttgactttttattgtatctatttatatttttgttttgcctcttttttttttttttttgagacggagtctcaccctgtcacccaggctggagtgcagtggcccaatctcagctcactgcaagctcccgggttcacaccattctcctacctcagcctcccgagtagctgggactgcaggcacccgccaccacgcccggctaattttttgtatttttggtagagacagggtttcaccgtgttagccaggatggtcttgatctcatgaccttgtgatccgcccgcctcggcctcccaaagtgctgggattacaggcatgagccaccgcacccggccaaggccattgactcttgatttacccttttgaggctattttctagaccttgtgagtgttcttcattcttttttttttatttgtgtattttcatataatttgtctttaagctcactaattcttctgcttgatcaattctgtgtttgaggcactctgatgcatttttcagtctgttaattgtacttttcagctctaggatttttatttgaatttttaaaaattattttaatctctgttgaatttctttgataaatttctgaattgagtctttgtgtttcattgaagttcctggagtttcctcagaacatctattttgaattccctgagtggtcacacatctctctctcccggattggtcactggcaccttagtctgtttgatgagattgtatttctctgaacttttctggtgcttgtgtacgtctgtctatgggcattgaagatttaggtgtttatttcagtcttcacagtctgcccttgtttatacccatctatcttcaggagattttctacaaattgaaaggtgactgatgatgagttccctaagcgtgtagtcagtcactgcagctgtttcagcactagagggcagtctaagccaagttacactgtgactatcttgtagacttctagatatccagccctgatgtacttggggaggatcagagagaatgccctgggggttcccaggcaaagtcccttatctttccctcaaggggaaggagtctctctgctctgagttgcctggagttggggaggggtaaggcaggtactcccatggctgtcacagctggcaccaccctgggtccctcctaaaccaatgcaatactggggtttgcttaaggccactttagtcagccagtggtgaagctggctggggtttgggtccatcctgctagggtggccgattgccttttggccagggtgggtttagaagtgccatttgggagcaatagcctataattaggggattcgggattcttcctggtgctgtggcagggctggtactaggttccaaggcaaagtccctcatactcttccctctcctttgcccaagcaggagtgttccaccatgctgcactgcctggagttgaggcagctggtgtcatgctggatcacaccccaaacccacagactcccagaccagtgcagtatcagagctgtggttgctatggcctggctgccactgaaattatttggggcctaaggccactttagtctattgtaaagtgggcccagacttggtttcctcccactggggtggtagatgcccctctgatctggggtgggcctaatactcttttcacgggctctagcctggaatcagggcctcagaattctgcctggtgctgttttcccttgtgaagttccaatgcaagttccagactcacttccctctcccaagctcacagattctctctgctgcactgcctaaggttgggggaggggtgtgtaggcagcgtgagaccctcctttctactcttcttcagtgtgtcttttcctgttattatactaaaccagatactgtgatctctcacctggttttttggctcttgtgtagatactttcttacatggatagctgagtttggtgttgctgcagaggactatcgctggagggttctctttagccatctggctccacctcctctaacgtcaaattctgactcatgatcttggaaggggaggaataattggacagctttgctaaaggaacatttaagacacaccgtccaccagagccaggcctaaatctagtattgattggcattcatgtcatcataatatatcctgatgtgatcatggcttacaggaaacagtttcatagctgagacccaaacgtgtaagcttccacccccaggtggggattctgtgatacggatgtgcttgctctgctatcacccactaccactattaattatggactggcaaggctttgtatgaagagggatgtgcagaggcttattgaatcaagactggggagaagggcttgcagctcgttgtgtaatgtgtgataaaacattttttaacctactatattcagtatgaggtacctattatgggccaagtggagcccagtacccgaggcatgctttactcagcttcacagcagtcaagtggtggtatcaccattttcatatgtgaacaatgaaatgcatactaaggtcaccctgctaaattgagcttagaagtattttatttgggaggctgaggcaggcggatcacgaggtcataagatcgagaccatcctggccaacatggtgaaaccccgtctctactaaaaatacaaaaaattagccggccgtggtggcatgtgcctgtagtctcagctactcgggaggctgaggcaggagaatagattgaacccgggaggcggaggttgcagtgaactgagatcgcgccactgcactccagcctggcgacagtgagactccatctcaaaaaaaaaaaaaaaaaaaaagtattcttaccaggttgtggaagtcagaaatccaagataagaactctgccttaaagagttacaactctgccttcaagagttagtgagagaacaatcctattgttttaaattattgattccagaccataaggaactgtgaagggcattcataggataaatagctctgctgaagtccagaaagggttttagcttagtggtcagggaaagctctgagactttgaaggatgagtaaacctagacaggaggaaagcatcgtagatggggaaaagagcagaggactggaggcaggaatcctcctctaagtttgggaggaaagacagccattggactagaaatgaggaaacacttgaaactatggtaactatgagatgggaacaagaggagctcaccttcttatggactgggtatagttttagggaaattcatctcaaagcaaggtcacttattgttggattaggccacaaaattaaatattgcctatcttatttgtgcagagcttttttgaaaaacagctttctttcagaatcactttattatagggaggagtcagtatttttctcctcaaactgagctatggacattaaaagtatagtctgaatgaagtatatagagttatgacagtttcagaacccaggtatttttcttatagtcccaataatttgggaagggctcttgataataacactactaaacatacaaaaaattagccaggtgtggtggcaggttcctgtaatcccagctactcgggaggctgaggcaggagaattgcttgaacccaggaagcggagcttgcactgagccgagattgcgccacgcacacaagcctgggtgacaagagcgaaactccatctcaaaaaaaaaaaaaaaaaaagaatcaagactgaagcaaaccagtaatcctgtttgtttctgtttgcttcacagatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctgactcccaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggcatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaagaaatattccctgccacttttctgctccacagaagcatgagaattcaagttttagcctaggtctctttataaaatcttattttattgcagggcaaatgcaaagccaggcataaaagcttacattaacagtactgataaaaaggggagtgaaaaaggggggtgtgtttttttaaagcatgtctgacaatatgtcactttctctttttttttttttcttttttttctttggagacagagtctcactcactctgttgccaggctggagtgcagtggcgctatctcggctcattgcaacctctgcctcctgggttcaggtgattctcctgcctcagcctcccaagtagctgggattacaagcatgtgccaccatgcctggctaatttttgtatttttagtagagacagggtttcaccatattggccaagctggtctggaactcctgagctcaagcaatccacccgcctcagccccccaaagtgctgtgattacaggcgtgagccactgtgcccggccagtcactttaatattacttaaatagctaataaaatttgtttcaatgaacatactatattatctgtattgtagaaagttgagnnnnnnnnnnnnnnnnnnnncccgcctcggcctcccaaaatgctgggattacaggcgcgagccaccgcacccagccaataatacctgatttctaactgtgccacaggctccctgctcttcactagaagtgctatttattatggattatgaaaaattagcttcaaagtaaattaaacccatcctcttaacatacaaggatatgaaagatgatggaaagatatcctagaacttagaattttatgcgaatattctgtcaaacatattttggtaaagggctaaaacactcaaccttggcacacaatcttcctatttttaaattagacttcgtcccacaatttgtcttaaaagtttctataaatacacatatgtatgtaaaaaggggggcagacttctcctgtatgcctaagcttagagctaaaagaagcaaagatgacataaggcaaaatacaaacatagactttattaaatgctgctcaatcccccaatgaagatctttcattacaaaacagttttccacacaactgcaagttaagagattggaatggtactctgataacaaaagatgtgagaaatacttgaccaagtaaaaacatacaagacctctatatagtcaaccttttcagagctctacagaggaagcctactgcagttcctttaaataaagccaggcagtgacaactagtgctctgtatcaccacactgtgggactcaaagcctccatccctgggtcaggagggactaggtgaaggacaggttgtgaggactggaaaggccctgccttcagcctttgagaggaagaggaggaatgaattgagaggcaagctgggtaattcacctgagctgcctctacccatctgttaccactctggagaattgcagaggaagggggatattcatgaggaacaatctgaagaattttggtttactttcccagcttttatttatattttgtgctttaaaaagcctggagatttaaggttttgcctaaattccagagtacagtaatgtatttattgagggaggggttagggcaggtaattccccccatcatatttctgggtgagacaaagagaagggtaaggatgataccttagttttattttaggaagtattttttcctaggatgtaactaaggtttgcagcagtgtgaaaagcacattataaaagggaaaaatatacagagcagactaccatatctatgtgcaacacaatcaaagaagaattcaagtcataattcttaccactcccataattatctcactcatatcatagatgataaaattcattcatttctgtgaaacttcagaagtgacacaataaatccaatgattagacaaaggttacaatatactatggccatgatacagcacagggctacgtttagtccatatatttttccatttacagttgccagaaaaaattggccttttaattatattatactgatgaggtttgttttgtaatttttacatatttcaaaaaagcatacaaaactctgcctatccggcagaggtgggaggctttttttttattcggcacttgtattgctgagaatactgtgcatgttgtaagcactattctgtttttctagagctttctttagctttagctcctctaattttttccataattcttcacgttccaattccttctttttctctctgtagataaaccaaaatttttgtaatcagaaattatttcagaacccaaagagaggtgctgtttgacagcttactggagaacacattacttacccacatttcacttaaatccctctgctaaagctttggagtccacttacctggagcacctaatttcttcttgtcactctcctaaatgtactgagtctgtgcatctcctgtaccagctagacgttactacttgctttctgtcccctacacattatcactaccatgacactgtactttatagtcaacaaagtacttacacgtcaattttctcacgtaaacatcttgcagttgtagtagtctaatcagtattacaaaggctgaaggggctggccactaggtcagtaggaagcacttccttcaccacaccagacagaagccacatcatttttgccactaacagccacatctctagccactaaccagtttgtatcttactagctcctcttttacatgtcaaatgaaaactttagtttcagtaatctttctctagaacaaaatgaaggtcaaaatatttcatatgtcgtttcaactaattaatttcagttctaaggaaaacatttctgagtaacttgaacctgtctattctgaaaggctccatgaacatgtaaaacataggcttataattctgcagttatgagttaaaaggacaaatccttttaaaggatttgctgatttatgcaggtaagaaatgatgagtatattcttagtcatgtgaaatacatatttttcaaatacaagtttcctatgatcctagtcatcttattttcttcccattgcttcctgaggctcaaaacatgtacttaatttctattcctgcctgaatgctgctatttaaaggaaataatgcattgagttagttattaatgggctggatggctttgaagaaaggctatccattttctactttaagataaccataactaggaacttgtcaaaatagatagcttttctaaacagaacaggtaatatgcttattagaagtaaatggtaactgttatcctcaaataatgggtgggctcaggtacactggttactaaccacttaagtttaagaaagtgcttcttgagtttgaaataaacatatgagaagaaagtaactcttgaaagattattttatagtaatttatgaaattctcaaaaagaggtaatcactaggccatgttcctaaaggctgatacgtgctaacatttatactctaaaatacatattattgcaaggacaacatattaatagtaccctaagccatatcattatgtgacttccctcttcccaaaggagaactatgctgactttaaaataccaccttctgataatccacagcgtaagaattacctactgctaacaaagaacacttgaaaagtaaagctcactctggaagcccacgtggacaaaaaggattttcgtaaatgcatggataaaaaatcaaattgtacaaattgatatttaaaattcagcataaattatatttcatatgcagatgctaacagactgaggaaatctaaggctcagaatgagataaacaggatttatgatccacattaaaatcataatctaaccatttagaggaagtaaattatgtaactaccctcaaaaataaatgctactgctttttctgctttaacaaatttataaaaatactggggctagtttatctggaaatgacttatatgttaagagactttcacattgtaatgtttactataaggtaattaacttcttaaatatgaaaatctgaactgagagaagataccttcctgaactgaatcacattcaactaacataaaatgtatagataattttgtaattcaaaatatcaaatacctctgtctttcagctttgtatgagctagtaaggtcatcgaaaagcttgccattcatttccattagggttttcagcacattgtataccagtgctacaatggtcctgaaatgaaaatgagccagtcctgagttatgatactgctaacagagaggaaatgtaacactatggtctctaaaatgggttaaagcttggctgatttcatttaatccattttagagatgataaaactgaggctcaagaggtttgtaatatgctcaaggtcatacagcaagtggtggtagagacagtctaagaaaacttaaatcttttccattttatcatgcttacattaaactctagttaaaaatgttcactatagttatcttcatttctgctttacagtctcatgtctgaaatcctgagtaacaacattaaaagaagatgaaaaagatccaattaccaaaacttatgaaaagtagaaagccggataaggatgttaaagaagttagaatatattacccttagcacttcggctttcccctgggacagtgccatttatagaggggagactatacactgagagtagaccaacacaactctgcattaacggagtagtttgtgtatcctctgcaaatgttcagttggtctccccaagagggtttgaccacaacctccagggagatttgcaattttaaattgacatgaaggctgggcacagtggtacatgcctataatctcagcactttgggaggccaaggtgagatgatcacttgagcccaggagtttcagtccagcctgggcaatatagtgagacttcaactgtccaaaaaaaataaaaataaaaattcgctgggtatggtggtgcacacctgtggtcgtagctactcgggaggctgaggcaggaggattgcgtgaacccaggagtttgaggctacggtgaggtatgattgcaccattgcactccagtctgggcaacagagcaagactctttttttttttttnnnnnnnnnnnnnnnnnnnngcccttaaatatagcagtgaaatatcttgtaaagctttcttgcatttaattaattctcattttatttatttatttatttatttatttatttatttatttatttatttcattcttttgagatggagtctcgctctgtcgcccaggctggagtgcagtagtgggatctgggctcactgcaagctccgcctcccaggttcacaccattctcctgcctcagcctcccgagtagctgggaccacaggcgcccgccaccatgcccggctaatttttttgtatttttagtagagatggggtttcaccgtgttagccaggatggtctcaatctcctgaccttgtgatccgcccgcctcggcctcccaaagtgctgggattacaggcgtgagccaccgcgcccggctgtctctaaaaaaattttaaaaataaattgacattaagaccacatactgaacaaacacacacatttataacttgataaaggtatacgtatataaaatacagaatagaatacaactgatgttaaccttggagtaacttccaaatctgtaataggtttcaagtatgagttaggaaatcaataacaaaaagatataaaaaaaaaaaaagaaaaaaatacgacctatataaaagatacttacggattccagtgttctttggaaattttgtacaaactggcaaacataattggcagaattttatcaatgttctcctcaatcaaactaagaatatattcgttattccagaagtacaatgccctttctgcaacctaaaaaaagacatttagagaaatgtcaaaactaaaataggaaagaaatactagtgtaaagtaaaggcttcactgaaaacatcatacctgaaaatgagaactggatacacacttggatatctgcttgaaaagtggctcttcaatttttttgaactgtgttggttcaatgacatctaagatttcttcaatttctcctaaaaacatcacctaggttaaaaaaattttattttaagaaacatgataaattatgtgaaactaatatagaaaccatacaaatgagaaggttaatctgcatagtatacaataggcaaaaaaatgtctggatggcagagtttactatagcacaggtcttctaccaagtctgtgtacatctcccgctctttagcaacagcaatacagccagcccaaagaagcatggtttatagccctgggattgacaagttctagtaaaatgcactacatttagtgaacaaaacccacctctttctgactgcaggtttttggccaaaatttcagcagtcctctgatcacctgcgaaaaagaaaaagtttagcatgaatttaataacaaagctagttaatcccagcgtattttccatagctgtgattatatcaacactcattctgaagtaaatcaatattgcttaatatatgtgtataaatagactttctgctcagctttagaattttattaattcaactaacatttactgggtgcctattatgtaccagatactgttctagatgctagggacacactgatgtacaagacagatgaggtctctggttttcacagagcttacgttctaatggaggaagaccaatgcaagtgatcaattaaacacataaataaaacaatttaatagtatgtgctacttctaagaaaataaaggaaaatataagttggtggggtgagagagggaggttattttagggagaaaccttaaggaacagatgattcctgttatttaaaccattatgaaacacaaaaaaaaaccctggacagcttctcagtctatttcatggctagcacaatctttataaccagaatacaatgaaacaaaagagactatttttatttatttatttattttgagatggagtctcactttgtcgcccaggttggagtgcagtggtgtgatcttgactcactgcaacctcggcctcccaagttcaagcaattctctgcctcagcctctcgagtagctgggattataggcgcccaccaccacacccagctaatttttgtatttttagtagagacaggtttcaccatcttggccaggctggtcttaagctcctgaccttgtgatccaccagcctcggcctcccaaagtggagactatttatttaaataaacaaagttgaaaacacttgcattaaactgaatcacaatagaagaatgctatatgcctaattgtaacttattccagaaatgccaggatggttccattcataggttaaaaggggaaataaaaaaaaaaaacccagatcattttaaaagattttcaagtcatttgacatttttaattgactatatattctgataaaaaaatttagtaagctagaactaaaagaatttatcagaaaccaccagcaatcattctacataatgatttattagagacaggctgtaaaaccatctaggcctggtggttttgtggaaatagatctttgacagctttttaggttactttatagtctgtctggtccagtaatgtggaacactaattcaaattaaaattgggaaggatactgttttggagacaatccagtaagataacaatgtgatgaataatgttggaaaggaataccagaattacacttatttgtgtaactgtatatttatatatcccttaaaacttaaaaaaaaaccctgcaagttactagagtgagtaggaaaattcagtatgtggccacattaaaaaatatatatataaaaatcaatacctttataaaacatcagtaaaaatcagatgaataataaaaaggtacttttcacaacaacaactataatgtgcataaagaataaatttgcaagaaatacttaagacatatggagaaaagcataaaactttactgaagatcatagaagactacaaatacagttatatgtcatttaatgatggggatacgttctaagaaatgtgtcattaggcaacttcatcatttaaatgtcacagggtgtacttaaacctagatggtatggcctactacacacctaggctgtatggtgtagccttttgctcctaggctacaaacctgtacaggatgttcttgtactgaataccgtaggcactgtaggcagttgtaacaatagtatttgtgtatctaaacacgaaaggtacagtaaaaatatagcattataatcttatgggatcaccatttttctttctcttggaatcacatttctctctctctctctctctctcaacatttctctctctttttgatgaggcctcactctgttgcctaggctggagtgtagtgacatgatcagaggtcattgtaaccttgaactcctaggcttattgtaaccttgaactcctaggcttaaatgaccctcctgcctcagcctcccaagtagctgggactacgggtgtatgccaccacatctggctaattttaattttttactttttgtagaaacgaggtcttgctctgttgcccaggctggtcttaaagtcctggcttcaaccaatcctcctaccttggcctcccaaagtgctgggattacagacatgagcaaccatgcccagttccatttttattttttaagagacagtccagacttgcattgtcggccaggctggggtgcactggtgtgatcacagttcactgcaaccccctaggctcaagagatccccctaccccagcctcccaagtagctgggattacagtcctgagccaccacgcctgtctgggactgacattttatatgtagcctgttatttttatttatttatttatttttgagacagagtctcgctctgtcacccaggctggagtgcagtggcacgatctcggctcactgcaacctctgcctcccgggttcatgctattctcctgcctcagcctcctgagtagctgggactacaggcgcccgccaccaggctcagctaattttttgtatttttagtagagacggggtttcactgtgttagccaggatggtctcgatctcctgacctcgtgatctacccgcctcggcctctcaaagtgctaggattacaggcttgagccacagcgcccggcccgtagcctgttattaaacgaaatgtcattatgcagcacatgactgtaaataagtgaggtggttcaatattgtgcagagatatttttcctgtacttaatttataagtaaatttaatataatttcaatcaaatgccaattgaattattttttggaactagaaacatttattctaaaatccataaatataagcaaataagaattgtttttttggtggggggagttaatggaacagaacctgtattatggatatcagcaactaaaacaagattatattggcaaagaaatggagagaaaagatatatatgagtatctagatatactcatgtatatatggattttaatatatgacaaaggtggcctttcagttccatgggaaacagtggtggtactgggacaggtagctcactatttagaaaggaaaaatgtagcaggctcctttggttggcagacttctatgatgatctcatgagcttgttaactgtcctcacacccttgtgtaatcccctctccttaagtgtgagctgtcctagtgacttgcttctaacgaacagactgtggcaaaagtgaaagaatgtcacttcatgagtaagatacaaaagattgtgacttctgtcttactagtagactcgctgtcttggctttgatgaagtaaggtgccatgctggagaagcctgggtgacaaggatctgagggtgggctctggccaacagccagccaggaactgaggctctcagtccaacataacttgacaaactgaattctgccaacatacatgtgaacttagaagcagatccttccccatctgacactttatatgagactcaacttctggccaacactccaactgcagctttgtaagagaccctgagcagagggccc

SEQ ID NO: 353 - DNA, 2430 bp, Homo sapiens
atgcgccgagtatcgccacgcctggtctctgggacgcccctccggaccggtttcgcctcgcggagccggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctgactcccaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggcatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 354 - protein, 381 aa, Homo sapiens
MRRVSPRLVSGTPLRTGFASRSRCAEALVSAMIRQERSTSYQELSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 355 - DNA, 71251 bp, Mus musculus
  misc_feature (1)...(71251): n = A,T,C or G
atcccagctctggtggatctttaagtctccagagcagagcagtgccctggggacactgtggaacttttgggacgagagtacattctttccactcctgcagtgtttctgagagtacctttttgcatacacggtgtcctgactaaatctgttcctcacttgtttcactaagggctgctcctggccttttagcttttgccaacagtgaagcatatttttatcttctataaagtgaggccggacaagccatggatgctttccacagccctttccagacatgtcaggaacacgctaggctctcactgggggcatgtgcagtgggcttattagactcactggtggacaggcatctggtgactggcatgtcattccagcccagggctgtgtgtctggctgccttgtcttgcttcctgtggaaataaccccaccaaaccagatgtggcatgaaggctcctggagaggcttgatgtaagaaacagctctgagatgcctgtcctcgaggctcacgggaaagaagccatttgtctcaacatcctgtatgatgtggttcatgccgtgaccgagacaatcccggtggggaatgtgctggaacacagtgagcctttgttcagtcattttctcttctgccttcatcgcttttcatgtcatgagagccggtgctctggagtgtttccctttttaatcttcacccctaaaatgaagctttatgctctaaatagtgttgtgtgtcccacccgtcccatcctatgctggtgaccaaatccatgcttcaccactgagctacacccacagacctctgcttactttttaatttgagacagctttttttttttttaatttttaaaagatttatttatttatttaatgtatatgagtgctctatctgcatgtatactttcttaccagaagagggcatcaggtcacattatgggaattggactcaggatctctggaagaacaaccagtataaactctgagccatctctccagccccatgttttgttttttaaattaattttttttttttgagacagggtttctctataattctggctgttctgggactcactctatagaccagactggccccaaactcagagatctgcctgcctctgcctcttgattgatgggatcaaaggtgtgcatcaccactgcctggccggccggcgggacaagctttattaagtggccctgcctaggctcagctgaatcgactctgtagccctgcaggccttgagctcactcttccatcgcagcctcccagtacagctttcaaaggtcccatattaatacttcagttttttctcatggatgctgcaaatatttgaaaacacatttgtagttaaatatttaagttaccatggcacattgctgactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtttgtaattaatttattgtgtgtgcttgagatagaatctcatagtgtagccctatcttgcctaggactttccatgtagactagagtggccttgaattcacagagatctgcctgcctctacttcccaagggctgggattacagatgtggtgccaccttgcctggttttggtttttattgaaatgtaataatgttaatttttgtggggctggcataattgtatgtactaatgaggcacggtgtgacttttccacacagtgtactgtcagcactggccagcctagggtaaacgggttcaccttaccagtgggttctcagtggcaatgctgatgtcatactggtatctgtgtctggcatgaacattggccctgtatcagctgcaggatgccttggagagggccgttcagttgctcacaggctctcagctttcagcagtgcctgggaggcagatgcttagcaaagcagatctttatgaagtatagtaagccagaggaaagtgcttgtccataaagcaggacccgagaccaggggggtgggtgctggtgtccttcagacatgatttagtgtcagcgaagaacctgtgtgggaacagaaaacacgtgggaaagggtgaaggggccgtctgactggaagagacaaggctgggggtggaggtgggataactggataggtccagtgagtgagcaaggaagagagcccaagatggatgctgctggtctacctgctgaggacacagaaactcttcaagccactgcagcatgagcccaagaaatcttgtctgtctctgatgtggctcttgagctgctgttgagagctctggagcagaaggcggaaaaaaccctggaaaactgcacatgaatccagatgttaggtgatgcctgggtgcagtcagagcctgaggcggaacctgaagaagagaataaacctcccaggcccaagctttggcccaagcagctggggaacaagggccactgccaacgggcgaggtgccggggagggctgtgagctgtacctgggacaaggagggacctgtgctgaaagagtgctgtgtggtaggggtgtgagtgacaagaagctgagcaccaggccttcagtgcccattgagcagtgggtcttgccctggctccctgcagggagggagttgattgggagcaggcagagacctaagaacaatggcctggggaatagccctgcaggaagcctaggcacagtgtgtgtggtatagggccagccctgctggagagaagccacggtcctagagctggagcagcctggtaggaaagactgacactcagggggctcaggaacagcaaggagggagcaaatggagggagcactgagtgccctggaacacttggcaccctggagggaggcctgggggtggggcaggaaagcaaggccatctgtggggccctggtaagggccagtggaggtagtgtgactgacacacacactagtccaggagttctgaggagttcagtcaaggtgcagggaggggctggggatggggcgggggctgtggtgagatgggttaaagagggcctcactagataattagactggggcttaagcctctaggttcaacaaccagcgctggggaaaatgtttgaggtactgttgggatttgatgcctgtgctaactctgcatggaactactctgacctagagacactaagcaaccaataactaattagtaagtcctgcggaggtacgccactcagatcctgggatctctgcctccccgagggaggcagcttaggtttaaggtgttctacccaacccccaggtactgccgtgccagcttataggtacaggaagacatacatgtgcagttcctacacactgacctgggacttcccactggtgtgcctttctgtggtgtattggggtagcatgattaaatcattctttcatgttaacacgtggtggggccacccctcaccttgctgtacccctgctgagtgcttgggctgtggctttggtggactgcactttttccacgtgcaccctggaagcttcagcactctaaatggtaattgcagttggagtctttattgaacattagtcttagtccagctgttttattacattaggactggattctccccaggccttctgagaaatggcaaagctaatttgccaaaatggcaactgcgtgcatgtctctctgttccagttttcttgggctgcttgccctagtttttttttctattgaaaccttcactgttagcagaattttaaatgtttttatcctggcaacaggagcatttggataaacagcgaggaaggagggcagtggtgtccttgtttggaggaggtcagagttcagggttttatagtcggtccagagtgttttcctaagccatttgcagagcttttaggaagcaggaaggtgccggggttgggcatttaaaagcctcttccactggccccttaggagaggcaggcacagctcatggaatctctgggttccggccatttgtgaataggccacagagccagagtaagcgggtgtagaccaggcagttgttaatgttctttttgacaaggctgtctgtagcaggtggcctggatacagggctagatgcacacatgtgaggaactggtctcttcctctacatcttcgcttttcacggttttccatgtttgggcctagagaaggcccaggctgcacaccagttccctctggaggagagtccccagaggcttctgcacttgggtagacttgtaggagtgtctaggcttttgacattgtgacagatgtagtctgttatctatgaggttcatgtataaaagccatgcaatcaaagcgaagcttgctgtttgaagtgagcacttatcactccccgagggtgaatgtggcttgtgggctgtgggttgaacaggtcttggagctgcacctgctgcaggtgaagctgggatgctgagtctctgtctgggggcatttgtcctgaggtactgaggcaggcatgctggtgattctagtatctttgcagccttgaaaagggcaaagacttgtctgtctgcattttcctggaaaacggtctgtagtctattttcagttctttggatttgctagagcctgggctacttttagtctagtcctgaatctggctgggtggctttaggaaggtgaaggccgctgcctcggctcagagctgaagttcactctttgcttctttatttggaagcaagaagattgagtttcgggctggagagatggctcagtggttaagagcatcgactgctcttccgaaggtcttgagttcaaatcccagcaaccacatggtggctcacaaccatctgtaattagatctgactccctcttctggtgtgtctgtagacaactacagcgcacttagatataataataaataaatctttaaaaagtattctttaaaaaaaaaaaagactgagtttctggtactaggtatgttctctttcagctgtgtctactctgtctttcaagttcctcctcagagaccttggaaaggggcgggcacagaggcctgggggtgcttagggctgctgcacctgtgtgacagcccactgcccagctttccgctgctgctaacgaccctgccggctcttttgagtgagtctttgtacagtaagtgcatatgctggcaggttcctgtgtccagggaggactcccagagtcagcccaaggcccctgcgagccactggggccccgtggcgtgtcaggtatcaatgttgccagttatccagcaggtgaaacacctgcccatgctttggcctttccttgtttgtttgtttgcttttttgttttgctgttttttgtttgtttttcgagacagggtttctctgtatcaccctggctgttctggagctcactctgtagatcaggctggccttgaactcagaaatccgcctgcctctgcctcccaaatgctgggattaaaggcgtgtgccaccactgcccgtggcctttccttgtgactgatttttttttttagggttagtgtcacaggtttactggtctttcctactgttgtgaaaagaaaaaaagaattggcttaggaatagcaagtatttttttccagattgaattttttcttaaagaacccctttgattaaatacaatgcaaaccaaaggtgtgtaaggtgtgtaaggtgtggtgacctacactcatgggctgcccttctgccgctcattcacacacatatttccatcacatgacctagacttgaatttctaattgttgtttggttttgccctttccttggttttgtcaattttaaaatctactttaatttctacagacctctcaccgtccctcctgttactgtgttaataagatgtgtcatctggggtgcagtacaacacttcattcattcattcattcattcattcctggcctgtttgattttttgcaaggtgagagaccctggcgccctctttccccacagagctggtaaggagaaaagccggcgagtctccagcggttcttcacctcactgcagccgttagacttgctgatgtcagcattttcatgtttgcccaaagtagggccttcacatcggtctgtgtgtcctgtagttgttgagcctagccgtgtttgtgggacccttacttgaagtgtgatggctgcctccttcagatggagctcagtgatttcatagtgtccttatatgtggtccaacaagtctgtctgggcttagcgtctgtgtttcttgtttggaatatggaactacccttcttcaaggaatctggctcttgagcaccgcagccagactccaaggacatagcctgctacagggcccactgctgctcttccttcagtggatggggcagagtatgtcagcacatgcccacacctgcgtttgcccttcctgccagattgtggtgcccaggtatatacttggtcactctcagaccacgatgtcagcttctgcacctctcaggaggattcagcgggattggggtgccaggtgttgtgtgagcagaacaagacatatgcagctacttagcagggactcccagtggccctttcagcagttactgaagatggttagaatttattttataggcgagttctccccatttggaaaagttgcattgtatctattgtcagagcagaggcctccctctgccgctctcctcagtgtcatgtcagagcagaggcctccctctgccgctctcctcagtgtcatgtcagagcagaggcctccctctgccgctctcctcagtgtcatgtcagagcagaggcctccctctgccgctctcctcagtgtcagagctgacttggtctcttctactgattctcattttctgaagttgctttatttttgcagattctttaccacccattgtgtatgagggtgctcttcctagacactgtatttggatcagagtgctgcctttagacttgagagggatttttgtttagatagaaaattgctggctcatacttctttctcatagtgtcattttattttattgtgtgtacgagtgttttgtctgcatgtaagcctgtccattctgtataatgcaatgccgcaagaggtcagaagtgggcgtcagatccccgggaactgaagttaaagatggttgtgagctgccgtgtgggtgtgggatgtctccttcacccctccagccctctcaagcatcttagatattttaattcactctttctttgtctgctttgattgagttctctttgttgtaagccatctgctcccttgcgtgcatgtgtatgggagaaatctttccctctgcgtatctgcgtacccttcaataaatggtttcagcacacggagctccacttcccctttcaggagtcacgttcctggcctcggaacctggggccctgtgctgttactgctgagctgtgcttcaggagatgcttgggtgcggccctgaggtcatttccttgccacacttgctctcgtgtctcccagcgctggctaactgttggcctttcctcacctgtcttctcggtggcgtggcgtttggaacatccccctcagctctttttacttcctctgttcattcgctttcctgttggtcctggtaaggctctacctgttctatttgtttactcgaggttttctaacttggtctgttcatttttaaccatttatttagatctgtgttgatggactgggcctcactttcatgttggagcataaggtgtttggtggcttaatcagaatgtcacaggagctggaggaaagtcacagaccgatctgacaggggtgtttcttgagggcgaggtgtccggagggccacgcagctatgatggtctctgggatgtgctcgtcactgagaggcctcggccttgaggagaaggtggtgcttagcagagggtttctttttttttttttttttttccccagttatttcaagatactttattttcacaatgggtcacaacatacgcttctggcccattctgccaatgtacaagctacaaacgcttgctcagcagctgaggggcacacgttagtatgtctgaaaagtgaataaaaatcccatgtaatacaaatattcaaagtttccataggaacacagtaagtgtgacccccatcctacctagccttccatactgcattggtgccaaccctactactcacaaagacatcccaaactagcagtaagttaaatggtccccccaaatgccttaattcaagctaaacttgcaggcaagagctacaagaatggcatctacacattgatcctagcagaagcacaggctgcagggtgagagtccatcccgctctcctgggcacaagacatgggcagcgtgccatcatcctgctcctccacctccggcgggaagccatggctctggatctgtttcatgagttgccacattggccgtgacattacatagtagatgtttggcctctggaacccattgaaagtagaagcagcagcaacggtgcatgcacccatgtcctcaaacagcatccaatcacccacatgcatttcaggcagattacagcgctccacaatccgatcaaggccatcacatgttggtccccaaatgctggatgagtaatacttcatctggcttgggtctcttctgcagcagggccttcacatgggcatgatcataaagaatgcagttaaatgatccatatattccatcattcacataatacatgaaggtttgctcatttgactcatcttcatcgtcagagccgggctgctccttccacacggtttttttggcaatgatgttgactgcaagcgtgaaagctgatgcgacatagtatctgcctggctcagctatgattctcactccagagtctgatgggaagtacttgtccagagctgggttgattacactggtgatctcttcaaatttaagttttgtatcttcagatccaggaaagccaccaccaatatcaagcagatacatgctgaaaccgacttctgttgctatgtcaaacacacagcgggcatccgacactgcctgaacgaaggtctcggggtcagtacatccactgcccacatggaagctcacaccaatgacgtcaatatttagctcttttgcccgttccaagagaagcctgctggttttgagtgtggcaccaaacttaacactgaggcgacagacggctttggaatcatcagtggcaatccgcagaaccaacctcagatgcttctttagaatgtctccgaggtccgcaacatagaacgcatccttatcgtcagaggaagagacttcattgattttttggtccagaatgtccttagcagtaaagccttcatcaaggatgtggcagtcaaactcgtccttagtaaagctgctcatggttctcgatgtgcttacaggaaacccggagatggaatcaaattatcgccagctcctcacaaggtcgacttagaaagaactctgaatgctgcctccttggagtggtggaaacactcatagcacagtggcccggctggcctgacccatggaggcgccgccgccaaaccccgaggagcgcccgtccgtccgtccgtctgcccgccgccgccccgtcagccgcctcttcgagcccgccgcagacgccgaccggaggtggcgccgagctgctggctgagggcggccggcggtggcggctgcagggactgaccagcagagggtttctataggcagctgggggcctggagatgctagacttagcctgaagctcccagacctgcttctagaagatgtgttggaggtggtgtgaagaatggggaagtgaggcttttattccactatttagggaaaaaaagccactagttagttatctctgagtgttcgaaagccaagtaaagccctacagcgaagcgcctgcagacctttagatccttcggtgcacagagctatgagctgttccacactgggcacgttaatcatcccttctggttcttgacatttgttttgcaggtgacagaaaccgcataccctgtgacttctggactcttgctgtcagtgtgccccttcctcgtgctctggatgatgtcagagcaggacctggcggatgtggttcagattgcagtggaagacctgagccctgatcacccaggtacagccgtgagacagtcgatgcactgttgctctccctgtcttttcagtatcaaagccactctgccggacttcattccccagtaaagcagacacagcagagatgccagccctgtgtgaaaatttaaatcataggatgattgcagggctgcctgcatgtgtgcttacacacacacacacacacacacacacacacacacatccacacatacttatttaaaagagttctggccattgctctagatggctgctgtgtgttgccaaaggaggaggcaaggcagacacagagctgtaggtagcagtctcgtcttttctattgtgagtgagcacacagaggctggagaaatgcacaggcattcagtgagaaaaactgaactagtgacatgaaactattcatggcataaaagtcagtacaaatgctgagcacagaattctgggaaggtggctgtatcaggccagagcagtggctcagtggttaggagtacttcttctcttccagaggacctgggcttcttcccacattggacagcttccaaccacctataactccttctggcttttgagggcatcccacacgaattgcatacatttactcacacacacacacacacacacacacacacacacacacacacacatatatataaataaaagtaagctttagggaaatgagtgctcctgtgtgagaacaggactagtccgtgcaggtcgctatagaggtgcagtgtggcagggataaggtgtaactgctcttaggcttggtgatcatcactttaatacgttgggatggtactgtagaggttggcgttagggttaccttgcttatctgaaagcaggccttaaaggtcagcaggaactgtttgtgggcggctcgtgagcagttcagcttccgtgtaagtcagcgtgttggctgtgctagattggggcatatgacatgcagagagggttgtggctgtcagtatgtacgtgctctcagccccatgcagggagtgggccaggacctcaggccaggccaggtgagggtgctttggattttacagtgacgtagccgcagacacactaaacacagtggggaagcagtcaccgatgacggcgcctcagtgtgctttgcccaccaggctctggggagtatcgatcgggtggtctgattttggtggggatggatgagggagggcctgatttctgcctggctgaggattttaacaaagaaatggctgtgccattttcatcagcctcaaggtaccggcactgtgttcggctgtagaggcacagagccccaaggaactcagcatgctcactccagcttctgtctctgtggttgcttttcagttgttttggagaatcatgtcgtgacagatgatgatgaacctgccttgaagcgccagcgactagagatcaattgccaggacccctctataaaggtaccgtgtggctcctgtgggcactgtgtaactttctaccatcaacctgggcttagaatagcagaaccaaccctcttgcagctctgcagtggcagggccacaccttctgggattctaaggaggctctccctgcctcctctgctgtgacctattggtcccagccttattactcgagtccatgcctgaggcctaccctcactcaggcccagatgggtcatttatttaaatacatgtgcaaagagcttttttccagatgaggccacaggaagggcctggccctgtagtattgagatgccactgaaatgctgcagaaaatacaggccaggtccttccggcaaaagacaggaggaaacactggatttgggagaggacaagcgaagagtcttcctgtgcctgagtaagcctgcctcaggtgggaggagagctgaggtcacttgggcccacccccaagtcctgaggtcactggggcccacccccaaggctggctggggttggaggctccttaggcagtcggtgcattgcttccggacttgcttatttgggatccagtgtctgcagaacacgaggtgaatattattacaggagagaagtttataagagtgactcagatgacaccagtccttgtcataggcttctctgtgtcaactgtgacttcttaagacactcagctcactctggtgacaagaaggtagtgccagctgaagctgggaattcagaatctactcaggccagaaggggcaccacgcacctttaaccctggcacttgagaggcagaggcaggcagatctctgagtttgtggccagcctggtgtacatattgagttctggaacagccagggctacatagaaagaagctatctcaaaaaatattgagtgaaatccaccttgacagtatcagatctcaaagtaacccgtgaccttaactgtagcatagagcacacagagaaacagaccatggaggaaagcagctgcctggggtctgctggagacactgcatgtgtgctgtcgcatgcagccgagtgctgtcacgggattggaagacattcacgtaccaaattgccaaagtaattctcaccagacaggtcagggctgtttgtgggcacctgacccgtggagcagtgtcaggaagaatgctgtctctcttctcctctatgggtttgcttgagatgttagttagtctgtaacagggattttcctctctcagttggccaccatgtagttgtcatggtgtctgcctgcactgccgacgctgctccgttgatagccgagtggacactggggatgagctgagcgctgctgcttgttccctcgcaggcacagccttgcccctagagagcatggttagcggggagcgtcaggtcttctccttaaccttcttcttactagtgtctttctgtgaaaagaggcctttaagccagggttcagggtgctggttaatgacaggaaatggaggagtaaggcccgtagcactgaagaaaaggaatcttctctaagtggtgctggctctggcagaggatgtgctgagttggggcagatgtgagggctttgggtatgcagcactttcccatggctgctcctgactgctgtgcatagcagagaaatagagcaagctcagggttcttcagggccgtgcctggctactcagaatgctctgacccatgcattcgtgctttgccacacccggttgttgttggtgtggtatctgcttctgtggctgttatgattgtgattctgctccgtgattccctttcaagttagagcagagatggctcccattaacttggactgggtgcagagggacacgctgttctgcctgcctgtgctctgaggtccagcgctggcctgaccctttgttctcataggctagcaccttcttcctgaggtgcctgaggctgcatttctcttccagccgaatcctcattgtgttttcttcagcggctgctggccatacacagttgaatgatttcctggcacccagaatgttgcctgggagggctctcttcacagtagagttcctgtgtgcgccatgtacatggtagcttgtgacaggactggcccttgggagagcaaagccatcctgttgagcttaccgagcacatggcctgctgctgacttccagcttgctagttggaaactgctcctcttgtgggccactaggtggcacacttgatatttagaaggtccctggaaggggtcattgacagatttcagtgaggtatagctgtatccagccatctttttttggttttcagggtttggatagtagtcttatctttcagcattagaaaaattttgtagctttactgtataaatatttggatgagcatagtgacaagcttattactccatggcctcaggaaaggtgagattgcaagggcttattagacacagagggctgaatccctgtgcacggcccagggctcctcactgaatatgttggctcggcccagggctcactcagctgaaatacactgggtggacttaggagccagctagggtcctaaggacttgctgctcacagtggaagacatcctctctgaagcttttctgttttcatttccagtctttcctgtactctattaaccagacgatatgtttgcggttggatagcattgaggccaagctgcaagctctcgaggccacttgcaaatctctggaagagaagctagacctggtcaccaataaacagcacagtcccatccaggtccccatggtggcaggttccccacttggcgccacccagacctgcaacaaagtgcgatggtaagtccagaagaccgaggctccgcaggccaccctgggaaagcgctccgtgccagcccaggcgccgctgttactgatctgccctcgccccggatatctgccctggtgcttccatggggctggtttcacttagaccgaaaccaaacacaggctctgctggaacggcctgagttgctccaactttgtttcttggcttaagcagctggactcatctttccttgcacctggccatgaacttggcccatgtatgttgcttcttttctctttctatctctggctgactattgcctatgttttctgcgggggtaatatttataatttttacttgatcatagaaaactttccgtttagtctgagacttgccttgtgcctaatttttaaataggtttgtggcctccaagagagctttgcatggtttgcactctgctggcttggaaggttccatgcctggctcagtgggatggaaaggtgtctcagaaggggtccttctcacactggctccataggcagtgtggcatgagaccttgtgggtggcagcacccacccagtgttcttgatgttctaattctttcccaaggtgtctaggaggaagtccgttcacagtagtggccttagcgccatctctgtgctccaaggcctcctcttgcctgttagatttgggaagagcagaacagtagggtagcgatgccagcctcagcagcctaaagggacaccagtggctttgctgtggtgtaggtggttggtgggtgccaccctgcccatgtgtgctgtaactagagcaacagtcggtgcttttatggattcaaaggggtgggttgtgtgggaagggaaaggaggggttactttgcttggttttggggtggtcaagagtaccaagtaactgcctgtcctctcttgagacagttcctgacgaccccagattcactctgttctccctcggtgtcctagcctctcagcagagacagggtttctctcatgactggagtgggctgcacagctcaccccccagccccctacatacttgtacacagtgtctgtgcaggctctcttttgaaatgtccctttgtccccaaacataatgtttggaaatagagctttatgttaatggggagacgtgaaaggaccgcagtgtatgggagagcatgtgcttgagcctacaggttcagtgggacagagagagatgcagcctggagacagtgggacagagagagatgcagcctggagacagtgggacagagagagatgcagcctggagacagtgggacagagagagatgcagcctggagacagtgggacagagagagatgcagcctggagacagtgggacagagagagatgcagcctggagacagtgggacagagagagatacagcctggagacagtgggacagagagaggtgcagcctggagacagtgggacagagatgcagcctggagacagtggttgcaggcatcaccgactggcagtggaatattccagaatgccaagttctttgtgctgtttccaatgaagcaaagtgtagttttttctagactgacagagtagtcgagttcctagagagttcaagttccataaaaactgcaaggacgtctctgtctgacttccgcctaggccagggctcagagtcagacatgacttcctatgtgactgctcagggcctggggcgttcgtgggggagggctttgtgttagttgtctcaggcattgaaggacaccttaccctccttggtcacacctacactctggtggcattttacattggtagccatgtttgtcatactgactccagagctttgggcctgcagcaaacagcagtattgtccccaggtgaaataaaagagcggtgatctttgcttcttataagatactgcctattctggggacagcacctgggcctttgtcacttgtggaacatggtgtcttccgagctgaggaagtattgacagcatcttttttctcggttctagttctaccaggttatgggagcagcaggggtgaaagagggtggttttttgtggcctgacctcaagggcacatgctttggaattctgtctgtctgggagcactgagtgccaaggtcacctagttggacattcccaggggccagacatttccaagttctgctttcctcattagaaagatgagagctgggacagcacctgggtgtggtggtgacagggccacactatccagaaggctctaacagggaactcgagagcagaaccccaggatcccatcgatggatgcatgaagtcactgatacagattcaggaagagacgagcattgttacacagaacctgggcagtggggcatagactggcttctagaaccatctaaaaggcggcagcatactgaatggggcggtgctgtgttttgcttacctgctgcctctgaggaggaggagcgcttacctagctgaatgacctctgtccagatcatgcactctgacaaagaactttaaaccttgggcttctacttgctggctttgagtgtgactcacaagactaacataggagccatcaccagtctttcagctctaaggaggcctcgagagagtgccgagagatgttcttgaaggtcactgcctcccatttggagatgctgcagaggtccaggtctagtaggaggtggtacccaaggccttctgctggaaatctatgtcccctgctggtcatctgacacccggctggacacggctaaggctgctgggctccaagggtgctcttctaattgtttgtgctccttggcagacagaaggccacggaacactgcccgcctcagctggcatggggtccagaaggccatggaacactgccagcctcagctggcgtggggtccagaaggccatggaacactgccagcctcagctggcgtggggtccagagtttcagattccgcacctgaatgagcaaattcaagaaaaaaagaaaagaaggcctgttttctttgatgccaaagcttaatcatgataaaaatgtttgtgaggttacagggatggggtttcacccagcagtgacattcggcttccagagatggaaatggacttaattctgttgtgcctggcttgtctctcctgcaggtatgctgtgagtttgatttcacatagttgtacttgtagggatggcagtgaggcactttagcgctgaagacatttggaggagcagtagttgctgaagcatctgcattgctgtggaagcagtggtttggtgagccatcctttatactcctgggcttcaagcgttcttttttcatatataagtccactgtagctgtcctcagacactccagaagagggcatcagatttcgttacggatggtagtgagccaccatgtggttgctggaatttgaactcgggaccttcggaagagcagtcggcactcttaaccactgagccacctggccagcccagcttcaagcattctaataaggccagtactgtgttgtctaaccagaaggcctcaagggccagcgcaggcatttttatacaaacggtgaataagttaccttcctgctctctgtggctagacatagcctgatgacggagcaggagtgttggtacagtgcagatgcacccaggagccgtgcaggcagctcccagtcacaggcaggcgttgcctccggggttgccaccttgcactgcttgacaactcaacagctgttagaaccaagcctttctgattgtagttaactaagactattaccgaggacagacattttttttttattttttaaagcagtagatttttttctttaaacagtttaaaattaggactggagagatggttcagagagtagaaccagtgggctcaatcattgccagcaccgtgtaaaacccagcatggtagcctgtgactgtcatccccacagtcggggtaaaagctgaaggataagaagttccgggtcattcttgactacatagcgagcttggggccagcctgggctacatgagactatctcaaaagcaaaactagacaaaataaaatgaaacacacacacaaagggattttgtatagcaatggtttccaaaatttttttaaaagtgattaaaacttccctcagggcagtggtgcaaaactttgtcaggagaagttttgttcttttctttccctttctctgaactgactgagtcaagagacttgaaatgttagtgaagacttaagctccctgtagcaatctggctgccaactcttagttcctggtgatcttttgttttcctgttaaaggaagctgatctggttcctagcctgcctccttcttggagagctggtctctgtctcgggcttcagcaccctcagccaggagcctctgctctgtaggctgagtgtggcaggcccacggtagggctgtctgcctgtggagtggctggtctctcgaatgctgggcttgcttccttcttccctgatgctgaattctggatgcttctgtttgattccgggcttgatcttcttgatcttccacacgctcctctgtacgcactgggctgttgactaaaggttcacacgtaaggctggggagtccttagcaaaccctgcagacccagacacattccggccctcaaagccaacatagtaaagccaactgtcctgctagattgtggtccggcagctcaggccttctctagtacccacagaactcatgctctttgaagggaattgcgttggctccaggttactctgggaagcgttgtcatgtccacccaaggtggtttcatttagtttctccttgttgtacataacttgtttttctaagtactttgtacttatggtcttatgtatactagcttggcctcttgattgcctcctgcctccacttcctgagagctgtgatcacaggcctgtaccatgtcttcttatgtgaggtgctgggactcaaacccaggactgcgagtggaaggcatgctctctcctgactgattctcagctctcataaacatttaaagcaatcacttacacatatgtggtttaacataagtgtgcatgccggaagagggtgatggctccctttggagctagagttacaggtgtttgggagcccttgatgtgggtgctgggaactaatcctgtgtcctgcagagccatggccccatcccctcccatgaatctttacatttcagtttccagttgttcgctgatttctgaattcacctcccaacactggcatgaaatcgaccacattaggtagttgttacagcgttgtggcctctctccagttctaagttcatttattttagtggcttttctttaggatttgagaagaaaggagcctggcatgtggtgcatgttaatcccagcgtttagcaggctgaagctagaggatgctgcagcctggaggccagcttggcttatgcaacaagaccctactgactggagttctcccttctctcacaaggatttctgtgcctttactgcatctgctgtgagctcatttccatgcgttctgtactgtttgccttgatacagttctgttttctgaaggtgctccataggtgctccatagaagatgagttctgcttcatcttcaggaagaactttcccccaccctttccaacaaactctttattctcgtgtgacccagtactgtgctttactagtattaaaaacattgtcaggcagctctctggattagtgtttctcaatcagtaggccttgaattcacagaagttctcctgccttagtctctccagcctgggattatgacatgagccactataattggcttagggggagacttttctgacatccttgtctcccatcagaggatgggctaaagtgaaggctagagtaccatgactagggtgactcatgaacgtcctgtgagcctcggtggctctgagctgtaaatagtcttaagttcctgggatgctggccacaccccaggaaactcactgaatttgaaatctttaattttcagtgcttaatatcaacttctgcctggtgggtaaggtggctctagacatcctctgcttgtgtgcttagtgcttgtgcttgcttactgatgcctgctggctctggtgctccatctttctgtcttctttgggatgttggctagctgcgtgaagaccccagaaccccaagatgcttagctcaggatgagcccagtcttaaatttacgtgggcttgaagtagcagacttcatttgtggctggtggtcttgggatgctggcaatgcatttttaaacaaagtagacagaaggccgccatcagaagccagaggtgctaagtggacactatagcaggggtgagcagaggtgctaattggacactgtagcaggggtgagcagagatgaagggaggtgactcagcagagctgttgctggggtatgtgtgtgtatgtaactgagaagttgttgtatagatttgtttgtttgttttgttgcttttaaagccaaaggtctcatgagaattgcccagggcaatttgtaaagtaaaaagaggtcttaggttctcttaagggggctctggcttctcccagaaagttctgatttgtgagaagtagtgtaagctcagctttttgttttgttttagaaagttgctgttataagagaacattgggttcacatctaacctatgcctggccagctctatggtctcaggctggtgaaatgtctttctgagctgctgtctgtggcagaggcactgagatgcccttgtctgagttttggctacaacctctttggaacatactgcatcgtcccatctcctccccaccccctcgtgtgtgtgtgtgtgtgtgtgtgtgtgtgtgtgaatgagagagagagagagagagagagagagagagagagagcgctgtactcatgtgtttcatctcatactgctatgtggaaggcaccctgtgttctgtctcctagtacttggattgagtaacgcgcttctcttgaagtctttgtggtcagtgcttgtcatcctgtgtgctgccaggctggttgttgacactcctctgaccatagcaggtgaaagggccttgttcatacctgtactgtggctgctgctttgccacagtatagagcatgttttactgctgaatactatgtaaaggtgagaatattcagcatgtgtagcttcagccacaaatcagcatcactgaagaactaaagagtcaggccagatgtgactgtacttgcctgtaattctagcactacggaggtggaggctggagagttttaagtttgagcctagccttggatacataaatgctctctcaaagaccccatcccccttcaaaagtcccaacagtctatgggtcatatcatttacttttttcaaaaatttcatttaagtttcttcattaagatttttgtcttgtctctgagtgttttgtccatgtttgtaagtgtgccatgtgtgtgtagcacccatggaggccaaaagagggcattagacccccaggagttagagttttagatgattatcacccaccagtgtgtgctggaaactgaacttgggtcctgtgcaagagcagccagtgctcttaacagctgagccgtctcttcagcctttatctcattattttctttttaaagacttatttagttatatgagtgctctctttgcatccagaagagggcatcagaattcattacacgtggttgtgagccaccatgtcattgctgggaattgaactcaggacctctggaagagtagtcagtgttcttaaccactgaggcatctccccagctccttatctcgtttttatttaatagaaaaataaataactgggagggagggtgggaaggggagggggaggggggctgggagcaggaaatgcaaataaataaacaagtataaattaaaaaaaggaaaatagacagctatgggtagaagtatgagtagttaatttggattgtaaaggagtgggtagagatcatataaagaatttcaacagtataaaccaagggggagtagacagcttgctcctggagcaaaatagagagagtcatactgtgcggcagcccaggtgggggcaagggtggaagccgttctgcctagtttatgctttttacagtcggcactggacagaggaggacctggataggcgctcctcgtaaaggcagagcacagatcaactgcaaggttgcaggaggcctttggggcctagaaccaggcaaagagcacccttcagtctgactctggaaagcagccaggcaggcccgtggtcggttgatctgagagagcataggaagaataacatagacaagggaagatgtcctaaagccgaaatgctgtaaactcagcagaaaatggagttactgtgagaccagcctgagggatgcctgcaagtcttcagcttcttggccataagaatacgccagtgagaaggcgtgatagtgctggggtggagtggggtgggatgggtggtgggggtgacggcggtgctagaggggcttgtattgtacacggttaagatgaatcaaaggacgataggtagcccttggtgccagaaggaatgtggaagacgggagctctcctgtgcagcatggccaggccttagaagctgagtgtccttcctgcatggccaggcagtggttctcaagactctgtgtgctctttatcaaggcgcagctaggaggaaacctatagacactcttaccctttccagtgggcaaggctcactaacacgtccatgccatgcatggagcagtccccagccaccgaagcaaaaatcatgagctgctcctgtggctggccagcaagttccatacgtaacattctccaaggacagacagatggttctctggagagatcccaggaggtggcagagcagggctttttctgggaaagggacattttttgaacctgtgcaggggaccacactgcccagagctacgcaggtgacatgtggaatatgatggcatctgaaggaggcttgcctctcactcatgtgtgggttcagggttgctttctggcattgctttaggttcaggctacacagatttcatagctgggggctatgtgtgctcccaagaaacttgtagttacttcacaacattgagtgtatggggcttatgtgtgtacacggctgtttggtgtgctcgtgcgttcctacatggtttactctaggagccgcttcaggagctgctgaacaagtgtgcagtctagggatggcatgtgagggtgtggcaggaaggggctgtctcaggccagagcagcttaagcctccttctggagggctcctgagaggccacccctccttccccgtcacctctccctgacagaccacagagaactaatgaggagctggagtcccatctgtgagattcccccttccagcagctcccaggtttgtgtttaactaagtcactaggagggtatttcagcccaggtaccccagaagtcacacaggagaacgaggaagcatgtggtctgtggccatacacctgtgacataaagggaggtagtcctgtcttcagaacatccacgttctcaggcgcctggaaatggtttcctcatttcccatcctagattggtgacaaatattcccagaagcgtgtgtgtgtgtgtgtgtgtgtgtgtgtgtgtgtgtgtgtgtgtgtgtgtgtgagagagagagagagagagagagagacgctccagcatatgtgcatttttcccacttactctccggtgttttctggttactgtggaagagctgtggctgataggattgtatggtaccaggccttggaagccatttccatcttgtgctgtgagtgtggcaagtgtgtgtgcccaaggcaacacagccacagaagcaggcagagattgcatgggttactttggatccttgtggacactcactcttagtttgtcactttaggtgtcaccagagagtaagtagaatgactaagaaacaaaagtgaatgtcatgctggtacttacacttcctgtttagtaaggaggtacccttttcctctggacaaggacactgggttttcaggtaatataactggctgcatcaagtggcggttccttttagccctggctcttcacagtagtccacactagacaactctgccatgctctgagttgacatgaggagtgcagtgggaaggagcctctgagagccatgtcccgctcggtcacaccctagtcctgcctcctgggcgttgctgaacctggtgactcttgggccctggtccattctctcctagaatttctcctcaaacctaagcctcaaggcctcctgttgtggttgtgcactctttagagagctgtgggtggcgcgggagcacgtttccctttgctgcccatgggttggttggctgccccactctagagggcagatgtggagtgacatgaggagggtagctatgagaccagcatgccgtctcagttttggagggatgcggttgaaagtcgctggggagctgagctggttcagtgggttagctcatgcctctgcaagcacggaggtctgagattaaatccctaacactctcataaacagccaggcatggcagtgcatgtctcagcaaggggaccgggacaggcagatcccacgcaggcttgctgatttaccagcctcgctgaatggactaggttactcttcagtgatagaccttgtctgaaatgaatgaggcagtggaggaaaactcccgctccctgctctggactctgcacacaactcctatgcatgcagtgcacacacgcaccccacacatacacatcacacattacacacccaaggggaaagtgaagaggatcctgtttccatgtaaacctgttgctgagatggcttgcaggtgcgtaggacaggagggtgccttagcctgtcctgcccactctgttaaatgttcacagcccactctgcccaaattatgcatttgggccaaccaagaataccaaccagcaggaagctggagaagcccagctccagcttagctgttctagcctgggctccgctttccgctgcggccccaggagccgaccgtgttgaatgatgcatgtgctctgacaatgaacgttgtggttttaaggacttctttttcttgtgattcttttgtttcatagcgtcgtcccccagactacagtaatactcaacaatgatcggcagaacgccattgtagccaagatggaagacccattgagcaacagggcaccggattccctggaaaatatcattagcaagtcagtagccatcaccaccccacctcccctgccactgccatgaggataagtgagcattcctgagccagggttcagtctgagcacatgtccatgtctgtagtcacagggtccattccgttagcagccaccatagtttttaggtcaggaagggccagcctggtgcttagcaatggtggggtgagacagtcccaaggggtgggcagctgtgagaaccgctgggctggatctggtttgtgaagaggctcgatagttagtgcgtgtggtcagctgaccaccccatctgcctgctctgcggttgagcctctcctcagttggcaaatgatgtacttgtgtcgagttgtgactttttctctcatccccatcttttgagatgtgttgaatggaacttccatcagaaatgaaagtgtacaagagccatgccccgtgggggcctctgcccgtggctctgtcactgcctcaggaaagcttggtcacctttaattactggcagtattctcacagattcctgtcttgctttttttctctgtggggtgtagctccttccagctttgttctggcttcttgtcctggaccagttctctaggcaacaggaggcctagggctgctgtgtgtgctgtgtggagtgctggaggcctgccactctgttggggcgaggatgtgcctcctggcccgcactgaggccacgggtgtggagtgttgaggagccagttcaccgtgggtagttctgtggggtcaagttcaggaagggcctcctgcctctggggctggccggagttttaaggcccctttgactttgctgatgggagctagagctttgcttcctctgtgctgtgtagtagtcatggtccacagtgttaacagtcattcagaaaacaaatcagtcctgggccttttgagcactttctgctgccagctgtttggctgctgctgcacttcagggcctgcaccgagaatggctcccagaggactcctggcatcctcatggccttggaagttgattctagggtttgtctgtgggagtcatagggagtgtggaggtgttttggaggctgagtcatcttgggtgtctgacagcgtgggtgatgatggatggatggagattctctgacacatgatgaccattatgcatgtgaggatggcctctaagatctggaagccggattctaggctgagtctcagggagttgtggttttacttatttcgtgctgttcatatttttaagcagttgctttatattatgtgtcttcttggtctcagactttctgtgttacgttgctgctcatctccatggagggtgtgtgtggggacataccgcatgttgggggacccaccttgtacattggtccatgctcagctagacactgggataagtccacatagcagcgggagtcagggctatctcagtgtaccactcatgtcctctcacagcctgggctgctgtgtttgtttcccgccagcgctgttcctgggcgtcggcagaacaccatcgtggtgaaagtgcctggtcaggacgacagccacaacgaagatggggagagcgggtcagaggccagtgactccgtgtctaactgtggccagccaggaagccagaacattggaagcaacgtcacactcatcaccctgaactccgaaggtgcgttcctaggactgtcatagttgtgtctgtgttgttcttctggaaggggtgtggctcactgttggcaagaagggggtgtggcttactgttgacaggaagagacagtgatgaagagagttaagcagctggcattccactgtggctgccagcacctgtgcccgtctccctgcgcctgtgcctctctcaagttcctggcatgtctgtgatggggttgccttcttggatggcctgcttcctgaggaaaagtagctttcatgaccatgcccctgaggccgccactgtccttggcatttctctgtaggcttccagaggccgttgctatgcttagggtgtacagtcttcttgggttgggctgcctctgtgttggagatctgcgagtagccaggaagatcaatgcgggggctgccttccctcggctcctccccgggatttcctggggtccccatggtggggcaggctcttcttccttgaagagtctgaagtacctccttgcttctaactaatttacagggatgtttcgagaaaggaaggagctctgactgactgagctgtgtgcaaatcccacgcatagactttgtgtacctgtgagaggcttctgtctcctcatctaaatgactgggttttcctataagcgcttttttttccgatttaatgaagattttgctcttaggtatgttactgtatctgaaattgcagtgttaggagttgaagctaggcaccacatactgatggttttacagttcacggtctagcagttgctaaaatggagattgtcgttcccaagagtttgtgtgctaagagtttgaccgcggtcatggctctgttgctcagaggtaaaccttccatggggtgagccactgaggcagttcctgaggaggagtggggccctggccccatgtggcctttccttttgtgtctcaggtccacgggatgaatagcctcctctaccacaggcttcctccatgatgactggctcccacagggccagtgaccatggactgaggaaagctttcctccttagaaactatctgtcacagtgacagaaacagggttagtttagccatgtttatccaccgtatttgtctaaatctagaaaggttttttttttttttaccacccccataagaatcctctgcccagttagtcactcgccaccctcagcagcactgtagctgttgatggtcttgtgtgacggagagtcttctgagcactgtggctctctaacgagtgtgtggagacgatggcatcattattaagtgactgctgcatgtggactgtcaggcaggacagtggctcccttcagactcattgcccactagctttggcagttctgaactctaacctgtgggactaaccagtcatagtcttggatttgccccagggtagctgctcaacagggagtgttaggtcatgtggctcatgccatagaagaattattgatcaggtgtgctgtggagggtgtgtttgtaggctttagtccttttggcccccgttcagagccaagagtggtgagcagacagaaggtctgtgtcttctgagtgtcagtgagcctgaggtctggagtgccagcttccaagacgttactgcttaagaattccaaatgctttagataaaatctgaagtcagttggttatactgtaagggtaatcctgttgcttcttagggtgcaggggattggacttgggtagcatgcttggcaggcattccaccactgagctacagcccaggcctctcttcattctttgttttgagacagtgtctcactcagttgtccaggctatccttgagtgttgctctgcagctcaggtaggtaggccatgacatttcagttctgccaccataccctctgaaggagctgggacaacagcccgcaccatttcatcttcctggcggttcctacttaggtaaggttttagagatgggggcacagaagagccatgtgagctaagctgagttcctgccgtggcttctgtggtggttggcctcttgcatcccattttgaacactgagcataggaggggcacagtcattcacaggccaagctgactgaatgcagctgaacgggatcttttaactaaggggtttagttggttcccaggccctcagtgtgggcgtttggaaattcctagagcacagactgatcctccatgtaatcataaacattgaagtacagtggggatggttgtgtctcagttgtcactggttgtggctgctccctctgcaacccgtgctgtctgcatgttccatgtcgtattctgctgaccagtaaggactttttgacaactttctgtgacagatgccctttaggtccctgcaccaggaagctggtggcagcctgagaaagcaccaggtggtttgcaacttaagttttgctttgtttttttgttttcttgtgaccaatgcctgagatgcccggctgtagagagaggggctgatggcacatgcatggaacttgtttgtggggtgaccacaatgtatagagaccttggttgtgctcagttttcttatgtaagaaacatttgtgtattactggttagaaaccaaaactatataatataattgttatttttaaaatagcttattaagaaaaatgaagcaaaaatagtacatatataccaaaaacctttttgaaagaaaatgctagaaatttgtagtttgtggaatacatttctaaaattttccacttctgtgccatagaagtagcttctggctgttgcagttgtcctctaacatgtggcctgtctttggtttgtgctccccttgcccatgtggagcactggtctgacagctcaccatccccatatggatggggttccgtcagagcatctcagagcagccgcaggtttggagaggacgtgcagacagatgggcacccaggttctgtggtgctctgggaccctgcatggctcaagatccgtttagggcagacacaagtgcacaagaagaacatgttttctggactaaatagagcctcttgttgcccacttaatgagcaaactgagttaaataaattgagacccttggctgggtttcaaaacattctgggttttgtgtggcagtgtggtctgaaaggcagtgggtgctgattcttgtttcctgtctggttagttccaggggacttcattctggttattttcatttttggagccactagcatctcacaaggcatgtgtcttaatgctggtaaattggggttgctttacaaatgccagatgggagttaatttttcacatggatagaaaatatgcttaatggtagttgatgagtacaagtctgttgtctaagcactagcttgaagagactgcggctgagcccagggagctagttgccctgagctgcagtgtttgaatagctctgaagcctctgtggtcgcaccttttctagattgtttagtccctttctgctggctcatgccatgtcactggtctgtagaatgtcagcagagccccaggaatggcttaggaagctcacagctgtgactggtgctcttgagtaggaactggggtgtctgggaggcagggctgtcacagagccctgtgtacaaccaggcacgggaagtggaaactgcattcttgctcttcacacctaggctgtagtcagggagcttttcttgttccatgtggcggatgccctaggccttgggtgtgatggaagtgacgggaggttcgtggtgtctgttgctcttgcagggcaggggtggtgatgattcatattgagacatctctgctgtccacactggttgctgagttgctgagtgacagttgttgcacagtaagtttggaacaaaagtatctttttatgctccatatgacttccaactcgtggtgggcaaagacttgctcaggtcaaggccctggagctaacagaggacctggcccgatgctcgggctcaggaggagttgcttgagggtttgctttccttgcggagggaagctgaaacagacccagaccggctctgcactggtgcttgctgggtagcactgaaggtggaggtgctccctggggtactctctctgcagtttattttcctggaacttaagataggcgctccgagctgtttgtattctgacctgctttaaagaagaacagaaaatccaaattgctgctggaaggttttcgttttaacagtttttaaaagtgatgatatcattgaagatttatatgacaggaaaagaaaacaaatttattttgcttgaattgtaaaataaagctagaagaacgtgttgttcagatggtaacatggggttgacatattagcacagttagcatgccccccctgcatttacaaaaggtgtgtttcagacagggagtgggtaggtgttgtctggttctgtgtagagacatgattccgtgttaccatgggaacctgcactccactgttacacaagtctagaaggtcagagggcaccagatttgtgtgttgtggaagcaaatacactgagtgagccagcatggcccactgggtgacagttcttcctcctgcttgtcccctttatcactgagcgatgacagcaggcctaggcctctctcaacctgagatggttttcctgccccccagctgtcttcttctgtttttgttgttgtttgttgagatagggtctccttatgtagcctatgtggcctggaactcatgatacccctgcttcaatcttgtaagctttgggatttcaggcatgtaccattatagccagcccattggactttgtatggctactggatatagcatgggctcgctgacttctggaaaagaacctgtctttgagaaccatctcactacttatacatcattgatgccaccaagagattatttattcatcttcttctgaattctaaaattcagctgtttccatccttacctagagctgagagcccacacccattttccaccctgccatcatgtcccctgtgatgtttgtttcagatgacctaagttctgtgactctagagaaccctgactgatacagtgttttaaggcatattgtgacagagacttaacgaaggcttccagggagagctacacacaacaccaactggtgtgtgctcagatgagttgggcccgtggattccaacctgggtgtgcttcgactgcttcaccagtgtgcttgctcacctttgagacattgtttctcgttctgtctgcccaagggacttacctgttatttgagctcatatcttgttttgatgtattcctttacaatcaggatggcttgggcctgctacacctcagctctggtgttctggccctagggagcttatatgtgggctgtgggctgtactgcctgaacgtgcttctgagctgagcgttgctaactgcggcctttctcccctctcagaggactatcccaatggcacctggctgggcgatgagaataaccctgagatgcgggtacgctgtgccatcatcccttccgacatgttgcacatcagcaccaactgtcgcacggccgagaagatggcgctgacactgctggactacctgttccaccgtgaggtgcaggctgtgtccaacttgtccggccagggcaagcacgggaagaagcagctggaccccctcaccatctacggcatccggtgtaagttcacacagtgaggcagccgtccgcacagtgagggcggagctggtcagggcgctgaagccacaccacgttccattctggggagtgatgctgggcgcagtggtcatcctggaaataggatttgctttggcaagatgtgtggctcgctgtgctgagagggacaagatgtgtggcttgctgtgctgagagggacactgggaatgggcttctccagggacttgcagatcccagtctcactcatccttcggctgcttttggggagagagcagaggtgggattccttgatgcccactgccccagcgccccctggggtggctgtgtgtttagtttcactggggccacacctttggcttttccatcatctcaggtaggtatttgacacctttttttagaaagagacattagctctgcggctttggagtgttgggccagtgtaccccacagttagacacgagcttagctccaggggtttgtagtaggtggggagacaggcgctgctaaggctatggccatctgtccaagagtctgccttgccttccccaaatcatggtctgccccgtgctcactcagctgcaggccatgtgcgagaggaggagtgcgggctgttcatgaccatggctctgtggccacaggctccgtgctagtctctgtgcactggttccttagctttgtaagaacagagatttggtgaagtactggcatacctctacctgtgtgggccctctgcctcccaactgctgggattaaaggtatgcgccaccacaccacacccgtgcagtgactcttcctaaactattacctggaggagacggtctcctggtcgtaagttgcaggcagcgcattgtccagagagctctcctggcttggtgccctgtggggtatattgaatttcttgggccacactagcagagtccgtgctggagcattcagacccaggcccagaggcaagggttagcttggctgggcagcagctcctcctccaggggctttgcctctagctctggtgtggtggccctgggtcttcctgatgtggcctccatgggccatcttctcctatctcctcatagagatcccactgctgctgcctcttcctcagtcatatctgtaaaggccctgcatttttgcccaatgattttggaagacattgatccatcagtgacagggatgtgggtttctctgagtttggataatcagatgctgtctcttccctggtcctgaaggatggctcgggaaagctgctcaaatgccttggatacaggccattatatgggtgtggcattggtctgccatggcttggcacgggtcttgggatgccccgagaatgccagtttgcctagagagccagggaagagttgggttggtttaagctggtggcagagcagcttgagttccggagacaaatgggagacctcttctcagaagggaccagtcactgctgaggggtggcttagaatggctgtcagagactacagactaggaggagttgtggggaggcatgaacgggccagggtgagctggggacagcctgcaggcgtccttgggaaactttgccaccgtgcagaggcctcttcaggcctgcctccaagcctctacagctgaagagcagcagtgcccttgactttcatgagctcagtgctccaccaccttgggcagcaggtgacccacaggccagcagctggaggcttctgttgtttccagggcttttggttttgagctttggtcctactgcatggcctgctgagcagaggaaggtatgacatcaggcctcgtcttgtttgtcctccgctgtgacgaaggtggacacatagccagaagtgacactgtgagatggcttctcctattccttggttttgcctacaaacaggcacaagagcgatggtgttcttactcagtgaggctttcaaatgtgtatcagatgaggtagttggccagcagggggttctgtggtgactgcgactggaagccaggtgactggcctgggacctacagaggcttttgtccatatctaaagccacttgtctcgcgtgtggtttctcagtggtttatgactctgtctatttgagatgacctggaagtcagaaccagagctgccaactcactcctgagggaaagggaaaagtacttccaggtcacaggcctgctgtcactgtgccattgctgagtatatgcaaacagaacactcagagacatctcctaatgcccagtaggtaatatggcagtgaaagggttccactccttctcatggctgctcttgatgagagcagctgtagagtttgggggagaacttccccctcaggagacgatctaaactcggtggctttaacggccagaagaggacatttgccaacttagacttttgattattggagtttgagtttcttcatttattttcctgttatttagtgaagttgcataagccagctacagaggtcactgtgttgaagagaaagtcttgtgacgtccttcactaccatccttcctgctgtcattgggccgtggcagacagaggaccatgggctggagacagggtctagtggttaagaacacttactcctcctagcagtcctgagttcgagtcccaactcccacagcagtggcacacagctgtctgtagctctagctctaggtgatccagtaactgtgacctctgcgggtacacaaacacacacatacacacaatttaataaatataaattttaattggcaaatttaaggattggtgatacaaaaagtaagttctaaaaagagggagggccatggcgtgaggtcgtgagatggccaggctctgcgtgctcttctgtgctcccggcctgttctgtgctcctaaggatcggcagttggggtccagtggtgctctgctgtgtgctgtgtgttcctgctctaccctccagggctggatgtggctactacccttccctggggttccaggcaactctgggaagtggttcctgtgctaagagcttgggtgtgttaggagacagcctggtaagaacgaaggagtaagcaactggctgggagcactgggcaaacatcttcaggtgcctgctgctccccgaatgctggccagaatttactgagtgcccctcgtttgtaagggaggaagggtaaacactgtgtgagatccctgtacatttaaggtgttctagaaagcaagtgtgctgcactgagggagttttggatgaggagaggggacagtactgtttgctggtctggactgaggcgggctaggctaaacagaagagcagagggtaacggactacagctttggcaagacctgtatgagtgcagttttgagtctgattccctaggcaattaggatggtatatgtcgtcttgtgagtgagtttagggcaagagaagttacaggcttgggagtctgaagcctgggagaaatggagactcgttggtgttggagtgaagcctggttctttaaaggttaactaactcgacgggaggagtggtaaatacctgcatctggtcctgctgcccccagtgacctgagtgatgggcgtcttccttgatgaagtgagattttctagaagatgagtcagacctttaggagtaggccagcggctcagctgggtctcttagcagagcttagctgctgtttggtgctctcagcagtggggctcaggacaaggcctgcgtatgagagctcttaactgggacgtgttctttcaggtcacctcttctataaatttggaatcacggaatctgactggtatcggatcaagcagagcattgactccaagtgccggacagcctggcggcggaagcagcgaggccagagcctggcggtcaagagcttctctcggaggacgccatcctcatcctcttacagtgcctcaggtaggctcaggagggcgctgtcccgaagctccgttcatcagtcctggccctgtcagtgaggctggccttgtgggagctccctaggcagtgacaagagcacagggcctgcctatttacactgtaggctcaacaggaaaatttagtgtgggacctttctcgagttgcctggttacttatcttctgagcgtcctgctgccttaacagtagctactgtgtagctgcagagtggcggtgggtgaaggacggagggcccatgttgtgctctttagtcttagtttgagcttatagactcaggcttgtccttaagatcgcagagacattctctgagccctacctgttggcccgtcccctcccttcatgctagtgtagagcttgcactcagggtcttgggcaatcttggcactggtactttgccactgagctatgctctcaatcctaaaattgcctcttaaactgtttttcatagctttcttggcagtagcaacagctcctgaaagctgagtcctgggtttgctcaggatctgggacagcagtgggcaggtggccggcaaggcttcctttcagtgcacgctttgtccagggactctggtttggaagctacaaagctggtcacctggagccctccttgagcatcttccagaaagagctcttcctcctttgttttagtggccattagttacttagctgtagccggtgccaaggctctaaggtggcagctgtgtgggccacacacattgttcccggtaggcagtgttgctgcaggtggcacgcagaactgggagttggacttctatcctgggaacccaagggagcctttaggcatgtgaggaatgtgtctggtgaggttgtgtgtggctgttaaatggggcgagcacgacttgtagctaacctaaaatgtgctcccaagtgctgtcagccgtgcgggctgtggtttggtccttccttacccgagcagcggatcttcatggtggcagtctgcagtggtccatcagttctgtttgtctcactgtggctcccatgttactgtccatgtgatttaatccgtgtgattaaagagcaggaagattccgctagatcaggttgtagtggctgcactgcagtgagccttcgtgctgtgaaggtgctgcatagacgagtggatgcctaggtctgagcatttgatcccctgcatctggggttatgggtggttgtgaaccaccatgtgggtgttgggaactgcacccaggtcttcggaaagggcagctggtgctcttaactgctaagctaagtctccaaccccataaagccagaacttaatgacaacctgagaagatcatactgggccacagatttcatcattgtattaggaagataacaaaatccagacacctctaacctagggacagtcacaagatctaggatccaataccaagaaactggaaaaaaacccaaacagacaacaaacaaaacctaaatccagcccacccacccgagtgactaaggagacccagccttaacagcccatgccactacagtgtcatgtccaaggacttaaagaggaacagaaatcagtagcaggggaggaaataaattttcaaaaaattgctaagcagacttagagatgaaacacaagggagtgaccgccagccactggatttcatgacggctgaaggtgactgtttcgtcacaaagaattggtcaagtagagtttattagacagggccttgatgagccaggtctcgccggaatccgacagagtgaggaggcccggcctgtgttactagtgttagacaagcacagggtgggtggaaagagccagggttctgtggctgtacgcatggtcacacacggtcacagcatactgcgtacgttttcagactctgacgtctgcctgcccgtggtccaggggagccactgagaaggccgtctcaggacggcttctgtggtgacagtgagtttgagtgaggaatgaggtacttaagtggacagggtttggcagtgtccacgaaggatctgggagtggcagtgctggtgagttggagccttcagaggttcaggtgccaagggattggcagggaagaagccggtcagggctccattcacagcgcagacaaccattggactattccctctagaggtggcttgcttagagacgcatgcgtctgggactgtagatgctcaggttgtcaggtgctggcctgctactgtggaatcaaggtcagctcatattctaattgaggtagtgtggagtggcctgaaggtccacatttctagccagcacccaactagcacccaccttgctgcccaagcctgctcttacatcagtgtggcttcctggtctttgagccagtagctgcgttgcaggtggagactcagcatgtgtgcctgtccgctgcagtgttgtcaggcttgtttacttgccagtgtgtgcgctcttgtagttgtttgtgtttccttctgttgctggcagtagcttagtgtgatgatacttatagtttgtgttttaattttcaggattttattagtagctagttgtactttttattccttttgctgctttgtttacaaacattgtcaatttcgctaagatgctgtgaacgctggcctcttgtgtaggcagccagccactgtgcagtctactaagtgcccaaattctggcaagtccccaggggtaggtagcatgtttgagaagccctggcagctgtcagccccgcagggtgactgttggggaatggacaaacacgtagtatgtgcactgggctgacctaggcatcattcccagaagacactgcagcggcaggtccgtttcttcctgacctggtctccatcctcccggctgcagacacttagcatgagcactgcacttacccactctggtctagcgtggagtagaactattggctaggatgctgctgctgaaggggtgaggggctccggaacatgaggcttgttcattgcagtcctcgtcctgtggctttgggtgagtattgcttagggctggctcagagctgcctagtagttcgtttctaggacgctgctggtgaggcaggcaggtaggcacttgctttcagaagaggtcctgggcttggggatgtccttgcccctcagcacccttgggtgttgtgaaagtgcactgctttgtcagctgaggaggagacattctgtgtctgtcctaacatgccacatttgtggcagagttctgattaagcggagtggtgactaggccaagggacttctgggatctttgtccttgttctgtttgcattgttgttgtcatagcaacgctagtctggtattcaagactatttggtgatggtaaaatgtaattaagccagcattctgttaatttggaattggtattgattccagctgggtcaccttgttaccttagaattgttagcagagacaaggagacaccgcacaatactacaaatgacttccttttttttctttacaaatatttacaagtttcatcttgtattccattttatttacttcatatgtgtcttttcacatgcatgcccctgtgctgtgtgtcggttcctggtagtgaggatgtgtgtggtatggacatgagtggagctcaagaacatctttcgagagtagcgctcgctcttcctttttctgtggtttctggggatgagactcgggctggcaggcttggtggcaagtgtgttcacctattcagatatctcactgtatatttcttcttcatacaaaatggtaattactttctcagggttcagggcgttacactgtttgcccaacatgtttgttctcatcaattattacaactctctgccacagaagtgcatagtatacattgaaaatttaaaaagaaattacaaacaatttttttgtttcagaaaattctgcttgtgatgacattacagttagaggctgaagtgtctagcatgctgcggccttaggcccaatccccagtactgggggaaaatctttatagttagtattacagttaaaattaatataacttatatcaaaccgaatgtcccttactttgattaaacttaggaaataaactgtgctgcagatgcatctttgagttaattttgtcttggagaaatgccacatagtgcaactctagagcagggttggtcctagcagagccctgtgggtcatttctgtggacagacctcaagccctgcagtagttcagcagtttgtctaggtgtttgcaggagaaacacttagtcacaacggtgtcactgaatcttaaatctctgtcacaaatctcagttcccctgacttgcagttgacaactctgcagaggagagatgcgctcacctgaaactgggagccaggtgcctttcctcttctgtagaaattgaggtggggaagacgtgaaggtgccaagatgacaggtgtcattcactctgtgtgtgggacctgagggattctgacacttgtcctgtgttccacagagaccatgatgggaacccctcctcccaccagtgagctacagcagtcacagccacaggccctacactacgccctggccaacgcccagcaggtccagatccaccagattggggaggatggacaggtgcaagtagtacgtatcccgttactccatggcgggggggggggggggtgctgtgttctgaggcgtagacagtgcagaggccaagcagtcttgcaccctctgagcagacagcgggaagccgcacctcagaagctgctcaagagcgggacttgggggcggcactggggagctggagcttttagtccaccgtgctgtggggctgttttaaaggcaacagagcgactctgagtggtggctctcttgggcttgttgattgtgtgactgactcgaccccagcaggtattcatctggctaggggcagctctgagagcaagccatgggccgccttggcacaggttcccgtgagcggtgaagctgagcggtgaagcggaagcggcccggccccgcccctggaataggctctttgctataagatctgtttgggccaagataggatttaaaaaataggggctggtgagatggctcagtgggtaagagcacccgactgctcttccgaaggtccggagttcaaatcccagcaaccacatggtggctcacaaccatctgtaacaagatctgacgccctcttctggagtgtctgaagatagctacagtgtacttacatataataaataaataaatctttaaaaaaaagcaacttaaaggttatgttaaaaaaaaaaggatttaaaaaataaaaagatttatttttatttttagtagtgtatagggtttgtgcatgtgaatgcatgtgttcacagaggccagaagagggctttagatcttccggagctggagttatgtggggtattgtgagctgcccaacgtgggtgctgggaattgagctcagggcttctacaagaacaagtgttcttaatctctcctgccccagattggattttgataggagtcggagcctcaggcttctgtgcagacacatttgtcagttgtttccgtgagcgagctagcttccttccttccttccttccttccttacttccttccttccttccttcctttctttcttattggctattttctttatttacatttcaaatgtcttcccatttccaggtctccccttcgaactccccctattccctcccctctccctggcccccgtgagttgtttaaatgtgagtttaccatctgcccacttgagtgcagtgcacaactaactcctcccatctgccacccgtagctgcacagttggtaaatcctgtgatgagcagttacatgatttaccattgtggaggctgtagccggagctcagtgtgtgcacacttctcaccgccgcccaggctgtggaaccaaagctccttgctccccagcagtttctgaggtgccggaagcagccaggcagggaggtggcagagggctcttgctgttcccttcagtttgttttcctctgatgcttcttggtgtcttctcttgttgtggatcccacagggccacctccacattgcccaggtgcctcaaggggagcaggtgcagatcacacaggacagcgaggtgagtcaggggtcctgtcatggtcccagggccatacagtcctgcactctgtgtggaaccagtggcattctggcagagcctgggatgctctctaggagagactgcctggtgcgggggtggggtgggggatgactgggacgcttttctggtgtcctttacagttgacgatggtgtgcaatgagctctgtggagaggcactgcacactcagagggtcctctggtcccagcagcgggagcagctccctagctattatgactcaagcagacagtgctctgataatatattcttgctatggggacacggctctgctatgggccatctgggctactgtgcacacaccttgtgaatctacagttgtttaaaagaaaaaaaaaggtgtcctcattcatgggtcagagttgatcattcgtgggtttaacgttttatgattttaatataagagaaaaagctagagattcagcttatactacttgttttgcttctgtgggttttattgctaaaaggggttgaatttttatacttagtggtttcctggttatttctgaatcgtgtagggaagttctcactgttccctttttgcactgtacagggcaatctgcagatccatcatgtgggtcaggatggccaggtaagtgctcacccttcccacgcactccttctcactgtggcctgcatacaggctgtactcctcagcacggggcactgctgtcgggtggggtggggttgcctccagcgagggagcggagctgagctgggctgtccgggatgtgtacagcagggctctgtcctgcgcttgtccttcctgggcgctcacattgggttttgcactggagaagaaactcccccctagtttctgcaatgctccctgaaaatctgacggacgaggtaggcttggttaaatttaagcacttcctgttctcccgagagaggagagcaggtctctgttgtatatactcggaggactcatgtgcttactaaagtgccccaggcaatgggtccccagcaggatgtgccactggcagggagggaagctggtgctggcagtgggggtttgtttgcactgtgtggcctttaaggagtttttgtgaagattggttttagttctgagttctgagtagtcaggacaggcttctgttagtgcaatgtggctttcactgtgaagacacacagaactcactcaccacacaggaggctccgctccttgttttccaaaactagcactgcctgtgctggaagacccatgcggcttcctcgtgctcccgccttggaaagagaagaaaagaagtcccaggcatttctgcagagcttgagcagttaggaacaagtagcagaggttggttctcttggaggtctcttgctgtcagctgggacagcagaggcccggccaggcttgcagttggctcccctctctgcctttgaggatgtggtttggctttggttgtcggtgttccccatgggcaggctgtacctttctgtggctgaggaaagtgaaaccctcctcaggtccccactgtttgtgttgtgaagagagttccacctggagtgggaaataaacacagtgggcttttccttgtccctgaccacttaacatgagggcagagatcccaaggtcaaattccaagcatggcagctcatggcatggccacagacatccagtcatggacagtgaggctgtgaaagagccattgcctcagctccaggtagtgacacctctggttctgcccctgcctccagtgtctcagaagcctgtccctgctgcccgctcagctccaagcagcctccctacaagaagctgccatgttggtcacttgtcacactgagaagtaacttgtccatctttaattctttgtgcatattttgtttctgtcccctgcttcccagtgtcactgtatctgggaccgaatatcaaagggcactcactgctgcccccttctctcccagtggcagcttgccttcggatggccatgtgcagcaagcgctcaagaagagctgcttcctgctgggccgttagctggttgtcctagctttccacttgcggagattctgccttcattttgtcatctgtctgttcagtcacctgactcagaatggcttcacttatggtgcaaaaggcacaaatgctccacttaccttgatgtcctcagtggagctaaagagcccagacctgtgctgggacagtcagctctgtcacctctcctcttcctaggtccacaagaggattgtgcctgttggtcttggattctttagctgcgctggtctcaggtcttccagcatcttcgtgggaatgctgggctgttttcctgaagactgactgcaggcactggctggagatgtatggggaaggtgttgattaggacgctgtcctcagttgtaaaagcttgggaagacatctatgtgggaaggtggtggggcttgctgcatcaaggctgcagcagggtgacaggggcagctgtgtccccagagggaggctgtctgccacaggaggacttgggcaccagagattcagggttaatgaggttagagccatctgagcttgggctgtcaggtgcacagctactcccggtgtagatagctgctgtggacaagtgtggtcagaaggggccattgggtaatgggaacgtttgcagcttcagtggttgttctcagtgagtggtgtgggagtgggtgggctacgtgctctccacctctgctccttgtttgctctagccagctctagaggggctctgcttgctcttggccattctagccctaagggtcactgctgtctgccagttgttgtcccacttcaggtttccaggcctttgctgcaatggccagtactcagtatctctgtactctgtacacagcactcagtatctctggattctgtacacagtactcagtatctctgtactctgtacacagcactcagtatctctggattctgtacacagtactcagtatctctgtactctgtacacagcactcagtatctctggattctgtacacagcactcagtatttctggactttgtactcagcactcagtatctctggactctgtatacagcactcagtactcagtatctctggtcagtagagggagtaggcaggggattccctggatagtgaaatataaactttagcaggatcctttaaagcatgacttagaaggtctttgtcagggttcccacagctgtgctttaccttggtttgtaagtgtaggttccaatcagaactgatttcgggctccttggagtctggccgagcgctctgagttcagcctcaggctgcagcacccagacacataggttgttgtctcccttgtcttccggccagtgtgtcttcttgtgatcgctacctgtcctttatgtgaccttccattagagttggatctgatctgcagtcactggttgtagctgtgggaaagtgagggatgaggctgagccagggcctctaggtgttcactgcactgtggctttggttctgatgggtctcgttgagagtcagctctgggagcctggcagattgtttaagctgatggtgatgtcttctccggtgaagccatagaatcactggaggtgggtgactcactgctgccgcccattcctgacttgtagctgtgcgaatggtcaaggagagtggtctaaggagggttgttgtggtctgataaaattgtttgggtggagcgtgggtgggaagtcaaagcagggtcagagaatctaggacctcttgcaaggggatctggcagggcagggctccagaattgggctgtgggtgggacaagcatgttgatgcagtacttcttgtcaggtcagagggatttcagtcctcacagtcagtacagtagaggctggagttttcttgggtgcattgaaggcgctaaacagtgacctttttgaggtcatggggacttcttgaggccagcaaacctgtagctatcttgagaaggcccctgggggctgacctcggtcttggatagtcactgcccacagatctgagctttgatgggagccactgctgcctgttaagcttcctccctgtgggtcgttgcctggacagctggggccccggctggctgctttagtagttggtggcagtgtgtctggagcggtgatgtgcttcagcctcagtgagagagatttcacacatgactccagggtctttctctcgtaaacatgtgcagtcagaatagctcccccaggcggcctgggcctcactgtggctgtagtagtgtttacctttctgccctgttaactcctgaacactggctatgatgcatcccgtttattgtgaatcatgctgtgagagatgactactgttgtcagttagcctgttagtctaagacagtccaggttttcacataaattgtatttgtactctaaatggcaatatacatttcccttcattttgataagtcagaagataattcttcttgaattttattggaaacccatttaaaaattgctggggctggagaagtgactcagcaagagcagttgttgctttgcagagaactcgggttcagttcccaggttccatgtcaagtggctcacagttgcctgtaagtgcaccaccagggaatctgacacccatttctggcctctgggcacccgcactcatttgcattgacccacatacattgacccagatacacagacctacacataatattttaaaaataaaaaatgaactctataaatataatcctgtgtgtgctagccctggtggcacaggcttctctctagtcacaggtagacaggagtattgcagtgggttctgttccaggtgatcttaaacttgcaaacctctctgaactgcctgcctccagctgagcgagcttcaggtatcttagacagccatctccaccgttctctgtcctttggagcagccaagccccgacaggatggggagcagctgggtgccttcaaaggcttgttgtgggaattggactgacttttgccaagtgtgccaaaaccaggcctgttgtgttttgtacctgggcagtgtttggagcagcgagagcgggggtttaggcttgcatgttactttgacgtcttgtttttgtccctggtgactttcttggtaccttgtcccacagtttatgacagaagagtttatgaggagctggacacagtctgtggctgggaagtatgttgtggtttttttaaagataactttgaacccgtttgttgtttcagcctggtcactggagccagggcactttgaaggggctgtgttagctgtataaggtgaggtggactcaaaacaccccgaagctagttcaggctaggtccttctgctgctgctctgggttccctcttagatccctcatcccattctcttcaggggctccagacagcccaggtaggggcagactttggaatcacaggatcgcttttgattgatttgataattttccaatgctattgtttgtttgttttttctagacagggtttttctgtcttggaacttgctttgtagaccaggctggcctcggacttagaaatctgcatgcttttgccttccaagtgctgggattaaagcagggtgccacccctctcccctccccagcttcccttctcacctgtccagcttccactgccctttcagattgttaactctgatactgttgatagcactgggtacaggttccgccccttctttctggggagttggagccatcagtcattcctggtgctgagtgcctgtgcctgtgctgcagctgagcacttacaagtccaccacatgtgcactccttctctaattccgacttagaacatgtggtgcccctcccccacccccatgctagtcctcactatcaccggtggttatgtgggcatcctttcaaaccaccctatagcagagaatccacaagccagggcctgcctgtatatatattaattaattctatatttattttgtaagatattgggtactggactcttgccctcattaggaaagggctataccactgagttatggactttgaggtgtataactgtccctttttgatttttggctttggtttggttttttgagacagggcctcactgtaattctggctggcctgagactcagaaatccacctgcttctgcctctcctgtgctaggattaaagacatgcgccactctgcccagctttgttttgtgttttccatcttgagacagggtctcactaagctttacaggctggccatgatcttattctccagtccaggacttgacttaagatgtagtctaggaaggccttgagcccagggccctcctcacccagctttctcagtacttggggttataggcctgtaccaacgggtctgcttgtccatggatttcaggtgaaaaatgtagggtcatagtgatgtgcctaataacagcgatgggacagagaggaaagggcagcagcaaggcggtgtacactgaagtcacagggccaggccagagcatggtgagttacactgaagtcacagggccaggccagagcatggtgagttacactgaagtcacagggccaggccagagcatggtgagttacactgaagtcacagggccaggccagagcatggtgagttacactgaagtcacagggccaggccagagcatggtgagttggagcaggtcagcgctcactgattggcttcagaggctcctaatctgagctctcaccaggtcccctccagagagttgggagcatgctgtccagaggctagccaatcctgaggctgtgttcttccctaagaaacgctgaaggagaagttcagtgtcaatagttgagctgttctttggggttggtgacactgcaacttcttggtgccatgacaggctgtgctgttgctcacattgctcttttctaatgaacctgtcaccagtgtggtgagtgccacatggagggtgccaggctgggacactgcctgtaggcatcctctgttcccttggttttattggctctatgtgcttgggcaaatgagtcagtatcccagactgtgtttcctcacgggcagagtgcagctcagagtaacagacaggtaacatctgtgccgagaacctggagccctggctggtgctaacctcaggtcgtcccgggtgctcacgattggactggggtcccgaggtccctgaagctccttacacaaccctgttcccccatgctagtgtcctctcctgtcctgggtcccaaagtccctgcagctccttatacaacccaatgctagtgtcctcgcctgtcccgagcatcctgagtcttcctgttctggttaggctgaatggcagggccgcaagatcctgtgacatctaggatgcttacagccactaaggtcttaggcttcagcgccccccagcaacagggtgctcttcctgtctgttttcacgcagcttcctccagctccaggacccctcattcactgcaggtgcctgtctccccttaaccctcccccccttgccactttcacctgccaagccttagacagaagggagaggtgaatatggcttccttagtgggtgacaagatagcttgagctccatctctgaaatggggcatttctgaaggggccacagtgaggaagggctcttgccttgcactggggcttttttccagagcccagtgttaccatgggaacaagggaatctgtgcactggctctctttttgcctccagtctattcttggaagtgtttttttttggcgggtggggggggttgcttgcagaatttctctactcccaaaacaatccatgtgctagtgttttggattcttggtcttagtcatgtcaaagtgacctcttgcttatgacgagtcacaagacttgccataaagagcaactgtcatgtcatgttaagggagcttttcgttttcccctgtgcttcagtggggactgtctgctgcttcccacttaaagcccgggagtctctgcaacagaggctgggacgcttcttggggagtttctcaagactgctcagttcccatcacactttactctctgagttctggggtcagggctgagtgctgtactccttgctagcagagtcctgaggcacagagctctgagaaatgcttgagcttgaggaggctcagggggaagacggtgggcctggcaacactcagctacaggtgagacaggctgggcagctagtgtgcattaccttgccagccaagtgggccgtgctctggtgtacatgggagggcagggcttgtttctttatggatggatatgtgaagctcttcctctgtgcctcttcaggctattagataggtctgctctgcccacttcagagctggaatttggcttttaaagtcactattttgtgtatttttttgcattctggtgacttctttacattaagatactacagattcctactgacacccagcagggatccagcatttatctttgtcactcctgttagcaaggggccctagagagtgtggagaggacccaaggaagcagttagaggagaccattggtggctcctttgaagggcattgagctggcccaaagcagctgcaggagaggacaggagcctttagagaggcctcagggtattctgggaagttcttatcagcctgtggtccagttggtagcctcaagtgaaaggcttttttgtgctttgggatttggacccccaaacccctggtccctacttggatcttaaatgaaataaatgccacagccttcattctaaaggccagagatgttcagagcaggcgaggctacctgtacagggcctgcagaggagtccaaggcacttatagaggctgcccatccatctttattgaggcactcagtggaggccaggttgcctgcacagaggtgtgcagaggaggccaggttgccttcgttaattctcgagactctggaagggctttctgcttcttgtactagatccttggtattccttggcttatggtcacatcatcctagatagcttctgttgttttacagccttctagaattgtgctctgtgtttggatgtccctatttttggaaagacacttgtccttaggttagggcttgccctgatcctctaggggccctgtttctaagtgaggttatactaagatatggaggctcatcaaacttgcagagacagtccaacccacaggaccaggaccaccccacctccaccctacatcaccattggcattgtttctggcttcctctaccttaaggttccctcctgctcactcccagtttagcggcaaagcccatgagagcgcagtattggaagcatggctaggcgtcagcctgggggcttctctcaggcagcctgcctggctgctgcatacctgtcattccatagcccaggccctctcctggctcagtgtgcaagaccacatcttcctagggctttggagatgaggctaggaggagtcactgcagccaggggctctagaccacatctgtcgtatggtggcatacccctccaccccaaggtcgtgaggccctaagtctgaacccccggtgccatgtaaatgctgtgcatggccccagtgttggaagcaggcacagttagatccagggaggaaaatgtggagctccatatctgctgagaagccctatctcagtggagtggggcagaaagcaatggaggaagacatctggtgtttccctctggcctctacatgtgtgtgccataacccctttcccatgcaaacacatgcataacatatgcgtgcatacacatacacacacacatacacacttagagggcttaaaaatgacagagctgagcaagagtgagagcacctacacttgagaggccacagagggcagctgctcgtctacctctggaggccaggcagggctacagagcaagaccaagctgctagtttatgtcagcttgacacaggtagagccatcagagaggagggaacctcagttaggaaaatgcctgtaaaatctggcctgtagacaagcctatagggcattttctcaattagtgcttgatgtgggagggcccagcactttgtgggtgctgttgctcctgggctggtggtcctgggttctataagaaagcagactgagcaagccatggggagcaagccagtaagcagcacccctccatggcctctgcatcagctcctgctccaggttcccgtcctgcttgagttcctgacttccttcgctgatatacatactacactgcagacgtgtaagccaagtaaaccctttcctccccagctgcctttgcttgtggtgtttcatcacggcagtggtaaccttaactaggacagagacccagaaaagcagtcactggggatatggctcacttggcagagtgctcgccacacaagcatgaggacctggattccaggccccacacccacataagaagcctggtgtgacatttgcatctgtaatcccagccctgaagacctgggtagaggaaattttctagggtctacgggcctgccgggcttgccagattagcaatttccagattcaatgagagacctcatgtcaacatagaacatagagagcaatttacattgatctgtggtgctgggcgtggtggtgcatgcctttaatcccagcactcgggaggcagaggcaggtggatttctgagttcgaggccagcctggtctacaaagtgagttccaggacagccagggctacacaaaccctgtctcaaaaaacaaacaaacaagcaaacaaacaaacattgatatgtggctggtagatacacatacatgtgtgcacgcacacacacatgcatacacacacatacacaaatatattggtgtagggagggacagcgagacacaatcagttagagttttgctgtaggaatgtgtgtatatgtgaaatgtttgtggctagtctctgagcaagtcagtggttggacgtattactggatagccgtctttctagcacctcaccactctcgggagaaaacttccgtttgagctgtcacatgggttgcagaaagatccttgttgggttggatcaagttagtgagaaacaagtttagcgtcttgggccttttccctgcagctgtggtccaggccgtcttctggccacactaatctccgcagggaagcatgtctactcctggcacaaggcttcctttctcctattttggttttacccctagtagactcttggtgggccttggagtttgatgtgcagatactgctgaaaggtcctggggcttcttgcattgactttagggttagcaccagttttgcattatctcagttgggttttaagtagagctgcagagttggcaatggatggaggaaaagcagatggtgtatgtccaaagcacagtcctcctggttccctcagtgcgcagtttccaactcctgcccgctgctgctctttcttacgtctgaaaagaattggcactgcttcagaatgtgttaagggagctgcaaccagtgaagccgggaatgtagcagtgcctgctcctcgtcctcgtctctggcgtgtcagtctgtgctgtcccttggggatccctgaggtcagctgtaggctagctggcgttggctgccgagagatgaagggtctggctgttgacctggcgtcagctctcatgtcactgcagtcagacgtttctacatccagagcctgttgggagaacctgcagatcagggctctgttccagatgcggggtgagcaggcagagtgaagggaatggaagttcatctttgggagatatgtgcagacttgcccctgtgtgccatgccatggtggcctgcattgctgcattcttttgtagctgaaggcttgtatctgccagactcctccctgtagcagcggggatccccaagaagactcactacttggttttcttgggcagccaaaatgtaccctcgtcacccaacccaagctcatcgatgctgtccaatagctgggatctgactcaggtttttattattcaccaatttaacattaaggtcaaacctcaacctgtgcggttgattctcttgaagcactgctagatgccagagactggaatgtgcttgattcaggcatgcagcggaccttcctgtgctcattgtgatacaccacacatttaacatttgtagtacatacctgttgggttcctctgcaattgtcagtcacagagcaagtggtccagtgttgctggagtctctggagccttgtttgtgggctgtgtggttagatgccatgtgtcctcctccctgccctgcctgccatctctggctcccagctgtcttcctacagtgtccttgtggctgtcatagctctcacctgagagtagcattaccagtgacaccttacttagcttgtctcatgtagctctggctggcctccaactcacttaaatagccaaggctggctttcaactctgcttctccctatcaaatgctaggataatcagccatcatgtgtggcttaaaggtgcttgttttgttaaatgcctcggaaactccttctggtgctggaggcagactcaggaatggcccacacagcagagcaggtgtttgtcttcccctgttgctggaggaggaatggtcactagtatgacaactcctgagagtggaccagaggcccacggggcaggcccaagaagcatggctagaactggacactttgagggacggccaggccttcctggcaagtaccctcctatgagtatgatgatggcaccctgacacgtatcttgatctcttcatcacagcagccagccaaggtgatggctcaccagctcctccctacagctgaaccagatgtggtcagatcccgtagccaggatccaggccccacagcctcctcactgggagacaatttgtaagccaggcctggtagcttctagtctttgaaagccatgactttctaagcttttttccagctgggaatcttgcttccattcattgattggttggtcaagttacacctttgtcttaatattgcaaattcaggttttcctacagtataacacctcacgtctcagcagcttcacatttcatatagaaagtggttttcttggcagtgctggtaggacagcgctgctgagcagggagggtgttgtttgctacaatcagcacagcagagttttctgggaaactggttctgtgattgcaagagtttccttaaatgcaactgcagctactttaaattcatcatggaggaatctgtaaaaatgtaacatgattggggaactggttatgtcataactcctaacttggggtttccaaatgtggcctggcttctgagttaccaggagatagcaaaccaggcagccacagtgtatcagcacctctcccttttcctacctcttccccacaaggtgggatctgtggcttgacaagtccctgcagagcctatagcccccattctgatctcttccagtcgtggggcctgtgccagaatcccattcctgtcagcggtgactcagtggcccaggctaatccctcccagctttggcctctgggaggagacacacttgatctgcctgctggaaatgaaatgatccaggtttgtaagtgtttcttgtcgggagatgtgggtggcctgaccagtgttttccagggaccttgaaagaagggtcaggtcagagctctggacagcaggcacgtcctgcttgccataggtccttacagagcctgtgccacacactaagcccaggcttacagaggctgccacaatgactgccactgtctatgctgaatcccacagaggcctgaggctaagagcttgcttgggcagccagagacatcagagtggaggtgcatgttaggggtttggcattgctgacaaggtcactgtgaacaggcatggactttacatgcagatgtgtgcatgtgcacatctatgaccacatgtgtcttaagacatgtgtataggcatacgaaacaattgatggcatatgaagacatatggcttgatgaatggccattaagtcaggcccatctgctgagcttggagccttcgtcccacggagcctttcattcttggagacagggccattctgctattgcagcagttctggtgtttgtgtcctttccttccttctgaagctgctgcttctgctgttcaaggaacccccccccccctcccactgcctgtccttgggttaccctggtggatggcccagggtaggtcaggggagacagccaggtacacgtgggccaaagatcctccatagacactgtcctgtctgtttgacctcaggttcttgcagtgagactaggaagctccggggactcagatgctgtgtgggaaatgttcatctgtctgtagagcatggcttcgctagcctgcagggttggcagagaagcatgtgggacccagtaagatccacaagaactgctgagtaaagagagcaggaggtattctgggtaaatgcaggggaagagagagcccaagctgccctgcctacccatgaaaggtcaagagtctggaagagccaaggctctaaccaagtctgccaccaatggccgtccccaaacaggagctcttgcttgctctttcctaaatataaaattctaggttttgtttcacgttgacctgcttggtcagatgaagcagagcaccaggcctggagaaatgtagttctgagcacagacgatgaccttgcctacaagtcagtgtgaaggagaaacccaagggctctgtcagtgactcttagaagactggatcattgtactctgttcaggcttttccctctgcaaggggcctagctttatctaaaaccaggagcctttactgtcagtcagctgttgggcaactcagcatctgttgccctgctctgctctgaagagggagggtgtggccagtagcattgtgcagcagctgtgccagagtgggtgtggaatagggaacgctgaggttttgggggcagaagtaccaggcaagtgtttatgtggacttttgagcttgcctggaaaccagagcccagatgtgtgtttgcacaccctctttccttttaattaacctgagtttaagcacctagagagggccgagggccagctcccctgtgtttgcatagcccactgcctgtcaccatggcccatggagattcctgtcctcctatccccagatgttgacatacagaaaagcatcagtaagcaggttcagggaggtgtgtctggagggctgtctgtgtgcagggacaggctgtcactgctgctgctgtctcttgactcctccctgagcagagtctgtcagggcctccataggtgcgcggactcacactggaagtgagatgacccagaagccactgcactctccaggaaagaggtagagcgaccacttcccaaagacatgccaagagtccttaggaaagagccacttcctgattctgtcactgcagcccatctgacggagttcagcagcagttgccaaggggacagctatattcagtcttttggcagtcatttccccaaatagttctcactttttcttagctattcaaaaatgttaaaaagggcttttcagtcattaaaaaaagtacccccccccaatattttcccactaccgtgaacctgagtgtgttttcgtttggcagaccctcattagcataagagacactgtcctcgattgcagtgtgtcctttaaaaaggcacatgtcatctgacagcacagctcttcttagaagttgactgggtgtttgtgctgctgtctctgcttgtggggaaccacatggtcttctccataccaaagggtggtgtgccatcatgccacaggagcctccaatatgggcattccgtccactgctgttcttgcctgcctgggactgtacaacactgatgagggcggggcccatggttcctggcaactgtgaaggagcagatggaggctctgcattgcctgcctcgagccccctgcccagttgtgtgagcaccaggtgtggtttgtgggaagtgaatcagtggtaagaatatccagggctggggtcaccccaagggtcaccctgagtttagtccctcctccaggtccattctgaggcagggtcactagttatacagggtcaggatgctggaaggatgcagctaagaaggaccgaggggtctgttctgtagtgacttgctcctggtgtctctgcttataccctccccacagcctgtttacctctcactctccccaccacagtagctcttcccttctctctctctctctctctctctctctctctctctctctctctctctgtctgtgtgtgtgtgtgtgtgtgtgtgtgtatacgcacacagaggtggatggtatcctcatctgtctttacctttttcctgagacaagctttctcactgaacctgcagctcactattttggctaggctggatggtgagctagctccagcaatcttcctgtttgggttacaggctagctccagcagtcttcctgtttgggttacaggcatacacagctgcccttgatttgtgtggatgctgaagctccaaactcacgtcctcatgcttgcatacaagcagtctacccaccgagccatctctgcagcctccctctccttttgcttctctatctaaagttattggctccacatgggctctgtccagggctttgttaagctcttctgccgtcttcagtgtgcccgtgcaggcttcaagttctagcttatttgttttgacacgggctttaaaagactaatgcctgtgtgtcacaagggtgtttctgcaagactgagtgtgaatgtggcatatttcatgacagtcgaagactcaacactcacataagcagacgtctctctgcactgggcagtgaggctccattgcacttacatccatgctgcaggcctgggggcctcctgctgctccaggacctgaagaggataggggtctgctgacccgagctccactgaccagcctggctttgtccccaaccccaggtactgcagggtgctcagctcatagccgtggcctcttcagaccctgctgctacaggagtagatgggtcgcctctccagggcagtgacattcaggttcagtatgtccagctggcgcctgtgagtgaccacacagccgcagcgcaggtgagtcccgttcgtcccggtcccaccagcctccctagtagatactgaacttgggcttgtctgacatacctgtagacccaggaacccttgtcaagaggcatacaggtctgaatcaggcgtggggcttctgtttactcttaactcctgagatcagcgtctgtgggctcctctgatctcagcccagcaagaacaggtgacctggtaggaggagaagactctacagtggagtctgttccacaggtcaagtctccttaccttgttctgcacagctgctggcacaggcagctttcctggagctccttcctctgcggcctaagcctggtgtagtgagcagcgcaggctctcacagggttccgctcacctgaactcgagaatagggctttggctgtaggctgctcaggattttacttctcccaggagctgttgaggcctgtctgcctcaggcattggaagggcttacggagctgctaggccaggcatctgaggagaaggcactgtggaattcctttcctgaaggcctcggaatgacatcttccaggttctcagagaaggaacttgggcctaagtgaagacttcccatctgcaggcctcagccatgacccccatcacgcctcaagacacttccttcagtgtgccacacagctgtgcatagctgcccacacctgggctgcactcctcctcctcctcctatttatttatttatttatttatttatttatttatttatttatttataaactggctatggcctcagccatgccatcctcagtagggagagtggaaacttttttgtttatctttaaaaatcagagacttacatgtacagcaagagctgtcaggtgccagccatgtgagaccttggcctcatgtggtgcagaacctatgctaactctgcaccaaatcttaggtgacttatccttcagtgcatctgcagtctagcagagatggaagagcagtcattattccaaggttgcaagtcctcaccttgaagcagtgacttcatagactttctcatacacttcgttgaaaggtgccatgtctttaagctgttccaagatgccacttagaacactggggcagtttctgtaggaagtcagtgtgaccctgaggttctagggaaatatgtcaggttaaaaatgtggtgtgtctaattacagttgtttctcggggcaccgtgaggtaaggctgggaagttgtcagctgtatgcccagctgcccacgttcttctgggtggatgtgagacatgcttgtctctcctcaggtcaggggtggcctggcaccttggcttctgaagttggcgtgccttttctaattgtgaaccttgtggctctgcataacacataggtggcttgctgacacacacatgtgctactgtgtttttctagaacccttttcatttctctccctcccacccccttgcagaccgcagaggccctgcagcccactctgcagcccgacatgcagcttgaacatggggccatccagatccagtgaggccaggcactgcaggagcaccgcgtcacagctgctcgctgaccctgccccactcgtgccctgctctcttgcttcagcaagcaactgcaggttctgctgggcatctgagagctgctcctcccaggggaaggtcctggccacccctgctggaaggcgcctcagggttggagtctcactactggtcgtctccaaaggagaagcatagtgcagagtgttgagtgcattcagacagacaagaactacgatattttgtttaaacagcttttttaatttgctatggtgtttataacaaaaaagaaaatggaaaaaaaaaaaaaaaaaaaaaaacatccaaccaaccaaccaaccaaccaaaccagaggagaaacacaactgtggagtagtgaaagcctgggccgtgtgctccccttcggggttctgacgtaggtgttggagccagctggcgatgctggagcacttggacctgctgctaggggagtgctccccagggagtgctccccagtgtgagtatgcatttctaatgaaataaagtgtatttatggccacagaggctcagtgttgttgcaccgtgagaggacttccccatccagggccatgctaccagagagtccctgctttggctctctctcctggggagcatgagctgtgggtatcccttggggcagctggctcccacttcatcacagtgagccctcaaaggcaaggtcattgtaacccatcctcttctgaatgcttaggctccattacctgcaacgccaggggtcctggagagtgccgtgtggagaaggcaggactgcagagaaagcaggtgcaaggagtcccatgagcagcatgggaaatgccagtgaagtccttactgactgacagtgccgtgtttgacgctttcctgggaggatttcaaagttgtcccagattctgtctcatgcctctgtctcatgccaccacattctgaattcctgggctggttattcaccagggcacaccgaggtagcagaggagagcagccctatggaaaggacaatttgacatggtggtggccatcttcttaggagacctgccactgttagagatggctctgtgtggggaaaatggggacaggcgtggaggctgggttcccaaggctgtgtaacacatctgggcaggatcccaggcaagaatggagaagaagaatccagagaggagagcacactccaggaagagcatggcataggcccatacccagatacacaagatgggtgatggcagcagacctgtgccctggaggtcagagtactggaaaggaactacttccagctgagtcaggtcttcagaaaacatgttcagaaagctagttgacaatgtaccatacgatggaccctgcaggtgtggatcccaggaatgccctgtgtccgtacacacctgtgtgcccacattcgcagtagccccattcataatgagctgaggtggaaatggcctaaagaccgagcatatgagcaggtgagcaaaggcacacctcttggtatcggtatcgagggtgagctgactgccagaggatctgcactccggcccgctctatggcatgtgaacttgcagacgctagtgagggaaagaaagcagagggaaggagacagcttaccggaagatgatatggatgggaggattcacagagacagattgtcaggatcatgcatcctgcggggcactgaaactgcgcccggttggacagtggatatttgtcttgcacaccaggtaatgaccggtcactcgaaaaggtgaaacagtcgctgtccacgaatgctcaaggttatttttgataaatggatcacatttggcaagaacagaaattgagattatgcgctaaagatgctcacaaaaaggggattccaggggattttcaaggctaggaacgtaggcccagatggaagttctccagcaagagaccactggaccacttggaacagaaaaggatcttaagtgatctatataaaattgactctctaagattaaagacatcaaaacagaggaaaacatgactatctcggggcgggcaagaagagaagtaaattattttaaagtattcttcattgccttgaagaaaacagaaagtgctgtgttcagccttcagtatctgagagctgtatagagacctgtcactgttggtacacaatgcttgctcgcatggctggtagccctggccttgtccttgtaggacatgacccagcagcttgagaaaggtctgttcttagatgttctctgaggcattgctaaagaactttgcttgccacaggctccgagccatgttgtgtgttctctgaccacatggaattgaggtagattttaatgaggaaaaaacttcccataggtcaagtaaaaaaaacttggattcatgaagatgacgtcattgaatgacagatgtcaaaatgtggactgcatcaggtgtgctgaggaacagctgcagacaagcttggggtggagaattacgtcgtctccatccaaaggacaaaagcagtgttggtgctcagggaggattacagatagaggagttccatgtataacaatgttcagttgatgaagtcctggtaccagaagggtgaaggctacaagctgccattgtgggcgtctccacagacgccctcaggcagtagaagatgaggttctcccagatctgtatggatggatcgggaaatgacagatgggatgacatgctgcctggacaccagactcgggtgggggcagcaggagaaggaaggaggaaagaagaaaagaaagattgttgttgcttctgaatgtctgagctgtctcagagcaagaacaggctgtgcttggtggcaacaagtgatgtgtcaccctaccccaggttgagtcaggttcagtcatgcatacttggtatattttgaaagtcatgtgacttaactctggtaataggaccatgtggttatcttaagcagaaaaatagtatgtaaaatttacctgtttatagttaagagacctttcagcaaaatcacaatagatcggatcagagacatctgtaagaaacctgtgacaaatatcccagaacttggatttggaaagcctggcatgacaaatgaagatgcctggcaccttggttattctgagattggaaagctaggaatgagactgtctatataatttggatttagacacctgatggctatcccacacactgacccaaaaacctgcgagtgtgctttgcctgggtgctggctacaggctacttagaaatcactcccatctcaatcagaatgggctcgggtgctcttagctgctgtttattacagactctaagacgctttaacccacagaagtaaatttaaggggatgctgaggcaaatgttactgaactagagaaaaaccaagaaaaaacctcatctgagaaagtgtgggttctctaaatggtgcagccagtgaggttccatgcagaagctaagcagggactcctgtggcactggacaagtaatggggactggttggagagatggctcagtggttagacttctttctgctttcccctccacagtggggagagctcactgcctgtaacccgatgcccctttgattccccacactcctcccactcccagggcagacgtacacgcacagaaataaaaataaatctttaagaatgacaattgtctgtcttgatggacctgtgtgtggcccatcagcagatggcacggaacactttgggacagagacccaccatgaggatgtgaaggttctgggacaagggacccaaggtccacagtgaagctcatgccagttgggatttcacaaggaaccaagtgtgagggatgcagtaaactaggtggtgaactctggggccttggcttgggcaagggtgacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatcttcatatgcccgatgaacaggtagagggtcagcctcaccgcactgagataccctttaacccatgatggtttactagacagtcctgtggcgagaactgtgagcagctgcaccccatggagtgaggtggccgctcattcagccttcagggatgatgctctagtgatttctagggagcacgggtacagggccagatcccagagcccctcaggcacaggagtggcggactcttcctcagcctgtgattgcctccagacagcattacactgtccttagggcagagagagcaggtgaccccctgcagtcaagctgtcaggttggatccacgcgtgtagtgtggactgaggcaatctgccccacctgccttattacctgacgtcactgctggtgggaggaactccacagacgagggctgtgtgcccggctgagctggctgagccccagcctctcgtggtgtgctcactaggcctacaggacagaaggaacaagatgccagatgtgggaatagtggagtggcacccttctgggcaggctaacaaagccctggcagagaagacacctatgtcttttgtccaaacagcatatgatgcaggcagtatcagcgggacgttccttaatccttggagctgtcgctatgactcgagaaagtattacttttaaactaatagggtcgagataattacagccagcaaaaatacccaaccagtccaaagaagggacaggacacagggagtgtcacggtgatagtgaagctcctgtagggatatcagaagccctggagaaagggaggcgtaggtgaggaagggacacttggtagttggggggttggggtcacttttctcttgggctgggtggcctgtcaggtggcagctaagtggatactgggcttcactacccttaaagccagtcattggaaccagacagcaaagagtatattccccaatggaccgtgtgctctgggcgagttctagcagggtgcaccctggtttacagggcagccccacagctaacttgcattgtctcagctgctggccagcatggctgagactgcttgtgtccccagcagcctggtgggaacaagtgtcaatcctgggaggaggaggaggaggatatcagattatattcacaggcacctttgcagacagaagcaatgaagcgcaatgaaaactccaggcagaagcagaccagagaggcagatgctgcagccaccccaggcggccttaaaaatagccctgctggctctgcagagctcaagggcttgtggagaatttaagcaatggaccgagtggcgattctgcagctagacaacagatgagcagtagcacagacagctgctgtcacagaaggtgagcctgtcagggagattgtggatgggaaagcaagtagatcttcgggatgacgtgttctcccagccccagggaaagtggggaggtgggggtgtcctaggctctctgtatctcagaaagtgggacacaaggcactccccatacttaaaggcaggtatatttttgatttgcagagaaagacatttatagtagtcttcttcagacacagttaaaagacacagccaaggttagcaaatcaaatcccacaaagtggagagagctcgtggggttctgggtattatgtttccaagtgtcctgatgagcgctcctaacggattatctgagtcacagatgaacgcagtaactcaagccctctgggcgctcatcatagcccgtggtgtctctggtgtctacagtctacaggtgtgctctggtctgatgtgggatggcattagtgttaaaacatatggacaggtcattaagccctctcagcaaaaaaaacctgtgtttaataaaatgtaccagtcactcaaaaacagtggagaaacccagatgttctagaagcataaagaacttcacttcacagagggtttttaggaaaacctggaacacagcacaaggctctcagtctgtggtgagaagcaggccaggtgacacctgtgtgcaggtgtgcacaggagacaacagacagacaggctcaggaaggaaaaaaaaaaagcacagctcatgtcgacaattttagaaaattccaggtagctgccaaagatgaaatctagagtatcagcaactctcagagataaattattggctcaaaaaccaacattcacaatgctactgtgctcctgtcttctgtcagtggaaatgtagaattaaaagcctatctttaaactagcctcagctgggtgtgctggtgcctgcctgttagcccagcactcgggagcctgagtcagggattgtgtgtttgaggttcacacacaatctgtaatagtaaggccctgccctacaagcatgctgtagcttaaagtcagagtgtcatgcagttcgcagctgcaggcacacagactgctggcacagctctcacataagacccgagcccccctgcagcataggccacaggcaccagcggcctgcagccagggctccccatgatcatcagccctggactatcccctccacttcctcctatctttacctcccatgcccctgtgacctgggacagaaacacagtaagcagctgcgtgcctaccactgctctgttgccctaggttatcctgtgaccctgtcccaccatctcccacctcatgccgccaccacagtgctaacacgttcttctactggatcaaaaagaaatcccatagttcccgctgcctcaccatgcaacctccctccctttgctcccacagctgcctgcccaccactgccccctctagcagacaacaggcatggtccacagcctgaacatgggtcagtcgggcaaggggaatggggagggctgagggcccaggactgggcagggagaaggtggggtgctgaccagtagaaactcagagactgcagcagcagcacccgttcatcttgatttcttgtcctctagagtcagagcagactgtcactatatatctggcacccaggaggataggatggatgatggctcactggcagtgaatccccaccgagttttatctgagatcatcacgcccagcagacaggagatgatggatgggccatgcttgccgctgaggaagcaagggagccaaggtcacggtccccccagaggagcagtgctgcacagcgggaggaaaactgcccagcttcatactttgaaagcctaggtgcagcggggcctctgtccatagtggctccaaaggatctggagctgaggtcctgggcccaagggtcacttggcgaatagtgcatctcccgcctaggagagctggggcattcactgctcttcctgtccactccttggactgggatcccagtgagtctggctgtggcaggttctggtccaggactgttatcccttgctgactccaggctccttcaggttgttgcccatctgtatgtctgtagagacgtgggttcagtggccctttatacaatctccttcctgagctagatgtgggtttcacaattgtcccttgtgtgtggtggtgtcgtggataatcaggaaggcctgtggctgctcatttagatcacatttaagatctaagcaaatcctcaggttgggttgcaaatgataaaacaggggaagattagccccacagggaatacttttaggcctttggaggaatggctcagtcactaaagtgtattctgtccaagggcatgagtttagtccccagccaccatattaaatgccaggcatggcagcatatgtctgtaagccctgagctggggaaatagaggcagaaggctcctcaaagcctgctggctgccgtctagccgaatcagtgagttccagggttagtaagaaaccgtgtctcagaagagaggtggagaatgagttaggaagatgcccagggtcgacctctgttgttccatacacatacatactacacatacatgtgtacacacaggtacatataatgcatacatgtgaacacacatatatgtacattctacacatatatgtaaattcacacacaaaacagcatctgtaggcaggtagaccaaacttaagtactgagagagggggctcagagaacatggctggtaagcttctaggtgggggtgactcagggagaaggcagactgtctacagccccagggtatgtgataaccctgctgtgctttctctgagcctttgtctgaccccacagtcagatctggacattcaatcctggagcccttgggccccagccgtagatatattccacctttaatcacatgtgaagcttcaggtagccttctagttgctagctctgcctgcctagaaagaaacgacttgctctggagacccagggacccactgtgctcccagaatctggaactcccttgaaggtcagcacaatgactgacaagtagcacccacctctgaaagtccctaggggtggagggttagagaggtcagacagaggaaagctccagagttagagacataaagagacaaaggcagacagtggggggttagagaccctgtcttaaaaatcagggggacctgagtggcagtgatgcacacctttaatcccagcactcagtagacaggggcaggtggatctctgtgagttctggccagcctagtctacagagattgttctaggacagtaggacagcagagctacgcagaaatcttgtctcacaaaacaagaacaaaaccaaacaaaaagcctcagaatcagccataaagacaggcagagctggagagacggaggcagagatgacgatgaagcatctcgaagctctcccttaggccatcattcgtgaggctgggctcgacagtgttggatacttttggccagtgaggctctatacctggctgggcctctggacctcagagtcctgccattagtctctgcagatgtcatctcttctggccctgtgtggcctgcatggcgtggttcctcctgtacttacagctaggcattttctaagaggccaacattggttgactctgacacttgatttgatagctagttggctcggtacaagagcttcccccctctctcctgctccctcgcaatgggaatatcttatacgtgcagccttcacttcagctgtaaaagaaaattacctcaaacgtacctcggcatttgggccctcaccttggctccagcagcagccatacacaggaaggacctgccggggaaccagacgagcctgtgttccgtgcttcactacatccttgagtagaggaagtggcattgatgaagggcagtcccttgtcagccacctcagatgccacctgctgggacacagcagctcaggacagcacaggacctgtgcatgcctggggtttatggtgggtcctgtggtgtctgtctttactgctgggaactgggcctcagccgcatgttttcaggtccatccatttaacgtccagagtgccgacccctctcccaggccctgcctgcctcgctagggccctttccacgtctgaggtggccttaagtctggctgctttgctataaggcaaatgggcaaagtccaagtcccacctgattccaggaggccggccggttgctgtcccgaccctgtcacagctggctcagagctaggaactgtgctgtctttagggccacacctctgtgttcattgttaacatctgggtgaggagagagaggaagacaggccagaagagtgtgccaatccctatcccaccacctccaactctgctctgccacccaccctgcagaggtgccttcagctgccatcaccaggaagctctgcaagcggtgctaccaggtcctagaggggttaatcctcaggcagacgcagttcctgctagtcagctgaagcggttttgcagatggtctgtgtgcccagttggccctgtggctcaggagaaaaaccacttaataatatttctttctgactctcaaccccccccccccattgcaacaccagtgaacagatagatg

SEQ ID NO: 356 - DNA, 1902 bp, Mus musculus
ggtgacagaaaccgcataccctgtgacttctggactcttgctgtcagtgtgccccttcctcgtgctctggatgatgtcagagcaggacctggcggatgtggttcagattgcagtggaagacctgagccctgatcacccagttgttttggagaatcatgtcgtgacagatgatgatgaacctgccttgaagcgccagcgactagagatcaattgccaggacccctctataaagtctttcctgtactctattaaccagacgatatgtttgcggttggatagcattgaggccaagctgcaagctctcgaggccacttgcaaatctctggaagagaagctagacctggtcaccaataaacagcacagtcccatccaggtccccatggtggcaggttccccacttggcgccacccagacctgcaacaaagtgcgatgcgctgttcctgggcgtcggcagaacaccatcgtggtgaaagtgcctggtcaggacgacagccacaacgaagatggggagagcgggtcagaggccagtgactccgtgtctaactgtggccagccaggaagccagaacattggaagcaacgtcacactcatcaccctgaactccgaagaggactatcccaatggcacctggctgggcgatgagaataaccctgagatgcgggtacgctgtgccatcatcccttccgacatgttgcacatcagcaccaactgtcgcacggccgagaagatggcgctgacactgctggactacctgttccaccgtgaggtgcaggctgtgtccaacttgtccggccagggcaagcacgggaagaagcagctggaccccctcaccatctacggcatccggtgtcacctcttctataaatttggaatcacggaatctgactggtatcggatcaagcagagcattgactccaagtgccggacagcctggcggcggaagcagcgaggccagagcctggcggtcaagagcttctctcggaggacgccatcctcatcctcttacagtgcctcagagaccatgatgggaacccctcctcccaccagtgagctacagcagtcacagccacaggccctacactacgccctggccaacgcccagcaggtccagatccaccagattggggaggatggacaggtgcaagtaatcccacagggccacctccacattgcccaggtgcctcaaggggagcaggtgcagatcacacaggacagcgagggcaatctgcagatccatcatgtgggtcaggatggccagtcgtggggcctgtgccagaatcccattcctgtcagcggtgactcagtggcccaggctaatccctcccagctttggcctctgggaggagacacacttgatctgcctgctggaaatgaaatgatccaggtactgcagggtgctcagctcatagccgtggcctcttcagaccctgctgctacaggagtagatgggtcgcctctccagggcagtgacattcaggttcagtatgtccagctggcgcctgtgagtgaccacacagccgcagcgcagaccgcagaggccctgcagcccactctgcagcccgacatgcagcttgaacatggggccatccagatccagtgaggccaggcactgcaggagcaccgcgtcacagctgctcgctgaccctgccccactcgtgccctgctctcttgcttcagcaagcaactgcaggttctgctgggcatctgagagctgctcctcccaggggaaggtcctggccacccctgctggaaggcgcctcagggttggagtctcactactggtcgtctccaaaggagaagcatagtgcagagtgttgagtgcattcagacagacaagaactacgatattttgtttaaacagcttttttaatttgctatggtgtttataacaaaaaagaaaat

SEQ ID NO: 357 - protein, 532 aa, Mus musculus
VTETAYPVTSGLLLSVCPFLVLWMMSEQDLADVVQIAVEDLSPDHPVVLENHVVTDDDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQDDSHNEDGESGSEASDSVSNCGQPGSQNIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPSSSSYSASETMMGTPPPTSELQQSQPQALHYALANAQQVQIHQIGEDGQVQVIPQGHLHIAQVPQGEQVQITQDSEGNLQIHHVGQDGQSWGLCQNPIPVSGDSVAQANPSQLWPLGGDTLDLPAGNEMIQVLQGAQLIAVASSDPAATGVDGSPLQGSDIQVQYVQLAPVSDHTAAAQTAEALQPTLQPDMQLEHGAIQIQ

SEQ ID NO: 358 - DNA, 11548 bp, Homo sapiens
atgggccagcaagtggacacccctctggggcacagtgcaacgaccaaacagagtgatccagacttagatgccatcctgggggtgggggatggggtgagaaaacgaggcccctgcacaggagtcaaggccacagaaagccagatgggcaggtcctgggatggccaggcccctgtgcgtgtaagcgagtgtgcagaaaaccatccaagcacgctcgctggatatggagtgggggtgcagcaagcagtggggactgggaggaaagtcagtgcatttcagacaagtgccatcaagcgggcccctctcctccacggggcctggcaactgcccaccctggggggctgcaccctactggtttccccagcacccccaccgagcacctcagcctaaatgcctgtgtgtgatttgcagagtcctccggaggctgagagcaaacggctgcactaggaacccagcagtcagaccggcccccaccctggagtgaacacatcgccactgccaggcatcgcaggggtaaggagcggttttctcttctctttaaagcttgatttcacgtcatgtcctgcctttttccttatgtttattgtcacgggctgtatcgcatgaagacagtgcacgagttagtactggaatcacagcagtgcatgggtcagtgctgtgccacactgacacttggtcagtaccatgcacagttagtgctgtgccacgctgactctcggtcagtaccatgtagatatcagtgcacggttagtgctgcgccacgctgacgctcagtcagtactatgtagatatcattagtgctgcgtcacactgactctcggtcagtaccgtgtagatatcattagtgctgcatcacactgacactcggtcagtaccgtgtagatatcagtgcacggttagtgctgcgccacgctgacactcggtcagtaccgtgtagatatcagtgcacggttagtgctgtgccatgctgacactcggtcagtaccgtgtagatatcagtgcacggttagtgctgtgccacagtgacagtcagtattgtgtagatatcagtgcacagttagtgctgcgccatgccgacacttggtcagtactgtgctgatgttggtgcacagatcagtgctgtgccacaccaacacttagtcagtaccttgcacagtttagtgctgtaccacaccgatgcttggtcagtaccgtgttgattttcgtgcacgtgttgattttcgtgcacgtgttggtgctgtgccaccctgacgcttggtcagtactgtgctgatgttggtgcacaggttagtgctgtgccacaccaacgcttcatcggtaccatgtagatatcagtgcatgggttagtgttgtgccacactgacgcttggtcagtaccatgcatgggttagtgctgtgccacaccaatgcttggtcagtaccatgttgattttgttgcacgtgttggtgctgtgccaccctgatgcttggtcagtcccatgccgatgtcagcacacgggttggtgctgtgccaccctgatgcttggtcagtactgtgctgatgtcggtgcacaggttagtgctgtgccacaccaacactcagtcagtaccatgtagatatcagtgcatgggttagtgttgtgccacgctgacgcttggtcagtaccatgcatgggttagtgctgtgccacaccgatgcttggtcagtactgtgtcaattttggcacacagattagtgctgggccatgctgacgcttggtcagtactgtgctgatgttggctcacaggttagtgctgtgccacaccaatgctttgtcagtaccttgtcaattctggtgcatgggttaatgctgcaccacactgatgcttggtcagtactgtactgatgtcggtgcacaggttagtgctgtgctatgctgacacttggtcagtaccatgcacgagttagtgctgtgccacaatgatgcttggtcagtactgtgtcaattttggtgcatggattaatgctgtgccacactgatgcttggtcagtactgtgctgatgtcggtgcacaggttagtgctgtgtctcattggaataagaaggacagtagctcctgactgttggaagcagggaatagtagactgtgtcttcattcttgttcttgccttttgtccatagttttggtcttggtgtgctcatggctttgatttgtactttaaagtgtgtggggcctcatcattcaatgactaagctgccagctgggtcagagaaacaagttgagcgaaaatggacctagcatgggatctgtttgtccattaagggatttagttagattcttaatcaagagtttaaatttctgctgtgtatgcatttgataattcttacaaaatgtgactgatcctacacataaaatgttaggtacttcatttcagtgggggaaggattgtcgttgaattctaactgaattattgccaggaattggtcccatggacttcccagtcagtagaatgacttacgtggtagctcttggtgatgctggtgaaggctggtgaggcacagctgggagagttgggcagctgtgagagctgtcagctgtggccatcctgcagctgctactggcacgctgtgctgacctcgttgtcccagacctcgttgtccacagaacgtcagccatgcacgtggaaataagaacatgtagccacactgctgtgcggatttacggacctcacaatgttagccgtgcacatggaaataaaaacatgtagccaccctgtgctgtgcagattcacaaacctcgcagtccacagaacaccagctatgcacgtggaaaggagaatgtgtagccacgctgtgctgtgcagagtcacagacctcgcagtccatggaatgccattcatgcacatggaaagaacatttagctacaaacatgcctcgaacatttatttacagaattcatcttatgtaagtgtttttaacataagcgccgtatgtgtgaggtaacagggaaacactttttcatggcagtcctgagttgattgctaataagagtaggactgcagagagaggagtgatcacaataaaaccaagggaagcgggagacagcagtttgagaacagtcgcggctctgagtgccacagagcagccagaagggcagtctggggaagtgagtgggggtgatggcgtctcagcagcttgggttgagtttctggatgcacagcctgtgccccaggatggaggtgtcgggagcagtcttgacccatggcaatgttggtgctgagcagtcaggagttcacccaggctcctccccaccacctcccccaccctgaaagacgccctttccatccctgccctgtgagaccagacacttggagagcaaacttctcaggtgctagaggcgctcagctctccagagctcagccgccgactggtgttggactcgggttctctgcgtgacccggaggcgcaggatcctttttaactcagggttaaattatttttcactttaagaaatgcttaagcattacaggcaaaacctttacaatagaatcgttgatggaaaacagcccactcaaaaagacaaacaaaataaaagcagcccacaccaaaaaagcattctgaaagaaaatggtagtgttcagtttctaaactgaggtctctgtaatgtgtagcttgcagaatgtcagtgttacaggtgtctaaaattctcaaatacgatgtcacataatcataaagtccctgattttagagcgaggccaccctatcaggagcccaccgggttttcaaagttgtcctccaggagtgtgcactttttgctgttcagggtacccccctcttcctctcccctccccttttaatctttctgctccccttttcccatcccaaatattcattaagcatccactagtacctgatgggaatggaggttcttttgaagcatccgcatgtgacatcatagacatctagccagcagatggccagagttggcgtgtttgggacaaatgttgccttacctttatagggtgtccctagtccccaggatcctggcataccccaacacattatattttcttgtggggcaaataattatgaggagcccaacagataaaatgtctcatgcattccacatagaattcttattctctacgttgaataggagagatgagttattgacagttatgtttcatcacgtcctggtgctggaagcattttgagccgtgatgtgtgtaacgacacagcccggtgctgcctttaggtttgaattctgtgtgggtttgctctgtgttatccattgttggaaccatttatttcattttatgcagagttgcttttgaaattcataaacagcttgagtaagcctttgcaaaagccggatgaaaattaatttttggcatggatggcatatctaacgtgaatctgttctctgaagacttacctggagatggtgaggctgaccttgaactgaactgacatggagttggttgtgttgtggaaattaacaccacgctataaggctttgaacaaccgtgcagcccagtgactcgcaaaggatggccttctgatttgttcactatcctgctggagacggaaatccggcattcgtcgcctctgtgactgcaggggactaacgtgtggaatcccagggacaggaacactctcagccattgcctgaaaagtgaccctggagctgcgcttcccaggatgttcaaggagtgaccgtggagctgcgcctcccaggatgttcatggaagttagggcttcggtcttggacaacacagataacatttatgggaattattgtttcatctgttcttggaaagtcagcattcaaatgaaagtaggagagagagggatcttaaaaagattgtatttcaattattggttaattcctttctatagactgcctaagaaaaaaggataaattgataactattcactgtggtgtgacagtacaaattccaggctgggagtttaagtcatcgttttgttcccctttttccccccagtagggaattctgaatgtacaaaaagttgagtaatacagcaaattatatcaggaagcaggtatgagacagtgccttccatttcagtgtagtaaaggcatcatttaaactcggagtctttgaggattctaggaagagacactagaaatgtgtgaatcactggttgttagtaggcagggacttctcatggcctagagcgtttgcctccattcccagtctgcctctcacttggcctgcaacctcgatcagagtcattcatttctgcagacatctgagcgcctctcctgtgagatggatcatgggctggctcagctgctggggttactgtggggactgaggaaatgaggcctctgaagagacggaggtgtggaatcaggagcctgcccaacaggacgggccctccctcagtgcagtgtgacgtgggcctgccccatgcctagtccttagactgctgcccgcacccgtcagagctcagcaggcctttgtgctctcctggtgcaggaggtgccaggagtggtgtccttcatggtctctacacatggggccctccttgcacaggtcagaacccccttgcctcagaacctccttgctaagcagggcccaccccacagcctctgattggttgggcccgagaatgagcattttcaggaagttccctgccactgctgatgctgctggtctgagaacatgcctgaaaatctctagtacttagaggagtgaggtgggagtgatgttgtcaacaggaaatccatggacacaggtgtggatgggaaccagtagactggggtgggtcagcactcataatgtggctgtgctgagcaggaagcacagggtgtggagctgtgagccacaaacacaggccagcacaaactgggtcctgctggacgctccaggcgggagattcctgggagcacaggccaggtggccttggggtaactctggtggggcagagtttagagtcagagtctcctgcggtgctgaaaaaggccaggaagaagtgttgaggcctggacgaggccactggttgtggagggagggctcattgtgacctgcagtgcaggaggagtcacccagagctggggcagctccgtgtggggtggagggcacggccagccttgggtgcactgggtctggacatttgcacactggccctcagtgagtcctgagcctgccagaggatgagcttagcggctgccccgacactgccttgaggtggagcctggggaggacggaggtggtgggtggcagcaccccccaggagctggctgtcatcctaagtcagggaggttctcggtgtgggcatggagagcccacgtcatccctcctggagggtctcagtgacactttgacatgattttgactcactgtttgaaaaacaactctgaattcttgtccagtgtttactttaaaaatattatctcaccacagagagctcagctaagtgtgtttgagcactgttaattcctgagagaggctgcagggatctttagcagcttggtggctacagctgagagcccctgcccaccgtccccacaccatcctcgcactggtcctgcatcacccccatcccggtgtgggtgggtgatggtcggggaggctggtggctcaggatgctgctgcccttcctgctgcctgcctcgggtcctctgcttgtgatctccaggtcctaagtccagagatgcttggtgtcgctggagaccaccctcatgtacccagagttcccattaaatgagcctcagtgctgggaaccctgggaagtttaaagacagtgggcctcattgtgagccctactgacaccaggcccttggctattcctggattactgagcagctctgtaatcagctgctcaccccctctgcccgtccctctgcccatgccccctcagctcatgccctctgcctgtcccctctgcccatccctctgcccgtgtcccctcagctcatgccctctgcctgtcccctctgcctgtccctctgcctgtgccccctcagctcgtgccctctgcccgtcccctctgcccatccctctgcctgtccctctgcccgtgccccctcagctcatgccctctgcccgtctcctctgcctgtcccctctgcccatccctctgcccgtccctctgcctatgctcccttagctcgtgccctctgcccatcccctctgcctgtgtcctctgcccgtgctccctctgcccatccctctgcttgtgccctcaccctgtgccccttcagctcatgccctctgcccgtctcctctgtccatccctctgcccatgccctctgcctatgccccctcatcttgtgccctctgcccatctcttctgtccatccctctgcccatgccctctgcctgtgcctccctgcctgtgccctctgcctgtgccccctcagctcgtgccctctgcccgtccctctgccagtcccctctgcctgtgccagttcagcttggaccacgctgggcgtgggtgcctgctttctgcccaggtgaccgggccctgctcagttctccaccctcccctgtccctcgtctgccttacgttccctgctctggccacgctggttcccttaccttcctggagcatgtggcccctcctggcccaggctggtcctgcttcccactctggaatgttctctggagttcttcccctgggtggctccttcccgcttccctgcttggggtcacccattctcgtctgaggtcagctctacccctgcctgtctccctgttcgcttgcaggccactgtccctggcacttgggagtcaggaggagcggggccaaggtctcgcgctccaggagctaccaggcagctgccgcagggactcaggtactcaggtgctcttctagcgcctcagcggctttcactccattcgtgctcctttacctggggctctgtaccagtgctgccaggaggcctggctggcccgggctgggagcccacattgagcagcatctgtgtgggatcgaggctgattcccgcggccccggttcacattggatggcatctgagggtgtcaccttggcctgagcccagcccgggtgtgggagtctgggagaccttgcagtgggacagttcccatttgccagcatgggcctccgcagcctctgcttcccagccaccaggggccataagcaaatctctgccccttgcccaggccccaaggcagaacattttaaaaaatcctcccttcacaagtacagacacagggaaggattcagccccttaggtttaatctgaccaggaaatctgtggcatggtttaaggtcagcacaagtggggagctgtgtctggggcctcccgtccatgcgggagaagcatgcggcgctgggaaatgcgtggtgcaggtgccaatgctccagagccgcctcggccactgtcctcccacatcttgggtttcccctgcagattcccatttagatcttcagtcccatggagtccatgaccatctctagccatggtgtgaccagcatgtggcttcagatcttggagactggaccactcctgccttggctcacacgtcccctctgtttccccttcccctccccatggcttccttactggactgctgctgaccagggcctgtgctgctgtgttcgatgacattgacctgtgactctgagcaagagcttagatgcagagctttagacccagcgccaggcccttgggtgtcccgtaaggattcgtagatacattcatagaatccccggaagctggagtctcgtagctttgcagctgcggcctttagacagctcttgccatgagactccatccattagtcttgaggtcacgtgtttccattttgctcctcatatacaggtggaatgtaatagtggccgactgacggatgttctgaaaaaatgcacgtctgagcgtatgttcctagcagcatccctgtacttctgaaccacctctgagcatcgatgcttcttaatcatctctgtcctgaatttcaaaaattagagctgttttctatccttagctacagccaagagcccagccacactgccctgcccctgtgacaatgtgtgtttgaagacagggtgaccagccctgccctgatatttcatggaaatcttatatttcagggaatgggagaggctgcctgtggagggagctgtgcacgctaggagcacacggcagccacaggcttctcggctgtgctccaggcttactggcccacgctccaagcttcctggcccggcaggcagggctggctgcccttgtaggagccggaaagtcaatattgggatatttcagaataaagctcacagacgttctgaggcagcgttgcccagggtggcatgactgtagccagccctgggccttggagactctggcagagcgtggtgtccctcctaggtcccggcccctcgtgggaggtattcaggtttctacctttccacaggggaggacgtgctgggggaggggagactctggcagcctccctttggttcaacttcagggtcagaagagattgtttgggaagctgctgagcttccaagcaggagtgtgagttttcctgtttatgatcatgtgtggagctttcttccgtcacatggggaggctttgaaaaggcagcctttcacatactgtacttggtcaacctgaggacaacccggagatgccgttacacagagaaggaatccgtggttcagagaagactagtgacttgtgaagggtcagctaggaagctgagagcccacgcttgggagggagggaggcggagaggtgtggaggggctggcgggcgtcactgcctgggcaggcaggtgggaagtcccactccatcatcacaggagtgtgctttgcaggcaacctcaggccactccaggtgcctggccaccctgtctcctccgtgtggagcatgggcctgtccacgggtccttgctgtggcctcactgacagcagagaacatggcgcattcccacacctgaatgtgctgctctgggcggctgcattgtaactgccctgagaatgctggcatccggggcatgctgtgacttacactgtgcagaggcagggactggcattgtgtgcatgggggcgatgccaagccggctgctgatgctagagcccctcacctctgcgtctttcttggtgggagtggctggccagtgggagagcatggctggcagtgaggtgtgaggggctccagggagggttccgctctgcagatggctggggcaggtaccaactgtgtgcaaggatatcggtattgctggggtcccaggtccaggatgagcagagtgtgtgaccgtgttggcgctcaggtcccaaggccctgcagccccacaggcacctggccgcttctgggggtggtgggatcgtttctgttccacatcagttctttcttgggcagcagtcggaggctccagcgctcttggtgactgcatcacaagttaggagggatttgcccagccctgtgtggagcacctttcccgggtgtgtctgagcagagcgctctgctgtcctgaatgtgagcttatttgagccttggccatctgaggacctgtcttctgtttttcagaggattaccccaatggcacctggctgggcgacgagaacaaccccgagatgcgggtgcactgcgccatcatcccctccgacatgctgcacatcagcaccaactgccgcacggccgaggagatggtgctcacgctgctggactacctcttccaccgcgaggtgcaggctgtgtccagcctctcggggcagggcaagcacgggaagaagcagctggacccgctcaccatctatggcatccggtgtaagtcgggccccatcttgggggactggggtgtgcggggagctgggtcaggacccacatttcactgctgagggtgctggcatcagtagcactggcacggggctgcgtttctccaggcggtttgaaatctcagcccgaggatcagtgctcgaggggatggatgcccggttgaccctgatgtgctcattactcatggcatgcctgcaccaaaatacctcatataccccatcatatatatacctactgtgtacccttagaaggtgaaaaactcctcgcctcctgtctgtaggccactcttgaggaagagagaggaggaggagagccggggccttccctgctgtcctggccacgctgacccaggccccccgagcctctcctaagcgggtggagtgccacctgcctccttccttctgagagggctgggcctcagcagccgtgccagggcctcagcgctgacctggctgtgatgggagccaggagagctccaaagcctgattttcgtgcccagcccggcctgtgacgtttccgtcccctctgaagagcgggatttgctccaggtggcgattgcggtactgcccttcaatggcgtttgatgggcgctcaggtcctccttgccagcgtccatggtccatttgctccacagagcccgtctgcttcagaagccgtcctcctggcttctaacgaagatgtaaagtgaagcagcagcaaacgcaagagacacgaggcccctggcgggagggtgtgggagggtgcagtggcctccggcaatctgggctctggagagtcacctcaggggagcgtgaaatgtaaatctgatctcgaaacag

SEQ ID NO: 359 - DNA, 328 bp, Homo sapiens
atgccaagccggctgctgatgctagagcccctcacctctgcgtctttcttggtgggagtggctggccagtgggagagcatggctggcaaggattaccccaatggcacctggctgggcgacgagaacaaccccgagatgcgggtgcactgcgccatcatcccctccgacatgctgcacatcagcaccaactgccgcacggccgaggagatggtgctcacgctgctggactacctcttccaccgcgaggtgcaggctgtgtccagcctctcggggcagggcaagcacgggaagaagcagctggacccgctcaccatctatggcatccggt

SEQ ID NO: 360 - protein, 110 aa, Homo sapiens
  VARIANT (1)...(110): Xaa = Any Amino Acid
MPSRLLMLEPLTSASFLVGVAGQWESMAGKDYPNGTWLGDENNPEMRVHCAIIPSDMLHISTNCRTAEEMVLTLLDYLFHREVQAVSSLSGQGKHGKKQLDPLTIYGIRX

SEQ ID NO: 361 - DNA, 107829 bp, Mus musculus
  misc_feature (1)...(107829): n = A,T,C or G
tcagacattcagtccattatcatcaaggtgggaacatggcagtatccaggcaagcatgatgcagaaggagctaagagttctacatctggctcccaggtggttacaaggagggtctcattgcctactcccacggtgacacacttcctccaacaaagccatacctcttaatagtgccacttcctgggccaagcatattcaaaccacatgacaactccctggcccccataggcttcttcaaatacttaagtctatgggggccatatccaggcatagtataataaaaaacacatgtagtccaacttccaacgtctccatagtcgacagcagtctcaacaatgttagaagtccaacatttaaagtctattctgagattcttctgaccacttaactgtaatctccaaagcaagacaggaaaacagcaaactccaaactgtgcatctccatgttcaaagtcaaagtagtctttagatctccaacttctttttcatctttgttttcctgggctggtcctgttagcagcttacctccacaggtatctgtagtggctattcctggttgtcaacttgaatatatttggaatgaactacaatccagagttggagggctcacttgtgatccaggtcttgaggctgccagacacaaatttctgatcttgatcttggcatagagatcttgaggcacagtggctacgaaaagcttaggcccaggcaagggagtgcatgtctttaatcccaggactctaaggcaaggagatcaaggtcagcctgggacaaaacaagtcccaaatccaggagtggtgatttcacctttaatctgggccacaccttctgctggaggcctacacaaggacattggaagacggaaggttctctcttcttcacctgcttgcacttacttgcacagcacacctgttgcaatctacttctacagaagaccagctgaaacaactagccttgtggaactgagcaactcctagatccttggacttcccattcacagctgaccattgttggggagttggactacagactgcaattagtcacaacaaattaccttagcatatagagactagtcatacaatctgtgactctagagaaccccaactaatacagtatcccaaagttttggttatctttaatgtattggggtctccaacttcaacttcacagcttcctgttccaatgtcagggatccacacatgatcttctgggctcctccaaagggttctccagctgtgccctctttagcgctcgaggctcaggttggtccactccactgccgctgctgttctttgtggtcatctcacagtactggcatctccaatatggtggagccttctgctgcaacttctttgcatgacccctttggtccaaggacatcaactgcaactgaggcttcaccttcaccaatggccttccctggcctctcacagtgccaagcctcagctgctctccacgactccctcatatcttcaaaaccagtactacctgggttattcttacatattaacaagtacagctgcagcacaaggtacaaccttggctatctctggaacacagcttctttgtgctctcagaaaacactttccagaagatttcacctcggtgatgctggtctcttcttaatgactgctaattttttagctccaggtaaccagcatcgattgtcccagtagtcccttccattctggactctaaattcagagccacatggccaaagctgccaagttccactgcttgctggggatggaacatggctcccttattcttttaccagcttcctgttttccaactccctcactgactaagcttggctgtcctagaacttgctctgtagattgaccttgaacccaagagatctgcatggctctgttctcctgaatgctagggctaaaggtgtgcacaatgcctggatttaagcttttcaccccaaggtacatgggaaagtgcatgagaggcagaaagaatgtaagagccagaggatggagacaagagctttgaaatgttgtcctgtggaagtgatacggttattattattctcctaaactcctggcagccctggttatctatgcaagacctgcaaacaccaagccagccaaaatcccagtctagatgcatgtcctaattagcattaactcctcaatttgacatagtctagaatcaccagaaaaaaagaattccaactgaatcgtttttatcaggttagtctgtggcttgtctgtgagagcttttgtgactgtttcttgatgtaggagggtgcagaccattgtgggtggcaccattctctgggcagctgatcctgggctgcattccgaagctagcagagcataacctgcaaatgaagcggagaaatcctttcctcctctaggttgttttgggtcagagtttcaacatggcaatggaatgaatgcgaacaatggagaggcttctctagtccccagcgtttcctgggaagctgctggccactggcagcggctggacgaggaagaattctttggtgtgtatgggtttttcatgctacagtggatggcccaatgcccatgcagtagctggacttagatagatagatagatagatagatagagtagggcacaatgggttgtgtggatatgatatttcactgttcacacatatgaaattcccaagaataaagaaaaaaaaatcaaagtaccacttatccaatccaaaaaaaaagtatacagagaaccttataaaaatgacacctgtcatatcactaaatgtagaattttcagtgaacagatttaatttgaatgatgcagtagtccaggactgttttttgtttttgttttttttattgttgctctttttgttttaaactttagttctatcattaaataactgtatagctttgggcaggatttaaaccaaggacagcagtagtctgttccttgtaagattgctgtgaagattaaatgagacaattttcttcaagtttttagaaaaggcaaaaacgaaataaagcaaataaatgaaattaactactcttttctttttggctcataaatattgatatttcccaaggtctggtttgacttctattttattatgccttatatcctcaaagaataaccatgatttaaaagtctatctatgttataaactcccacctttgtatttctaatggagttctctgtgtatctactgtgtctttcagaaaagaaggaaatttaaaccagagatgatttgagtatagccaaataaccttcttgtagcttattttacatcttaaacttgtaatttttttttaagtaattagttgtacttggggatgaacacagggtctcatgagtgctagacaattatccagtaatgaacttgtatgtccattctcaacatattaaaattaaaagtaatttaattagatgatatatgtatttgttactttcttattgttgtgacaagatacctgacatgaagcgatttaaagtctgaagggctttttttggctcatggtttgagggacacagaaggcaaagcagcatgaacatggtgcagctagtcacatttcatctacagttggtgttttagttaactttctacttctgtgatgaaatcccatgaccaaagcaacttatgaaagaaagcatttattaagggcttgctaacagtttctgagggtgtggttgtttgaatgaggacgccacaccactgtggactcctgtctgaatggttagtcctcaagtggtgaaactggacaggattaggaggtgtggcctcgttggaggaggtgtgtcaaaggtacagggcattgaggtttcaacaacctatgccaggcctcattcttggctggctgtctacagctcaggatataaggctctcaactactgctctagtgccacacccatcggcttctttctataaatatcatcaactacgcttctaaactgtaagcaagcccccaattaaatgcttaaatgctttcttttataagagttgccttggtcatggggtctctatcaatagaccagtagctaaggcaaagtgtgactctgtatcatcaaggctgggagcctggtaagaggcagaccaacatggtgcaggagcaatagcagagagcttacatttgatctgcaaattggtgtggacgactttccctccctctcccctccctctccttcttcaatttatttatttatttcatgtatgtgggtatactgttgctgtcttcagacacaccagaagatgacatcagatgtcagatggttgtgagccaccatgtggttgctgggaattgaactcaggacctctgaaagagcggtcaatgttcttaaccactgagccatctctccagcccctggtgtggatttttcaaacctcaaagtctacctcctagtgatatacctccttcaaggccacaactcctaatcctttcccccaaatgttcagcattccaattcatgagcctatgaaggtaattctcattcacactaccatttttgggaaacacagaaaatgaacgctggtgtgtattaggctttcagttatagtaggaatgaaaaatgtctcatttaggcttgtgtatttgaatacttgctcctaatctggtggtgctgtttgtggacatttgatgatactgtggtggaacctttacaagaggcagcctggctggaggaagtacaacactgggacctgctttgatgctttgagcttttatagtcttggcctacttattgcttgctctctgttttctgtgtgcaattgagatgcagtctttcaccattttactccttcctcctgtgtgactatgaacagctagactgctggaactgcaagccaaaataaactcttccttaagatggtgatgcatgcctttaatcccagcacttgggaggcagaggcaggcagatttctgagttcgagaccagcctggtctacaaaatgaattccaggacagccagggctatacagagaaaccctgtctcgaaaaaacaaaacaaaacaaaacaaaacaaaacaatacttccagttatgctatttcatcacacaacagaaaataactaatatacttcctcaagtgcttccttctacttacgtcttactccattaaaaaaaaagtcttggccactgtcttagtttctattgctgtggatagacaccatgaccaaagcaactctttcaaaggaaaacattcaatttgggttggcttacagttctgatgtgtagtccatttttgtcatggcaggaagcatggtggcatgcagtcagacatagtgctggggaaggaactgagagttctgcatccagatcagcaggtagcaggaagtgagggactctgagctcggcgtgattatttgaaaccgcaaagcctacctccagtgacacaattcttctaaaaaccctgtatttaattcaataaggcaatacctcctaatagtgccattccctatgagcttaaggggccatttccattaaaaccactatagcagctgtcttaggtacttttaaattgctgtgataaaacaccatggccaaggcaattaataaaagcagtatctacccgggctcatggtttcagagggatcggcgtccactaccatcctaggtagggaacacggaggtggacaagtaggcactgtgctggagcagcagccgagagcttacattccagctcaaaagagcaagcagtgagttcattagagatgatggctggagggtgttaaagcctcaaaatccagcccgtatgatacacatcttccaacaaggctatacctcccagtccttcctaaatagttctaccaagtggggaccaatattcaaacatgagcctgggggggtgggggagcagtcatgctcatcccaaccaccacagccactatgaagtccttgcaagcacagtgagtttctgctgctgatttctccaggcacacacacagtaacctgaaacagagcatctcttggggattcggagaagagcaaagtgaagggttgtgactatctttaaagaatgaggcagtatgaccatgattgattggcccttttcatgagttaaggcccgatgtctgggcagtgaaatcaagtcaggtgtaagtacttgtggttagaccttgttcaacttatttaatctagagttacaaattcatattttggcttcctatagttttcagtgctagagtgtccagaagaggatctgatgaaaccagggaggcagaagcaaagccctagaagttctctttctcagatgtggtaacagggagattggcactttctgggtcatgctgtctccttcatttcacctttagctctcttagctgccaaatctgtttgagtaaccataaccacgagcaagcaaccaacagaagcgtgactattcacaaggaggagagacaacagaagcaatacaccccttttgccattccacttaagcgaggactggacctcatgtttctgcgtaattagctggtgactctttcccttttagtctagctaactggagtggattacgtttcatcagttccaaaggcaggtaggtatagggggcttaagtaaacttaaccccagaactcatgagagtgtccaatcatcttaccaaatccttagtggataccatcattggttccagaagtgggtccagggtcctgatgagactttaaatttagttctctgatctgcctaaatgtgaaagaacagtgacattgtcagtaataaaatggcggctcacttggtaaagtggcaaaaatattttttgtttgttttgttttctatcacaagccatagaaaactgggatctacatgcagaatgatacagttcagactcctgactctatgtataaaaatttcaactcatcaggactgctggtccacgtttgcaatcccagagatctggaaggctgaggatttcaagttcaaggctcactgactttaaggcagcctgtagaacattgtaggatttgttgcaaaaattaaaaaagaaaaaacaaagatccaattgacaaaaataataaaaaagtaagaaagggctgggcatgtggcttagtggtagaaaattaaagaaaaataccttgaaatggattaaggacataaacaaacacaagccttgaaactaaaaccagaaataagaaagtgtaggggaagccttcacaaaattggtcataacaaaacaatttaaaaacttaaaaaaataagtccgttttattcagtcttaaaggctttgtacatgctctgggctcagcacatacatttattatttaaatctttaaatatcactcctccacacacacaaagagaaaaacccatggaaatttacaaatcccctacaaatgtctttttggttgttcacttcctctttatacaatcaaccagaaaacagccaaggctggccctgtagcccactgtcctgcagaagcccagaggaagaacgaagagccccgggggcttcctgcagaccagaaatctatattcagaccaggggacttgtcttttgacttctgtagacccttgtgtatgctctttatgttcagatgcaagcagttcaaggtgctgaggctgttgagtttttgataaggttgttttgttttcctccctctctttgcactcatctggaccatcactggcactcctgcactcagagaaccactgaggcccacaaaagtcagccttagagggaccttcacccctgcagctggcctgcatctacagggccagggatgcttgcacctgcttgggctctaccagtggcatctgatcttgtggaaaccatgaattttgatgttctagagggtaggctagtgcgcatgatatggtctcagatgatccatcactaggcaggagtaggcacatgtgggtggaaagatggttcactcattgtcctggttgttcagaactggctgctcttctggagaacttaggtttgattcgccaagactgacatggaggctcacctgggtgacagcatgaggcagcacaaccttgcccagctctgacatacatctcttgtgtgttggtcctgaggaaacacttcccacaagatttcacctcaatgatgtgggggcagtccatcggccactgtcccggaagaacaaagttctggtctcttgtttatcacagctggttcttcagctcgagctcattttaaaccacagattcttcacacaaatggcctggtagagtctttgcttccctctgaaacgtcacaagctgggccactgtcgtctgcactgctctcgacattcttgtctctctagtttctacgtaacaggtccctgagttctccacactccatggctttagtacaatgtccttccaatctgcctctaatcaacatgcccaggtctgtcacaggaattctggggctggagcaggaacatggagctgatgttttcttccttttcttctttctttccttcctttcctcttccacctttcttttcctttctcttctgtttccttccttccttctttttttttttttttttgagtcaaggtttctctgtgtagtcaaggatgtcttagaactcactctgtagaccaggctggcttaacctcacagagacaggcttacttactgctgccacccaagtgtgggtggcaccacactcagctgggtgtttcccctttcaaggcctcttgttagattaagtcaagtctattccagatattctctctttcaactcaaaatcaatctagaatcttaattacatctattaaaaacacttacctttttccttttcccttttttggaaacagggtttctctatatagccctgggtatcctgaaactagatctgtaaaccaggctggccttcaagtcttagatttgcctggacactgtatcacattttatgaccccagaagttgtttcttgaatttcaatttccttgggtttgcctgtttaatgtcctagttgaactgtcaagtacaggacaataatgaaagctgtgagcttctttggagagagagtctcaagctctagatgatctgggagcatgtggccccaggttgtccttgttctctcaagacctgcctcatctccctgagtgcttctgggaattgagccacagctgcccatgggagtgtagatttcctcagcactgacagctacttaactttttgattggttaagttactattgaacaaatacttaaagggagaaaattaagtttaagggattccacctaatattatttttctggctcttactaatttacaaaacatatttagaatcttttcttcattctagcttctctcaatttgacggaacagtgattactgtctctatttaagcgacacgtgaatttatgaggtgtgaaggcatgattggtactgcttgctctcttacaggatatccccccaaaagatgttcatctccacatcttgatgattaacacaattaacttagtgaactttaagtgatacctgtaacactttgacagagtttgaggctgatagatttcaaattccagaccagtgtgggctacgtggcaagttcaatggctagactgagttaaactgcacgaatcttcatcaacaaaacaaaacaaaaagataaaaattaaaaaaaatttttttcgaataaattaccgtactctaggttctctagacttatggaaaaatcttttcgctttttaaacacctacttttttttttctcaagtctcatggaggggtggccactgaggaatctccatgcaaaaaaaaaattaaaaaattaaaaaaaaaaaaaaaaaccccaatcacctccaggataaaaaagaaaagagccaaccggaaaaaaaaaaaaaatcacctccggatgcgatcgaaaagacggcagcgccaccaccgcagacgggctacaatttcaaggcaggaggcgtggccaaaaatccctcattcaaataaaaaaccaggagatttgcatggagaataggcatcgcgcacgttcattggccgatcgctcagtgggtggagtacatagtgtgcccacgaagctccgcccccagctatttgcataacggccccggcgcgtgctggggagaagcgggtttgtttttgaatctgcggtggcggcgagtggagcgcacggctgagacggcagcgtccgggacggctgcacgggacggctgcgtaggaaggaactcgggtcccaggctctcacctcccgcccccgaaggtatacgcgagtgccaggggctgttctaaccactgtcggcgaaatgactattgtatttcggaagagtcaagaccgcattatggcggctgcgggagttgagtgtgcgcctgcgcggttgcgaagctgcgggcgggcgctgcatgggagcacgtgatcgcttggggtcgggctctagctgcagttgagcagctggccgggcggtggctgcgcaggcgcaatattcattttcaagagctaatgttcttgttggacgccatttgggttctagatttaattttctcattctcgagggggtttcgtctcgtgcttcttcttttcacattttccgaggaaaacgtttctctcgtgtcttacacctacccgcaccttaaaatcctttatttctctcacggtttcaccggcgcagacttgatattttggtacaaattgcctcttgtggttctcgattataatttcgcgtttagttaggtatttctggattcgcgttccatttagggagataagatcggcacctagtggtgctctcgggggaagtgcatttacttcagctgcacttttgtaaatacatttttaaccctgtttttaccggttcgcttttggatgtgcaatgtttacaaaatagaaacttttatttttgatttgtttgagaggacaagaaaaggatgtacaagttaagttgaaatctcaattttctcaggtattacatctttattattatttttttttaaaaaggaacatttcatccaaagtcaatgaagttttaatccaaacacttgagtctttcatgtttttagttttactgtttcttcagttagagaaatgttaaagaaaattagtgaacacgatttctcattattttgggatgacgtataagctattatcatatcattttttgatgaagaattttacaaatattccaagttctattgaggtccttatttaagggaatcaattaaacattttgagtttttgaaaaaaatatgtgcactgtagtatatgtgtataatgtacactttaaatatgttttaggtgtatatgtcctggttttagtttcttaaaataactatgggtgtgctactgattaaagttgtgatgccactaaatttcagttgtatgtagcacaattaggtcagttgtatgtagcacattgggtcagtatacgtataatttaatataattttcttattctacccgttgtttcttactagtctaaaaacttgtgttttcataaacatctgtcattcatatgtacagttgcttttttggttgcttatgtaacccaagtttaaatcagtctgttgtcaaattaagtgctgttataatgtcgattggtttgggctatctctattacccgaaacaaatactcttagaaataataggatataattgaaaggaacattttgggctgtttttttttgttttttgttttttttttttaaatgctgtgacatatgccctggaatggaaggacggggaaggaagtcttctcctcctgtagctagcaggtctaaagttgatgtaatgggaatcttgagcctctgttgtcttgtaccaggaatgaaggcagttctgcctttttgagactttgatgcttctgaggtggtttcccctcaccccattttgtactcctagtatttgagtttatgtatttaagcttaacatttttgtttgaatgcatgggtaattgtgtcatgcgttaatattgagcatcataagaggcactagaaaattacataacatgcaatttcaatattgatgggacagttttgctgtatttcttagaaggtaaatgtaattttaagtttactaaaattaatgaattgtctgaatgtcagtggttgattctttagtattttagaaacaagtactaaaagtttgaaattttagtttggttataattaaatgaagcattgtgcatgtatgtacacacacacacacacacacagacagacagacatgttactcaaagtatgaacaatcactgatatgtagtttagaaagaatcaggctggaatgatttaagtcataaaattaaaattttattttttaaaaattacttgattttgtactctgttggaatattttcacgtccacagtatgaagatttagtattgtgttaatcgcccttaactactgtggtgatgtttgtaacttcacttttgctgtggtagatcagtctataaatatttatcactatatatacatataaatacgtacacacacacacacacacacacacacacacacacttacatgtgtatgttttccaagacaaggtttctcaaccctggctgtcctggcactcactatgtagaccaggctgaccttgacctgcctgcctttgcctctgcctcccaagtgctgggatgaaagtcatgtaccattactgcctgatttcatttttaattaatttcctgcaattttcctttttagttgtgtgtgctgtgggtcaaactcagggcctcaggcatgctaagcacacactgtcatgttaagcacacactctcatgctaagcacacactaccatgcccagctgcattccccagcacactgcatgctcttgtaacttagatagtatgactagctccccattttagtgttctaaaatgttttttaaataactgcataataatgtattatcaaaatcttaattatcagatattttcaaatcaatcaatgtctttattcctttattgagacaatgtatccctatgtagcccaggccgtactagaacttgcactgaagcagatggatctggttcttctgggattaagtgcctggctccagtatgtttgtttttaaatatctgaaggttatttgtacaggatgagtgcactctgactttgtaagcctcctgctcagactgtgtgtggctctgtttctctttgttctcccctcctccccccagcttctcagatgtagctcaggctggcctagccctaggctgtttttgcctcagtatcctgagtgctggttactggcattgtcaagctagcgtgttgcttatttgcctagtagaaattttgttatggtaaacacatggtgaacacaatcataatccataaaaatagctgttcaaaattggtgtttctatgtggagcagcagtggcacacaacacagaaaccctggcttggaaaaaaataaaaatacataaatgcaaaaaaaaaaaaaagcgtttctaagggttttgccagaacaattaatttgcaaaatagaacagtgtagaggtttttaattttgtttgctttgtttttgtttttccaggggcatttctcacactgccaccagttaaggggagtcactaactttaattagggaagtcgatttctttcctgtgaactgaagtgtttgaggtgtgtgtgtgttcagtttgctaatgctcctcctctctgcttgtcagcaacaggtgtgccaactggcatacttaatggagcaagtaagggtctcccggtgtagccctgcctgtcctggaactcactatgttgaccagactgtcctggaatttataggaatccacctgcctctatctccccctggaattaaaggcctgtgccaacatacctggctgcactgtctttttaatttatgatttattccagagcttctctgttgacaaagtattacctgtggtgagatagatttttccatttcattttcttctagaacttcatgattatttaaaagtaatcttgtgtgtatgatgtgtgcgcatgcacttgtgtctgcttatgtatgtgtgtgctcttccttggcttctgtatggactttagagtagatgctcaggtgactgtccttgtttctgacttggtttgtgccaggatgccttagttactttgcttttatcccctgcctacgtgagctaggagcttctgggtgttgtgtctttctgagagagctcttggatgacagacacttacgctgccatggctgcttctgggctttgaactccgggccttccatttctctagctctgctttgtttttcaagacagtgtttctgtctaacagtgttgggtgttctgggactgaccttgaatttagagatatccctctgcctttgccgtccctaaaactgagattaaaggtatacactaccactgccagcctaagtatcttttaattgactttcaaaattgataaattatgtgtgtgtgtgtgtgtttacagatacaggaatgcatctttttgcagagagggtctcattagcatggagctgagcagttggactgactgactggccagtaaaccctggggatcaagcaacccccagtacagagaggacaagtgcgaccactaccatcatcagcctttgatgtaggccaggggtggagcaaaggtcctcagagttgcacagtgttgtagggccatacactacattaaatagtaggtaagagttttacaatgctgctatgtactgtttaattaaaatacccatgacttggtctcacagttgtgttagctaacgtgtggttttgcagatgaacatgagattcttttgcttaaaacagtagtctttgtttagatttatatacagtaaatttaaatttgaggaatttttaactcatatacttaacgcgtcgtaaagagcgtacaaacaaaacgtgcacttcttctagactcctaaaatgtactgtttttaggaaatgttgggaaaactcacagttcctatgatcattcaataagttgccattttcctgttttctgagtattgatagtaagagggataaattatgagagagcataaggctaaatttttttttgaacatgttgataaaaaaagtaagccagttagaagctggaaaagtaggtttcaaaagaaagtattttacagtatttgaagccattattattattattattatttgttttttttcgagacagggtttctctgtatagccctggctgtcctggaactcactttgtagaccaggctggcctcgaactcagaaatccacctgcctctgcctcccaagtgctgggataaaaggcgtgcgccaccactgcctggccattattattttgattggtggaattttgaaaagttatttactcaatgtttggccaggatgggaccaaatttattgcataataaatacaaaaataattttatttgggaacattaaattgatatacttttcctactttctatatacatttgttatttcattcaatttttttaatgttgattgtagtaacatattaatttttttgttttgttttgttttgttttgttttgtttttttggctggccttaaactcacaaagatcctcctgcctttgcctcccaagtgctgggttcaaaggtagtgtgtcaccacacccagctcctattactaattactaatgacataattaaactttttaatcatttttatattgaaaggagtctggttattgcccaaatacttattgaacttgtagaggcatgaaaaaaagaaaagaaataaagagaactcaaataggaaaatcttgctggctttgtgaaaatgaacctaggaaatcgataccaagtgttaagaccctggcattttatcatgcctgtaaacttaattattttgctttttttttatgttagctttgaccttggtcgagatcttttcagcttctagtgtagtacatagagcatttgattccttacttggcacagaagtgcccgtagagaaggactttgatgaggagcaagacatgaaggttggcatcttggcagagtacaggggagtcacactttaagggctagagacaagaatttgtcatttcatttctttttccttccctcgtttgttttctttcttttctgttttttcctcctcccctctccctttctttcctctgtccccgcccccttcccctcccacctcatgagtgctggtattacaggcatgtaccttcctgtctggagattgataggcaagcactctgccaattgagccgcaccccaacctccagttttgtcttttcttgtgtttttgttgctgctgtcttgtttttgagacagtttggtaaccctggctggcctggagcttaatatgtacttcaggctggcttcaaggtcacagagagccattttctctgcctcgggaaggctgattaaaggacaggctttgagacagggtcatggtctattgctcagtctggctacaacaaggtcagcgtcctcatgccttgtcctctttgcttgtgttcaccttagatcctcaagccaactctggaaaatacgatgcaatgacacaagtaatgatttgtgtcttatgcttgtataattttctccttccctatcagatttaagtgatttaaaagttgaaaatgtggcgaggggtgtagctgagttggccgaatgcttgcttaatgtgcatggaatcttggatttgattcccagcactgcatacaacttggcataatcttgaacacctgtaaccatagcactgtggaggtagaagtagcagatacatttcaagtatagttgtgataacgggagactcataaaatattcaaagatgaatcaagtaaatgaaagacaaaaagaacaaaggcagaaaatatttctaaacaagttagaacaccgtgaggagctgttgtaatttgtgttaggatcttggcaaccacctggtgtctctacagtttttctttgtttggtttttatgttaattatttttgcagtattgggttttaaacctaagacctcatatatgctaggcaagtactctaatactgaaccctattgctatccttcctttccgtgaaaatagatttaacatctgtgtggtgcaataatagggctagagagctggctcactggtttgattattaacatctacagcaggtgctttacagtcgcttgtagctctagctttagggtgtgtggtggcctcctgcactcacatgcgtgcatgcatacacgcatgtgcaaactctcactctccactccctcccccaccggatctttataaagccttagcagtttaaggcatgtgctatatataagattagtaacctaggttctatccctagaattcacttaaagttggaaggagttaactgactccaattgttatttgacctacacatgtgtgctgtggaatatacccctcacacacgatgaacatgcagaatacaattttaaaaatccttatggggctggtggagatggctcagtgggtaagagcacccgactgctcttccgaaggcccggagttcaaatcccagcaaccacatggtggctcacaaccatccgtaacgagatctggcgccctcttctggagtgtctgaagacagctacagtgtacttattacatataataaataaataaatcttaaaaaaaaaaaatccttatggacaatagtcttaattttttttcagatttttatttatttatttaatgtatataagcacaccattgctctccagacacaccagtagagagcatcagatcccattacagttggttatgtgccaccatgtggctgctggaaattgaacccaggacctctggaagagcagtcagtgctcttaactgatgagccatctcttcagcttgacaatagtcttgattatactaatagaatttaaatgttttgaaaagtaatttaggaaaaaaatggtttgataataaatgcataaggaatttatacatttagaaaggttaattataatttttgtgtgtgtgagaatctggttttagaaccaactaaaaacttaaacaagccacatcattattatggtcacagtgaatctcttcataatgaaaaaaaaatcagctttttttccattaataattctatttgctggtccaggaagtatattatcattgaagataattgttcactagtatgctaccacaaagcatcttactgaaaacatataatctgacttataaaagtaagagatgatctgtgaagtaccccagtagataaagctgactgccaccaaacttttatcacatgagttcaattcctgggacccacaaagtggaaggaaagaattggctcctgcagattgccctctgacctccacacagaacctgtagcatgggctagcttctgcttcctaccccaaatggagagagagagagagagagagagagagagagagagagagagactgagaccccttactcagtgtaaacattttgaacagtatttctacagaattaatcttaaaatgtttctgataatttagcttattatctataaagtctttttgaataagtgctttaacaaagttgtctgttttgtatgaatattaatatgaaaatcctgacctagttccttgatacagatgttaatttgtgagagtaatgactcctttatgtcataacaagtctctctggcctctcttctatttaactttaacttttgttcaatattttggaggtttctttttcttgtaggacccttgtttcccaggtggcacatattttgattgacttagcctctgaggaggaggaaactatagtatgtagtaaattttatattttgtttatagacaggacataggagatatttttgaggaatttaaagatcatctatgtcagaaaaatattcagtattttcatgttttctatgatagtttggctgggtatagaattttaggttgaagtcattttcctttgttttacaatggaagattgtgcacaggaagcaagtgttgtacactggaaagttttcttaatttcattggtgatatcttctgtcatttggccattccattttgagttttgtatagatacttcatttctctctatttatactttgtcttttgttgaagcagttttcttcaagttcatttttttaattggtttttatttctctctttctctctctctttctttctctctttctttctcccttttctgagatggggttctctgagtagccctggctgtcctggaactcatctgtttgcttctgcctccctgaatgatgggattaaagtcatgcatcactaccagctggctgaatttttcatttcttatattaaattttatttttcatttcctgcctatactattctgttctggacttgaaagtataccttttcccttcatataataggttttatagtgttcttcttgatgtgtaatgtattgttgatatgtaatgtattgttaagtatttttttggcatttgctttctgtctttcatgttaaaggaatgccaaatatgtttttcatgtttgagttctttcttgggggcttaaggcataatgtaacgtaatagaagtcaattgaaatatctaaatttagatagacttaaacttttctctagtatgattgggggggcatttttggtgaactcaaaatgtcttgagttttgtattggttatacacttatgctttcccttttgtaagttggtgcacatgtatatatgcatacacgtatgtgtgtgggtgcatattaacatatactgcatgtggaagccagatgggttagggttagggttagcagaggtcagtgccctatgtcttcttcaatcactttttatctgtttttgttgttgttgttgttttgtttttgtttttttgttttttgagatagggtctctcatcgaacttggtgctttccaattcaattcacctaacaggctaccaagtcctgggattttcttgtctctgccttccagccctgggattacaggcccacagcctcacaaagtagatactgaggatcagatttgtggcaatcatttaatcattttactgctgtctctccacaaaagatttccatttttatgcatggagaataaaattctgattcatggaggaagaggcttaagtatctcttcattcagtctgcactctgtcagttttcagtgtttttcttccctctttttctttcttccttcctcctcctctcccttcttctccccctccttgtttttttggctgttgttactgtagttggaatccagcaccttgtaaatggtacacaagccctctcacaaaactacaatgttgctgtgaccctcttacttattttcagaccttgctaggtttagggaaagctagtgtttagtgatctgtttttgataggagcttctagagttcttacctcccctcatagctttggccattagtagagcaccctctaccattcttttttttttaacttgttgccaagtgcttcttgaaatacgtttttggccttccagatctttctagctgttttatcttactttcatttaaagaaaagaaattacgccttggaaaaacctctcctgactgcctaggaataaagctcagcggtagagaatttgcctaacgtggacaacaaaaccgaacaaaacaaaacaaaaccaaaaaaccaaaaaccaaaacttctcgtttataatttttataggattaaggggatgaaatgaggtatcttcagtttgtatcttagttttcttttcttcttcttttttttaattacaagcttattctattttatggagtggatcatgtgttttatttaatgggtgtgggggacattgagggacttgattcttgccagtcactgtgtgggccccagggactaaacccaggttgttggatatcctcaaagaagtttttactgagactgccttgagggagtcgaggacaaggacagagatgcatgccctttgattcaggtcccagggagtaagtgggcccagctctgccttctgtaattgctgcagggagggagggagggagggacagggcctccagaaaaggaagcgggttggcatgagaaagtggaaagttgtgtttaaagtttgtttaggattttggtcagtaacctaagaaataaaattacgttacattgtttgaattataacctagaaaagctagtgaagccatgaagatgtagtgtgtatgttagagcccttttatgccttttcaaaagaagttttcaataatttatacacgttattccactaatgtggtaaataaaaattatagtagctgactcaagtgaatttcttccctcttgcaaatgattatagttctggatataaaaattggtttgtaactcttgttttcagggctatctagactcttgattgtgatattactttatcatttacaaattcattagaccagattcttagagcagagccatcctgactgcaggttgtagttgggacatgtctgcatcactgatcttctcatcactgatgagatgagaagactgtgacaaagcatgctattttctccttgtgagatgaaatgtgagattgtcgaggaaccagttacccaattaaaattctttccaagtcatttatttttacaaataaatgatgtggctttgtaaataatctcatctaaaatttcctaaaagatttcttgtgacattaagttaagccatgttagacttagaaatattaatagaatttaaaaacaagtaattaagttattatgtgaaaatgtcataatgaaatctgttatattttaattaagaaacagtgctacacaagcctgaccttaggtctgttcctgaaacctactttggaaggagagaactcctggaagtagtcctctaatatccacgcaaaagccatgggcatgcatatgtgctcatatatgtgctcatatgggcatatgcatatgtgcatatgtgcatttgtgtacatacacgatgatgataatgacaattgaacagtaataatacaaagttgaaacaatatttctatagctgtcttagaactcaattattctatgcaaacagtagacactacagtccttctcaaaacactaaaaatgggaatgtgctgtataaaagcacattctttaccacattgaactctgaactgtagtcttataggagaaaattaggaagaaaagagacattgtaagtgaaggttcacaaaatgcacagtttgctgagtttttatgtcagaagcagaataatgagaatctcaaagtactgtgtgagttgagataattttatactattgaatagaaaaatgatattctaatggaagacaaattaaggtgcagtttctgatcttctgattttacatggtatgtgaagagagagtgttgaagtgtggtcaatgaagtggagataagagctagagatcttgagagcagttacctcaggtttggatgatggacacagtgaggagaagagggttggctgttaaggagaggaccattagtgttagttctgaatggtgggtgttctagcccatgtttgttaacccaggactttggaaggcagatgcatgaagaatgctatatgttttaggctagtctaggtctaaagagtgagactgtctcaaccaaacaaaacctgttgaatccagacgagcctagactagaatttatctgttgagttggactgttgtttttctgggacacggaacaaaaggtataagccacgacagcagcctgatactctcttttcttgtttttattagaaggagaaaacccagtatctaaacaggttggctaaaaactgtatggatgagtgtacagctaggttatttttcagcttttattgaagtttgactgttatttagtctctgagcctgttatggatatcacagattggtggtaaagcctgccattagactcagtaacaattgagatagtacccaaggtttatcaggttagctatactgtgagcacatctattcagaacagtcgtagtttactaacatcttgattttattgaataaacgaaaccatcctcagccacaatgctctaaggctcctgtggcttggccaggtaaggtatcacaaataccttcggggggtagatgcaggaggattgcgagtttgagggcagcttgaatgtactgtggattcagggttttggttagtgagattgtcccaaaaaaataaaaaacaagggttggtgtcatacttcagtgatatgaagcatgtagtaggtcaaggcccaggcttgaccccccccccagactaattttttttttgtaacttttatttttattttattttattttgttttctaatatagcttttaagacagttttcacagacattgtccagttcatctcatggaaacttgaataatgtctcttttaagactgagtaattaaaaaaatgtatatgtaatatatcaagtgtatacagaaatagaatgagataaggaaacacgtgaattatcatctcttgcggccagtctgtctgtcacctctcttatgccttaaacagtcgtagtaagtgcccacatttagatagcacaacacaagaacactgagcttgaacccgtgtgcggaaggatggaggagcctggctccagagctgctggagcctgagaggcagaacaggccctttgtgtgccttggggcctttcttctgccaagtttgctgggatgttctcagatgtggcttgattatacctccccacttccggactaggttgcaccctttgtcctccggttccccttccctgggagtctctggtcttcattgactttatactagtaccattgactttatactagtacctctgtgtaccctgggagtgtactcaggacattcagactacaaagagatatttaattttatgggaacttattaaaatatgctttgttaccaccttagtttttaagactgtatcattccaactaaaaaatgtggttgtaaagtctaaccattctgctagattgagtacttttgaagcttagattttgtcaaaacaatttaattagctttttaaaattaaaatcaacgtgatcaaatgaatataggatttagacagatttgacactcttcttgtgatggccgtgttccattaaaggtaaaatagaaaaggtaaatagaaagaaaaaggggctcttgagtggggttcgagggactggctttctcctctcttttctggactgaaatggaggcttgctttcaggcaattccctggtgtgcactctgcgtgatttggctctatctctgttactgctaatacgtggcctggatttcaagttgtttgggatcggaatgtgcccagactctgtattgcaagtccggattcccaggcattttgttgcaaaactggcttgctgccttcttttttcttttctgtgtcctaagtggctgcattgtttgttgcagtatatgcattagctatctgtgttcagtttattgcagcctgacaaagtgggaggggcttgctttgctccatggctgagttttcactgtgtgagttcttcagtgcacagtgcagccatcttaattacacttttgtgcaactgagactgtgcagctgtctcaaaatggctgctaacctaatccctgaagctgcataggcagcctgtgaggagacttgtcacatgcaccaggatcagaggtaagagccaggaagctttgatctttaagcattacaattagaaaacattagaacatgaccaagcttggataggaaggagaactcgcatgtgaaaaagttggcatgtttactaagacctgtaagcttgtgttagagaaaccgtgtgttgggatggtgaggtcaaaggttaaattcctcctgtgattcctcaccagtttgttgtcattgtcaggacactggatcaccacagtggtgcttttctgatccatgccgaatttaatgctccttgtgtatttgataattaattcattagatatttgtagaaattcaaactgtatattgagagttttttaagaagccattaattagccttgtttagaaagattatgattttctgacttttaaaatgagatttttatggtagttttataaaaagaatggtaatttgctacattaaaacatagaaaaaatattgtttttttgttatatgcttcagtgctgtctcacatgctcactaattatagtaaatatatgtgtacacatacacacatgcacacacacacgcacacacacacacacacacacacacacacacatttatatagtgtcgtacttttccttaggttactttttgttcgaattagcatttggatttagattttaaatttcagagtagtttcacatatagacctgtacattttttggtcaatctaatgcaatctggtacctagaataaatattgttttaggtaagtagcattattgtgcatatttaaaattgttaatactcaaattgtaaatttgaaaaaggtgtttagcattgtaaaacagaaatgtttgctaaactacaatatcatggtttcctagcaaattgggagaataattttttctttctcttcctttctccctccctcattcccccccccccttcttttctcctttttcgagttgtgatctcagtgtggcctgctgttggttgtgcctagattgctaagtatgtgaggcccctgacctctagtctctgcctcaccagtacttggatcacaggttcgtgtgctgctgcgcactcccgaaagcaggaatgacattccactcacgtaattcaggtcgaacagttttatcttaagcagtgcttatgttatagtagttactaaattattttctgaatgctgtcatatacttctgttgctttgttaatagagtagtttaaatatattcttgactgatacagtagagaacagttagttatgtatgttttgatagaggagcttttattttttattttgtaatcttttacgcttttcgatttttattttctcccctctgtttttatttttatctttaaaaaacagtgtctcatatactataagctggccttggaacatttgttctgtggcctgggctggccttgaacttgtaatcttcctgtttcagcctaccagaattagaggcaagtaccaccacgtctgattctaaagcaacttctaaaatagcaaattacatttttgcaaattgaatttgtaatcacatgtgcctgtgtagctttgaaccttgagcctcaggaacctaaggcgagcctcgcctacttagcaggccaggggcaaccaatagcaggccacactgagatcatggctcaaaaaaagagcaagaggaggagggagggagacaaggaaggagaagggaagagagagaaggaaggagggacagaaagagaagaaagttactctcccaacatattaaaaggctatacatgaagttttattttgtacttatttcatagtataaatttatttaatttacttgtaataattgtatttaataaataaagtattgtgtttaacaaaactttgaaataagatcacttatgaccttaagaattttatattagtatccagacctggttgacttttttgcagagctcagcctctaaggcattatggaattctgttttgagttttcctgaaatgcatctacttttattccttttttgatttttcttgaagatctacactggaacattaaagctgctacttaatagtttaagattgctgccttgtcatgaactttaatttatacttactcttgcttatatatttttaaataaaataatgttttttgtaatttaaactcaagtaaaattatgaattattgataatcttaatgatagtttatataaatcatctactcgtgtgcatttgccccccaaacagaaacaaggtgataagtatgagagtgagccctgctttctgtaagcgtgtgctcagtgtggcagaagcagggactggctcccatctctgtcactttccttttcacgtctgagcagtaaggatcttgggataaggatgggggaggggagtgtgtactatttaaaatatgtgtatttgaataaaatgccataagacagccatttggtttttaatatggtagaaaactactgctaaggttgaagtgcccgagtagtttacgctggcagtcactttttctgccttctgttgctgagtatgtaatttactctcatactttataagattatctatcagttattctggctaccttagaatattattgctaaatttttcattgccgtttcccatttttacagcttataagcataaagtagacctcaggttatttttcatttggtggaaaaattttcaaaatttctgtgaattacaggttagatgttatgctggataattgaagccatggtccatattctgggaactgaattcttgaagccatatattatcagttcttctttttctcctttcctgttgtttaccttatctcataagctatttttaaaaattagcgactcaaaaggaaatgttgggatggggaaagttcattgatgaagaatgcagttaaatacaaatctcctgtctgagctgatcggcatcttccgattctttagtttattctctctctctctctctctctctctctctctctctccccacctccacatcccttgtcatatgtgactagatcagagtgtcacaggacaggatggggagtttctcacataattcatgctgacgtatatatttgtaagtcaatcctgaatggaatgttgctatcacaggattggaagtgtagctgtaataaatgcttcagctgtatacagtctggctgagtctttcagatatacttaaaaacaaacaaacaaacaaacaaacaaagagggaaagagggagataaagcttctccgagtgatggatggctgcaggccgagtgttccctgtgctggtgcaaatgaggacctttcagtggccacagactgacagctgctacactgatttctgtcctttaaccacggcccatttttctagttaacatctaacgtcagttagatccacatatcttgcatcttaaaagctgctagatggggcattggtcagcctgtttgtctgcccagtcatctgcaccgaacacaaagcatatctcctctgttccatcctcttcactctgacacttctgccagccagaatcccttttgtactctgttaattaatgggagtgttgacagccatcaatatctaaaatacagtttctaacggggaagaaaacaaacacaaataaaatctagtctactaaccctaacctaaggaagatctaacatgtaaattgagtgtactctttagtagatatggtaccttaggtaacatttttttctaattaaaaattttttgagattttaaaaattttatatgtataggtattttgtctgtgtctatataccctatgtttacagtgcctgcagaggtcagaaatggacatcagatcccttgaatctggagttaaagatggttgtgagctgccatgtgggtgctagaaattgaagctgggtcctcagagcctgtgatctccaatcccatccttttgtataatggtacagtgccgtggggcctcttagaaagattagtgatgtcagcccacggttcagagggagaagagtactcactggagtgtagaaagggtccgtgaggtttcttctgttaatggtatcactgtcttaaagacattactgttgtcaaccagtctttatggtggtgtggaagaacaaattaaattgcattctgaaatacagtttggtggacaggtaagtaaaataacatttttgtcaaaaatttctgccaaaactgaacaacatgtaatgagttttctaatatgaacttttctaagttgaaatttttttgatacaatacttttcttgcatagataacaataagccaatataaatttagctttgaaaatctctctttacatttactagttaacagcaccatgttagctgtcaaaattactttgatgttgtgtgaccatggtatgttaacattgtgattggtatgatttgaattcacattcttccagggtgtcagcccagctaggttggttggttggttggttggttccttccttcctatttatttctttgggtgatagtcttactgtgtagtccaggctggtctcaaactcttcgtgccttctggaagctgggattaggcagatggcaggcaccacacccagcagcttcttgacattcatagaatgacaggtacctccaaggaaactcccctttggaagcagatttcaagataacaatgaaaccatactggatgaagaggttgccaacttgtaaaggaagtagaccactctggttcccacactgccccaagacagtgactggggagtaaaggtaattactattcacatagcttgaatagttcaggtgagttagaactttcacaaagtgggatttttgtttgttttgttgctcattcataatcgtttggattggaactaccgagtaccacatcagttgaccacaacagtataagtttaatgaggaaggggctttaacttgagagatgtctgaggagttttgagtttgcctgagtgcgtccatcctgtctctgaagtaaggcaaaggcagctggtgaagaatggcgactgcggtgcttcttggttgcatatggatgctcatgtattagagtggggcgttaacacagatgtcaggaaaggtgatctcagctctgctgttcatgacttcagggtaaatcatttaatctctttgcactgttctttgatcactagagatgattaaagaattagaaaatacatgctagccccctggagtaagaggattctaagtttgaggctggcttacacaacttagcaagactaaaacataatgtcaagagtcctggctttgcaggtagagtaggtatcttagggttttactgctgtgagcagacatcatgaccaaggcaactcttataaaggacaacatttaattggggctggcttacaggttcagaggttcagtccattatcatcaaggcaggaatatggcagcatccaggcaggcatggtgcaggaggagctgagagttctacatcttcatctgaaggctgctagcagaatactgacttccaggcagctagaatgagggtcttaaatgccacacccacaggacacacctactctaacaaggccacaccttctaatagtgccattacctgggcccagcatatacaaaccattacactaggtaagcactcagtgcaagaactgtttgttataggacccagtcttggtcctccatagcataaaagctttaaaccagagggtccagatatttttttccaatcagtttgataaactaatttttggcagtttcataaaaagtaaattaagctcgttttgttttgatctctctcatgtttcaagcaattcttttcattgtccatcacacactattcatgtgttggtgtactggaactacggtgcctctcctctgctgctgctggctaaagctgctgggagaggctcaccagtcctccatggcactttcaataagcaggaatgttgaggtgtttctgataattcactgcaagtgattagttaactcatttgatattaaaataatatataactgcttattatttacattgtattttatgctgcattaaacttcaagttggatgcttaaccaagtacacagaaggagaaccagcacctgaacaatgagaggctggggtcagaatcacaggcctctgatcacagcacctgacagctaaggtggaagattagtacagcgcttctcaaccttcctactgttgcagctcttttaacactcagttcctcccgtagtgttgatccccaaccttaaagttatttattgtaatgtgactatctgatatgcaggatatctgatctgtgacctctgcaaaagggttgttcaactctcaaaaggcgcaacccataggtcaagaagctctgatactgggtttaaggccaacttggactcaaatgtaaaataataaaaggattgtacctggtggtttgaataagaatggtcctcataggttcatatatttgaattcttagttactagggagtggcactatttggagatattaattaaatatgaccttgttggaggaagtgtgttgtgagtgggatgaggttaaagcccatgccaagcccatggtctctctgtctgtggatccaaatgtaggtcctgcaccatgcctgtcatgcctactgctatgcttcccactgtcatgataatgaatgaaatctctgaaactgtaagcaagtccccaattaaatgctttcttttataagagttgctttgcccagtggtattttcacagcaatagaaaaatgacatacagaagtcagtatgaggtgtgtgtgtggagtgctgctgtgacaggcctgagaccatgcagcttgttggaggaatatggaagactttgggactttggcttaagaaagtacttgaatgctctaagtggggcttaatgaatcatatcaataagaacatggaagatggtggtgcatcaacaccccctccctctcactcacacacaccccccaagagatttaagaggggggagaatattagtaaatggttcttgtgatattttagcaaagaatgtggctgctttctgcccttgtctgcaaaaccttccttgatgttgaagaattttggattaatggcctttgaagaggagatttcaagacagcctagtattactgactgtgttgtgtggttattagtggctactcttatgcagatctataatgtacaggaacaagctggacaaatacaattacagtttgtagagaaaaaggaacaccattgtagtgtctgtgcctggctgtcaacctgcttatatctggaatgagctacatgcagaattggaaggctcacctgtgatcctaatctggagactgggagatataagtttctaacctggatcttgacgtggatggagatcttgagacatagtggctatgaattccaggagatctcttgagttcaaaatcatctgggacaaagcaagtccctagatccaggcatggtggcacacacctttaatctgggccacatcttctgctggagacctacataaggacattggaagaaggaagatttactctttctcctccgcctgcttgccttgtggtattgagcaactgctagatccttggacttccatccacagctgctgctgaccattgttgggagttggactgcagactgtaagtcatcaacaaattcctttactatatagagactacccataagttctgtgactctagagaaccccgactaatacaaccgtgaagtaatgatggagctaagtcttgtactaaaggagatagaaagtttaagggaaaacgtgttgctaaatggagtgaagggagtggtgacttcagggcaacatcccaccctgctcactttccaactttagagaaggaattaaaagcttcagcaacaaagatggaaagctgatgtaaatgttattgaacatggatgccaagttccaaccccagcaagcagaagaactttttggcagcttcagccgcatgggcctggcatcagagttaatgatacaagaaagggttgtggaacctccctctgctgctaagaaaatctgctattgggcatgtgtgaagggtgtccttgtgtggaggcctacagaggccattggatgagggtaaagcctggattatggtggagacccagtgttggtgctggaggtgccaatcttggcacacctgccaaggaaagctgcagagacaacaacattggaaggagttggggagacagattgggagtttgccctggtagttttgggtcatggtttgcttcagtattttctcattatgttctctttcctccctttggaatgattatgtatattctgagcaattatatgttggaagtatgtgacccactttttgattttgatttttgattacagggttatggttaagagagtgccatcagtctcagagacttttgacatttaaacagtatggagagtggcatcatagactagggtgatctttgaaattggactgaatgcatttttgcattatgatatggctataagcctataggagccagggactggaatgtggtggtttgaataagaatgaatggccatggagtcatgtatttgaatgcttagtcaccagggagtggctccgtttgtatgtgtggcattgttggagaagtgtagcatgaggagagtgggctttgaggattcaaaagctcatggaaactcagtgtctccgtctctacctgtggatccggatgtggctctcagctgcttctgcagcgccatccctgccatgcctgctgctagtcttcccaccatgatgataatgaattaaacctctgaaattgtaagccagcccccaattaaatgctttctttgtcttattgcattggtcatggtgtctctcttcacagcagtagagcagtgattatgacgctgtaaagccttctaagctctctttgcagctcttgagcctttctgatgaatgtggtacttaagaatctggtgtttagagctgtgtgcccccctccccaatattaagtgtatggttaattctgaaattgcattgtattttactgtcattttgtctgctggggtgtaatgggcatggtggacaggtcttgagaggacagtgtggttgtctgagaagaatttatccattccctttcagttattctctttcacaggggacggttataattgtctgcatattgaagattccgatttactgtttatacaatagtacttctttattcatatttagagtctcattactatataaagggtgacttaaataagttaaaaattaggataaaactagagacatggttataggagatggctcagcagcttaggagagcttactgctcttgcagttcctggcatccacttcagggagctcactcacaactgccttcatctccagagagatctgacacatcaggcctctgtgtgcagctagcatttacatggacctacccatgtgcaaaatgcatgcagacaggtaatctaaaataataagaataaatctaaaaataaaaatgtattttgaagtcatccctagaattttaagtattttctagtttgttaatttgaatgtagaactaggctgtggatttggctatagtttagatcgtctgtacttttaacgtggggtaaagccaagtaactggagttgcagaatttgtatcagtaaatcataaattagccaaaacagtttaaaccaggtacccacaatcaccggtagtgacttgatgcttgcccatgaggaaattgaagtgataaatcagccacataattttgacaggaattgtggcactgacatttgtaattcaatatgtctttgttttggtaggaagaaagaacatactttactaatgttagttggtgttagtaaatattatgatggtcaaataaattatttgaccatcataataatggtacatgaggatgtgcgttttattcagtgaatatgtctaacagcaagtttgcttgcaaaaatttatatttattcattaataaaacttggaaacataattgtatattagagtgaagatagcttttatttaatgagttataatttatggttgtaatgattatataattagaaaatattaaattttatatatacatatatatattagactgtgaccaagtaagctaaggatttaaaaaatttaggggggggttaaattgtttcatgtggcaggggttgagtttcggtagaagttgcttttgtttttttcctgggaattgaattcttttagtggctagctagctagatggcttctagaaccagccagtgcctgctggagaactaatggaagggctttctctccagccatgaagaaaggactgctttatttatgtaaattgttcttactggcccagctagctggaactgcagtctgcctgtgcagtggcagcagataacacgtgtcctggacttcctctttggaatgtgtgggctgacagtgaagggttgaagccttagtgtcccagtaatgagactccagcactggccgtgccatgggtgacgagagcaactgtgtgttttaagctttaagttcggctcttagagactgacaccattagtaataggtgggaggcacttaacttcgaatagttgctgcagaccccatagttgcctggatagagagtggcacagagaatccagattctaggcattttcactgcaaacggtccttttgaagatacgatcttgtgccccgtgagcatcactgatacattgaatgacagctttttggcttcgtggttaatgggatattaatgggatgtttgctacgcaaactactcaacagatgtgaaacaacaaagggaatcacaacacttagccaactattgtattgtgttcctgagtttttaaaaatgaatatgaatcaaataagaaacttaaactcaagaagtctcattagattttaaagtttgcactgccttaagtgaagtacaaagctgcccccagggaagagattcaggtcccctctctgggacagctcctcatcataggtgctccagctgtctctctgcctttgggtgtttgtttgtttgtttgtttgtttgttttccccccagctatagtaatgacaggattggtagattattagtgttaatattcaggagattttgagagccttatttggatttagtcttttaaagagatgtcattgtaaattcacatttgaagtgaaatgaactaattaataaatgaagtgagcttcatgtggatattactaatttatattacatatgaatcagccactatagcctgttaccatgtcctcagttatatcagcaccaactggtgtatgaggagaaatggcattcttaccataactaactcactgcaaagttttagtgtgcatttaacagaggtcagcatttagatcagactgcttatgcattcacatttgactgacatgttaaacaatagatgtttatacagagttgatagtatcgttttcactccacataataaattaatttccaaatatttaaatttatcacaattttaatatgtattaattaagaattccattatatctaatactttatttcgtaagttgaccaatggtacacaggcattgtttctcttgtgttatatacctgaaatattacatcctgtggaaataaaaatatatgtataatagaggtttatataattactacaaagatagaaagatgtatgtttgtgaagaaatgcacatgtgtttattaatgtcatacagaggttaggtattttaaattgttgtaattgtatttgtggaataggtgtaagtaggaggagatgtgaagtagtgatgccaacttagggacacagaggaaaatgctccagcaggccaccctcttttgtgtcttcctctatctagcaggtaaacactaggcttttcctacagccttaaagtgtaattaggtggtgtttccagttcgctagcttctgaaaggtagctggtcactattactttatggttatgcatgtaaagagctagctagctatggtagagtattgccatgttccccgagtgtggacttaactgttgtcttttgacagttttgctcattaatactgttttatacgtataagtctgtaaagtacagaaacgtatgttttttttcttgttttgttttaactctgtttcactatgattacaataataatacaaatcagctttgagtaattttgaggtagatgggaagaaggttataattttgttaatgttgctggacaaagacgtctgaaacatttgggaaatgttcctatgtattttgagccattatgttttaggaaaatgttggactggccaatggagtggtatttatgcatatgaaaaggagagggttattgaactcaaactaagtaatttattgaatgctgttaaaagttgagggccaagccatagcaaattaagatggggattctgtgtatagatgaacctgaaaggaaatatgcaaggcaaaggtgaaagtgtccaatctttgaggcgggggaatctgggagtggctccgacctgtaatgtcagcacactagaggctaaggcaggatccccactaacttcagtccagcccagactagagaatgagttagttcatggcagcctgggccgtcggtgagactctgaaggataaacagccaaactatgtaggcaaagtatgtagttctgtttcctgtacagcaatacgatcacttagaatcatagaaccatagactcttggaaatgacttaggcagattggagtagtttgagcgcctgtatgggcgttgttgcttaggttcctgacagacagggaatcctctggtcctgcagctgccttttcatggccaacggggttagaagccgcggcagctgctccggttctagtctgtactgtcaggcatggggcagacagattggtgctttatacaaagttagctgtcctcatagctcttcaattccatctgtcccatgtctgtgttcctgaagtcagtaagataccgtgtgtttcctaggctaaatattctccatttgccacaactcttcctcttacaacatgttgttcagggtgttcttcagggtgggcattctcatgtttaggttttaggtattataagactgtctctaatgtttagtcaacctgctaccctgaagcgctaggaactttatatttcttgacattatctttctgttctgtggcttaactttgttttggtagccattttgtgctgttgaaggttttaagtttggttgtacatttatttgttgagagagtgtatgtcatgatgcctgtgtagaggtcagaggacaacttttaaaagtcattccccccccccgtcgtcttcactcttgcctggacaatcatcactgttattgctactcggctctgtcttgtcagggtcaggacctgcttcacaaactgccgatgagcttggtttaacagtgtcggtggctggttccacagagagctccccaggagtcagctcaccagaagccagtccgctgcagacagacctaggaagggagtcctcactagaaggtggctcatcagactgtgaatcaccggagggggcacaatcatccaaggctgactccccaggagccagttcgcaggccgccacgacccttgcgaccggttcatctgaagctggctcacttgtagctggctcannnnnnnnnnnnnnnnnnnngcagtgtgggaaccagagtggtctacttcctttacaagttggcaacctcttcatccagtatggtttcattgttatcttgaaatctgcttccaaaggggagtttccttggaggtacctgtcattctatgaatgtcaagaagctgctgggtgtggtgcctgccatatgcctaatcccagcttccagaaggcccgaagagtttgagaccagcctggactacacagtaagactatcacccaaagaaataaataggaaggaaggaacccccccccccggttttgtggattaaactcaggtcatcagattatgaaagcctttacctgctgagacatcttaccagcccagatcttgagtttatagtaaattaaaagccttcagttctttctggtgctccattgatgatctataatttacctgaatacttgagacaagtagattttcttaaatgtgtgtctttcacatttctgttagtgtgttctgctttctctgcacgctgcttgctgcatttccctttatcttctcatggtttgacatcggttagcctggaactcagatacctgcctgcctcttcttctttgctaggattcctgcacctccactgatgtgggctctcagttttcttatgactagctttgcagaattacttaggatatattgttagtgctttgctggtaggttttgttttttttacaaattccctctttattctgagttttgttctttgttttaatagataatcttcctcttatcctgccggtatatatggttttatttgtgtggttttttttttgttgttgttgttgttactgaatttataaaatatttattaccacatgtgagctcactattgatatttattggtatatttataagaattttacacttgactatatatatgattctatatatttccctatcattctgggttgttaatagatttttttttttaattgcatctatagattttaggaagaaatgtgtgcattttgggcatagaaatttcttttcagaaatttcttcacaccttaaaaaattatatcagtttacatgtttaaaactgtctaatgttctttagtttggatgttccattatttttggaaagtatttccttagtgatttgttgttgttgtttgctgtttatagtgtagctgtgtacgctgttccgatcctcttttaaacagtctgaaataacctgagatgtaaaggtcaggcccctgggtggggctaacgcctgctggctctcacccgtgcttctgattaattattctgacactgagcgacatgacgtctgtacactaatgttagtgagaaaacatttattgttgacattttatttttctgaatcgtttgtagctatttctgttttccatggtcctcagggtttgtgttgaatttccattctgtgccattgggtttctctatgactgtatagagccttcttgatattctgcttatgtctactctcacttctttctaaagttgtctcattgtttatttcattatgaacaattctactgcactctaaattttaaacaagaatttactttttcataagcttttttatttgatgagaaaacatttttggtttttaaaaatattccctttttataaactattcttttgttttacatattaatcttaacacttttgttatagtacaaaaattacataggtgaaattttagccagaattttcttttgacagattttgcctaggaaaagtaatgcatttttttgcattaagtcttatgtcttcttacatagttccaatatttcacataaattaaaaattcatataaatgtttttagataggtttttttccttgctatactgaatggagggttttcttactctagtcaggtatttgagatctttggtcagggtttttagtattgaacatagcaccacactggcttaagtatgaagattttttgattgacatgatctttgtttaaggactagatcttgacgttgcaaagttttatttttatcactgttaatttgtataaatgaatgaattttgaaacactcattgccatccgagttttattcagaaaggacagttgtaattgttttgggttcttagtacattttctaaatttaaattattacagttttaagatagaaaaatagtttggtttagtgtgcacacattatcctttagcagtgtgtcaagcatatagaaataaatttcagggaaatctagttggttttttccagtccttaaaggtctgatgtcatggaagtcctgcgcatgctctcgcccgtttcctccctcacccaggctacattgtctgcttattagaagaggggcttcaggattgcaaacctcctgacaattgtcaagttttggaaatgaggtgctagcataaataatatgcttggcatattatagtttttactgtctagttttggatttttttttcttttccctttctcagttcctcctcattgtcccgcctccctttcctcttctctttctgtctctttctgttctcatcccttttctcctcctcatctccttgtctgcttctttgaattctggaggctctaggctcagttaaattctctaatgtggcagacagccagctctccaataggcccaaactgagcatgctgctgttgcctagcaactacttgggaagtctttgtctatgactgaattataaatagggttatgagcaaaagtgcaattgaaaatgggattggaaagaaaggcatactctctttttttttctcattcgaatttgaagaattaaagatttttttaatgtagtcttttgaaatctggcttataaaaattgagctaatcagaaagaaaataaaggctttataagtttatgtctgtagttaaacatttaaatcttttaaaattttatttttatatttgtgtgtgtgcgcgcgcgcatacacacacacacacacacacacatacacagacacagacacacacacacacccctgcatatgctcgtgcacatggtgtacacttatgctcatgagtgactttggcccctagaggaggactttggatcctatgaagctggagttaatagcagttgttagtcaacagatataattgctagaaaccaaacttggatcctttgcaagaaccaccaggccaattccctaaagtctattcttttaaatgattaaaaatatctgtgttgtaactgtttattagtgcgtgggtatagattaggccattggaacctctggagctgtaatcacaaattgctgggagtttcctgattgtgggtgctggggaatgcttggttttctcaaagtaaaactgaccaaatgtaagatgtgaaaaataagtttaactagtactgcagtagaagaaaatagcaattctaaggcttatgaatagtttcagtaatgatctagattaatgatctagatttatcaaagaaactctcccatcactggtgccttctgacacatttgatcacatgtgaggactagacctcattaattgtagcttattgctttcttgtgtgatggtgataatagtttacttgctcatgatttaagattttattttaatcctttctattaaaataaatatagctaggttctggatatgcaacaaataagaatagaacgttaagaaaaagtaatctttatttactttttaggtaaactgtttaaaataagtaattttatgctagatgaaactccattttaatatttagccattgtgttatagaaggtagatttaacgtttatcatctgtttcctggagctttttctatttatttaagtgagtctttgtttgatccccatcaccacaagaacaaaaccagaaacacttaaaagaaaaccacataaggcaattgcttgttttaataggagcggactctgccacagtctgagatttcagcagctacagcttgcgttgaagtgaaatgcaagtgttaccttgcatttttattttatctttattttttgccttagcttgcctcttctttgttcctgtcttaaactttccttcattatccatgtgtccttccacctccatacctaggattctaccctagggcgacacacatgcttggtgagccctcttcattttgagccagatctcttgcctttatattcttctttgatagttattattagattgcagattatcaccttcagaaataaacattatttctggagcaaatatgtaatttacagagaaaaagtcatacatatgctaaaaaccactaggtcgcaagttcagagtgaagaaatgtgtctcacatcttgacagctcaagattttttttttaatttcatttttacttttttttttgttttgttttttgagacaggatttctcttcagttgcgccaggctggcaactgaagaaattttaaacatgtggactttaacatctccattgtactaggaaccaattgaaacatcaaaaatggaattttgttgggattatttatgttcaaatatattttgtttgacaatttttttcctcattgatactaattaacttttgataaaataatttatgtcttgtgtgaataggaggtttatgttttaaaacacaaatatggaaatccttaccttatttagaggtctgctttattgagttgtgcttttagtacacaaccaataggcttttgaaaattaataaatgacattctcaaataattgcacaaaaataggtagacaaatgctgtgttattcagatatttggatttttctttttcttgaaagcctgggatttgttagaattgggattcaagtgcctcattgttctcctggaagagggaaatcgcggaggtgcgtgtgcagtggaggcgcgtgtgcagtggatgtgcgtgcttgtatgggcacaggagaacagacaatggaatgctacttggcactgatccatttatttaatggaacatgctttttttttttttttttttgtaattggaatctaataaaaggtatcagctttgtaaggtgttataaaatgcaagagtctatttctctccaagaaaatgagattttttagccaggaagttttgctgttaggttcacatctgttctaggaattaggcttgcatgttgtttctatttttaggctgttgctaggtggatttaaattttctcctcttatggttgcccaagttctaacttcctgattggttacatgaccctgctttcattagccaaccacagtgactatgcaaattgtatttcagtttctgtttctgtcaaagagctgctaagatggctgcaaggggctcctttggggtatgtttatcatttcaaggagggctttcatcagcgtgtagtgtagtgataagtagagatttctcttaaagggatgttttaattttgaaataaaaacacactgtccatgcaaactttcatgaggctgaaaccgcctcttgtcagctgtgattttaaggtgttctactttgatacttagacactgtgtacattttattacttacatgtaaatgtgtgagcatgctagcttagaaactgttagaatgttctagattactacctttgctttcaaaaagaacagatttttttatttaagaaattatttgtaggtgtcagttacatacatgcagggcatagtctctagtcggtatttattacatagtctgaactatatagtgtgtgctcattattataacattaggatactccaattttcattatattgtgaatggctttagaagcatatcatggcattggtatatttaagatgttttctgatatgaaaattttgccttcctaaaatatgcctgtactaaaaatcttatactggagatataacgagatatgctaaagtgctttgttaatgtacatgtaggtattaaaaccaaataatgtttatttttaaatgatgccttaaaatggtggcagaaataggaaatggtagcaatactggtgaagaattgataagaatactggtaaaatattgtaaagccaccagtccaggacgtgcgataatgcatctcctgcaccctgccaggtttggttacatgttaggcttcgattagactcagaagacatttgtttcatttcagattttctggttgtcctgggaaaagatagttaatggaattttccatgagtaagaagactgttagatggcaattctcggtgctgcaagctttgatattttatagtgtgtttaatgaacagtcctattgtcttttgagataaacatgttattgaatcttgtcctatttagaataaggaagaagagtaagaggcttttttgggtatgcagagacaaatgttagtagtatttacatgtactacctttattaaaagcagaaatcacaccaaatacttaagcacctggaaaattgaacttcctaaaataaagtatgaactaacactcagtttcttggaatttttttttcttctaaatttattgtgtatatatgtgtttgccggcatatacatacaacacacacacacacacacacacacacacacacacacacacacactgtgcatcccatgtatgcttggggcccagggaagccaaattttgagccatcgcagtgctgggtgctgggaattgaacctggtcctcctgaagagcaaccagtgttcttaagcacttagccatctctccagccctggtggtaggccattttgttttgttttatttttaatgttaaaaatatgaccgaatgaaagaggtcagagtaaagtcacagaaaaagaatgcactttaaacaaaacaagacatgttggtttttgaggtacattttttttaaagttttgatttaatacatattaacctggataaggccaaagtaatgaattattatcagactaatggatagtaaacagtgagaaaggttgttagtatttattgtgtaactgattatttcttatggcccttcatgaataaatactgccaattcccaagcaatacaaaccttagagctatcaactgagaaatgagggtttgtttgtttttagtttatattctttatccacccacccatccatccacccaccctccatccacctacctatccatccatccatttatttatttggtgtgtgattgtgtgttcatgtgtgtcttgggagtcagaggacagtttgtgggagtcttcttttccattcttccaaattcaagtcatgaagatcatgatgatgaaggtcaggccaggtcagcatgacgacaaacagattcttagcaatagaaatcgtgggtaatgagtaaaatgatgtttaggggttgattattagtagtcacgtttgttgnnnnnnnnnnnnnnnnnnnnatgcgcacacatgtgacagacgtttacataaatgaaaacaaacaaattctcaaaacctgggcattttcagcatctgattagtccagaaaagtattggtgatgtttctcccagcatggacataactgaagtgtttgtcaaagaaagatctgggctgcatttacttaacatgattttgcttttgttcaaaattttttgtgagttgtatttttatgtattctttattaaagctactaacttaaattagcttggtggttgtgtgtgtgtgtgtgttttgaatcaatgatcttggtatttatttgggctatttttagaaactacagaccctaatttaaatataaacaataaaatgggggagagacttctcaaaaatcaacagcactgtagatggcttttattgacacaaagcatttgagttgtggtgatgtataagaggtttccattttcattgtttcctttgacttccaccgtgcctgtagttcttagagcacttgccctcatctgcttcctttgttgctgggtaaggtttgtgatacttttctctgattggctttaggcagctaaggctttgagccaatcagagagtgaatttcagttccctcgcaggactgaaggacgcgctgaagcagctgttgatttatttcccttatggggcgattatataaactaaaattatggctgcagcaagctccctcttgggtatgtttgaaaaattgcaaggttcacctgtaatgaagggggaaaatgatgagtttaaaaacgtgttgactaggaaaagctaataaagatagtgaatttggggcaaataaattctgatcatagattttttttttgtagtattaaaaaaaaaaaccctgtaaaattaacttacaatccataccttttattgcttcaaaagcagagcttgtgttgtctttttaaaaatcaactgtgaaaggcaattaattgtgcttgttgtagtaaatacattgttaccacttagagcaaccaaaaccggacattttgattttgttctgtgaattaagctgagtcaggtccatgcagtagacaacacagcgctttgtcatcctacccatggtccagaagcctgttgaattttccgtttggaaatctgtattagtaacggtaggtgaaatggtttgagagatcatcttaattattgggacttaatattttggtcttaatatttaatattaatatttgggacttaatatatatatatgtgtgtatatataaacaaatagaagagctattaaccttgtaaaagaaaatatattttgaattttataggttctaactctgtaggaatggtatttttatgtattgtccctgtttagctgattcctcagataagttatattttagaaacatttatgaacattgattaaatccagataaagtagcataaaagatctgtaaatcttagccacttgtctatgtgtgctgtatatgtaaaccatatcatggatttaagacagggatctgtgttctaggttatttgtttcagacaaagaaccacattgcaccatttcagctctgggctttgtcaactaggtttctctgaccttattgtctgtctcctgttgctgggcaggaaatagaatgctggctactgattggctgagtttctatgtagctcttgaacagccacttaaattcttgagttttttgagcagggagattataagctaagacaaaacagtttccctttgtttcatggctgtctgtgatctcttgctagaaaatgaaagaagtgggtgcggggaggggcctcaggaaaagttctcctttgaagaagaggctcactgctcttcccttaaaaagaatttatcaaaaaattgaaaaaaaattacaaggcatagagacatctcaggtaacacacttttctctggttattaatgtataaatttctatagaaaaatgttgataatatttcaccaagttcttgaatctgaatatgtaaagtaaggacttaaatacttcgtttttaaactccttttagattaaaaaagtactttcaggagaaacttaattcatcacgtcatgtgatgtacttctaggtacggcagacatgttctgctgtaaaatagaaatgccttcctgtaaactgaggtgcggtcctgtggaagcgctttgacccatgttgctgctgtaccgaggagcagagattctccagaataatgtaggtggatgtggatggtatctgaagtccagagggcgatgctaaagtgagctgtaggattgcttaccttctgctaatgccgccttggagacttgtttgcagggtacacgcccttccctaatgtaaatttttcctaatgagctttgcttatgcaaaatagatttctcaaagcagactgctgattggtttgcacagatacgcctgaactaatttgaacttgttcatgctacttccttattgctttgtctgtttagttatacatagaacccacgagaatctgctgaatggctgtagtgtgccccctggtggggatggaaagtatggaaggtctcaggcaggactttaggtgattagtgaattcagtggctttgttgcaaaaaaccaacttgacttgggttatatttatttgtattaagtgttatttggtagagagaatttagtaatagtgtttgtttacactggcttactatattttcaaatatctctcacacaaacacacacaatatgttatttaagagaaaatttgtctcagagtctgaaagttatacttaaaaactccacggaatgtacatagaggctaaacatagaatcattctagatgacctgtttgtggttgcagtctcacactgtagcacagtttggacaggaactgacaataacttaggctggctcagacttgtaatgatcctcctgcctcagcctcccaagtgccaggattaccagtgtactccactttgcttggcttcaatccttaatattaattaattaatcatcaattagtcacatctcagataattctcagcaaagccggtgttggtatatgcagttcctcttaagatactttaagatacagtttcttttaaacactttaaaaacttgaaatgctaggcaagcagcctcatcccggagatgtgggactcaaacttacaactcccagccaagttcattgattatttgcattgtgaaaagttaagtatggtttttttgtttttgttcatttgtttgtttttgttgttttgagacagggtttctctgtatagttctggaactcagtctgtggaccacgctgacctcgaactcagagatgatgcctctctcctccacacctaagctttggaattaacggcatgcaccactacactggcttatgttttaaaaatgtttaattttaatgtaaataattataactcttggttaggcatagaatatctgaaaatggatatttcaaagtttaaaggaatagtacttcagtatttgaacatatttaaatggcagtcacactacatttaatatgtttattatagtcaggctcatgagtgctaagcttgtgctgcctggctatagttcacagcatgcattggaagcccctgggttttatctcctgcccacagtttatgcagaaaaatgtccaggtaacaggacttgcaggtggaggagaaaagatgctcgccgagtgtaaatcctaggcttaaacaggaccagtgggggtttgtttcaaggtttctgtaaatagagttgaaagatcatttttctaagaactgtactttaaataaaaagaagacactaagaactgtttaaattattgacttaaattcagaaggtgagtgcaaagtgtaacataatcgggacattcgttgacaatgtaccgtgtctttagagctgtactggtctctgacaaataggtcaggctttttatttattgaataacattcactattaacaacttaggatgcttatttattgcaggtaagttatattagtaagggtgctgaacgatacagtgtagagtagattgttttgtggaatttaaaagtaaagcctcactcttgattgggtgataccaggaactaagtgtatcaataaaagagagaaaggggtgggggagagagcatctatgtgcatacacatgcacatttacatatgcttttctctgcctatagttaatctcttgctttggtggtgatgggcccatacccaggaccttccttacgcatgccaggcagaactgctctgcagtgagcaggtagtcttagctctgtcttcttacttgctcttttgtactagccttttgataacataaaattggtgatatgggctgcctttgtttctcttgttattttaatatcatttcacaattaaatgtagcatcttcctcttgaaaacctttagcactcttgcttttttagagtcttagttttaattataaggtagtactgaatatgatctaatggatattctgtctgttcaggtgggtcctcgcttactcttgctattgtgtttatgtggtaaatcacacgcacacacacacatacacacgagcacaggcacgggaatattgttttaattttacagactagaagttgaaagtgatgctgtagtcaaggcatagttccttggatggctctgaggaaggatttgtccagacacatctccgagctgcttcgagttgtttggcctgtgatggtatagctcttgtttcacatggttttactctgtgcatgctgaagtctcagagacattaatcagtttgtactaaggcccatcctatttatcctcttctcatctacaatttaagcagtaagactacagtaccatattctcactcattttaaggaaaaattgtcaatcaggctcttttgtggccctgtatagaccaggatgcttcaagacttgttaatgatcagccttgcttggcttttggataggaatttttgataatgatcattggttgggttttggatgtgaatttttgataatgatctttacctagtgattagtattatctcttgaagaaatattctgcttagtcatttatagatagaagaagagaaaactatggaaatttgaaaatgctttagcagaagacaagctgtgagctggaaatgtagcttggcagttaagaaagaatattggctgctctcacagagaagccggggtttggttcccacccacatggtggctcagaactgtctgtaatactagttctataggattcaccaccgtttcctcacctcttcgcatgcatggactccacatagctatttggttacatgcacatacaataaacataagcaccttggcaaacattagattcatttgtgtgtatatattaggaaaggtgaaatttaacggagaaccgaggactaagcttgaaccacaggggaaggacgaagtgcagtgcttagtctcagttgtcaggtgacaagatctagactccttgagaggtgggtgggcctctgggatttgcctatggatgggtttatcttgattaggttaattatgtaaaagacccacccactgtgaatggccctgttccctgggctggatgtgggaaaaagtaagagtgtgcgggagtttgtcatggctctgactgtgtgtgtgtgtgtgtgtgtgtgtgtgtgtgtgtgagagagagagagagagagagagagagaggcatgtgaccagccacttcaacccctgctcattcaacctccccaacataatgggccgtattgaactgtgtttcaaaacaaattgctctccccaagctgtttttggtcaagagtattttatcacattatctgaaaaagtaacttaccagatgcaaattaacctcattcaaaaagtcaaagccttgatattaggggagaaagcagcaactgctggcagatgcacagcaggagcttgagcagtgagaagagtacattctttgacaaacagacgtgaagggactcgagcaagattgaccaaaaggaagaacatattcaatagtttgtagctatcaccacagtgaatgttagaacattttcattatttcaatcctgtactctaaagcatttatttcttgccttctccaaacctgcaaagggagctggagagccggtccagtgattggttaagtgctgctctttagacagtgactcggtttggtctctagcacctattgttttcctggacttttcacgcccctgaagcggctcctttttaactcttcatttgcttccattgatgttctggtgtgtgttgtttgtcacttctgtagtatgtgagtagtaaatatgagaactccgaccgagtaattattaaggttttgtcagtgttttaaatttatatgatctaaattttaccctttttaattttcattaagcctgtagttaaatgactcttatctcagtttattaaaatccttttctttttatttaaagattcagaatggatagtgtagaagaacctcagaaaaaagtcttcaaggctcggaaaacaatgagagcgagcgatcgccagcagctcgatgctgtgcacagagtcaagggggagctgctgagagccgacgggaagctgctgaacgggagccatgagaatggagacttggatcccacttcacccttggaaaacacagattgtattcaagatcgagaagaagtgaatggtattgatgggatttgttttcagtcagaagaaagtacaacggaaatggaaagagaccccttgtatgcccaatgttgctgtaaaaaacaaacaagaagatttgaatagtgaagctttgtcccccagtataacttgtgatctttcttctagagtaaccactgaaccagcttctggtagtccagcctctgataacccaggctgtggtaccccagtctctgataacccagcctccgataacccagcctctgacaacccagcctctgacaacccagactctggtgatctggctgcaggagagctggccactacagtacaggctactggtgactctgcctgtgaggagcctccctccagtgatccctcttccagtgatcccacttccagtgagccctcttccagtgagcccacctgtagtgagcccatctctggagatcctgtttctgaagaagccgcctctcatgatcttgtctctggtgattccacttgtggcgagccagtttctggtgagccggtgtctcatgaagcagcttcgagtgagccagctacaagtgagccagcttcagatgaaccggtcgcaagggtcgtggcggcctgcgaactggctcctggggagtcagccttggatgattgtgccccctccggtgattcacagtctgatgagccaccttctagtgaggactcccttcctaggtctgtctgcagcggactggcttctggtgagctgactcctggggagctctctgtggaaccagccaccgacactgttaaaccaagctcatcggcagtttgtgaagcaggtcctgaccctgacaagacagagccgagtagcaataacagtgatgattgtccaggcaagagtgaagacgacgaacacttagaccaaattcaaagtaaagactcctgtgatgagggaaataaagtgaacagtaatgtcgtcgagaaggaagaacctctcgaaacacacagtgcaattatttgttctgatctacctccagaaaacacaacgaagatagcggaggatcccatcgctgagcctgctctcgaggaagaggccatctccagcagcatggaagttgaccaaagcgaaaaggatgagcataaaagtcctgcagaacctgtagccgctgtcagtgaggaccccgccgaggaggacaaggaggatactgtcgtagacaacacggactccatggaaacagatgagatcattccgattttggaaaaacttgcacccaccgaggatgaactcagttgcttttcaaaagcttctctccttccagtcgaaacaagtcaagatttggaggataaaatggagggctctttcggctcaccctcgaaacaagaaagtagtgagaatttgccaaaagaagcctttttagtcctttctgatgaagaggatcttttgtgtggaaaagatgagtccgaagctgtagcgcagactaagatgagcactccaggttagctgatcccggacttttacttgctttaatagactattgaatacaacatgctcaataatgtcaggactagtgatccatgaggaagattttatagaatgcagctaggtgggttgacacaaggaagtgcagaagtgggggaccaaggagttgaaagttaactttggctccatgggtagctggggactacatgagacctagtctcaacccattaacaaaacaaatagaaaaaaacttacaaaatcagaagaactaatatgtcgtcgtccatctggggacacgctgttgcatagtgctaagtgataactttctaaatgatgaaaaccgtagtttaaggagactaagctagggtttccttttctggggaagttcggacatctgtggatgtacgtttatcctaacatcagtatgcttcatcctacacagtctttactgctgtttgatctttttcttcattttcagatcaagccctccagccgcatgtacagannnnnnnnnnnnnnnnnnnnnnnnnnnnnnnnnnnnnnnnnnnnnnnnnnnnnnntgctgcggcccttaggacacttactcaggaagtggtgactcccaatcataaagttattgttgctacttcataactggaattttgctgctgtttttcattgtaatgtaaatattttatatgcagatggtcttagctgaccccaggaaagggtcatttgaccccagaggttgcagcctacaggctaagaaccacgaatgggaacgatagcatttgcactgtagtactggtgtaaagcttggaaactgtggggaggagggggattttcctgaggccatgtagttattgttatttctataggacaacagtaagtagtactgtgtcagacttgtactctttggccattaaaaggaaaataacttattaaatgtaatgctatcaggaagatattaaatgctttatttgagttctcaaaggttttggcgttaccagaacgataagattagtcaactgtctttagtgctcttacagtctagctttgacagactggagcgaagcttatggcagttagaagtctgaaaacacagcaccttaatgagaaggctgatcttgagacgaacagaggcatcatagcaaccttgcctacgtagaaagatggagccgataagaactgatgggctaataggctttgtattggaaatgatgcacaagtagtttctgtacaagggcatttggttattattttatgttcgagagatggctcagtactgaatattaatttgctactcttgaagaggactgaagttgggttcccagcacccacatggaatctcataaccacccataactctagctctggaaagccagcactcttgtttggctctgccgtacctacctacctatctatacacacacacacacacacacacacacacacacacacacacagacacacacacacactcacatcacccacataaacactaaatcttctcaaaaggcagtttgcacaatccctagagactgagcaaaaagttaaagaaatatgggcctgccgggcagtggtggcgcacgcctttaatcccagcacttgggaggcagaggcaggcagatttctgagttccaggacagccaggactatacagagaaaccctgtcttgaaaaacaaacaaacaaaaaaaacaaaagaaaacaaaacaaaaaaagggccctacttcctcataagattctgttaacattttttggtatcaagagttctttctatgataaaatgtaaaactctagcatacattctaatccttgtaatttattctaaaactcagtgtatgttctaagtgccatgaatctagtaggcagatctgaaaaatggtaattcagcataggagagttctgagttgtttagggttgttaggtggtcagcgtatatgtgagggtctcgataatgggtcacttctccttccaccacgtatgtatggcttgggaactgatgtcaggcttgttggcaagtgtcttttggtttattttaataacagaaagtaaagaaatctttaagatttataatagttgttactgatgatggaaagtttataagaaaaattgttggctgtgaaatctagtatttatcatttccgtttattaggcataaacagtctgaatgtgaacttggtctttaacttcgcagattgtgctccctcccagagtctctatatttcttactttgtgacttcagctttgtaaaacatttgctttgtagcccgattggtgaccaaaaatgtgaattagtgaggtgttcctgatttccatagaaataaggctcccttctccatctttgtcctgacagagggagaaaagagtgagaagggcagcaaagctgaggaagaggagcgagttccagccgaggagcagccacctgtgagaagtacgtatggtatgcaccagctcctaccttagtgcgaccccagccatgggcttcctcctgcttctctccacttgtgaatttaagccccagtccctgatgctgttcattagtagctcagggatctttgaatgtattatttcaaatgttaatgtgcttactgtattgtttatggtaatcattttgcagcgagtacttagacctacactctaaggcaccagtgccctaagctgtgctggggacaggagggtttgccttgctgtaagtgaactgcagtacatttctgtctacagccgacgcatagggaaggaaggaatgctagaaaactgatgccatagacttagaaaaagctagacgtcaaggtttgattttggtttattatatctacattaaaaagttgtaaagtagaactctatgaaagaaatgtctgggtggatgtgagtatggttgcgctcctccctgccttgtatcctgaacattattttacaaatcaaaggaagtagcttctatttatggagaggcttggccatagaaggtatggaatatgctgaaaagccagtacaaaatttcaaatgacttcatgaatgttagcatttgaaaaaaatgttttaagtaagatcttcgagtgtgtgttctgtgctaaatgtacttttgtgacactaattttgctatgtgtatgtgtcttaactctacttggctatgttaactacctcttggagtactgtcactgctctaaaggttgaatgacttgggaatggcgcagtcagaatgaatgactgtctttcagcagttttcgcagaaggaggaggattaaataattgagaatgtgcatagctaatagatctctggggcatagtgatggcggttacatgttaaagtattcccatgtgctgtggaattcagtatagcaaagctatagacagctctctgtcttgatgttaaaatgtttcaaggaaagaatgctgtctcagtgtacattgctaagcagttgggaagttctgtttgtcatgctgaaatcctttattccatctttaaagctgagcgttgtatgcctgctgagttcttgtgatcttgagagtgagtaggatgaccgacggagtgtggtcttggctgactgtagtgtgaagcctataacttacacagcagactcagcagtgctgcttgctttgttgtttttctcagatgaattttctagacgaaaacgttctaagtcagaagacatggacagtgtagagtccaaacgccggcgatatatggatgaagaatacgaggctgagtttcaagtaaagatcacagccaaaggtgacatcaaccagaagcttcaaaaggtagcacacatttcatgtcacatgtgtcaagaatgtcacaagctgcatgcttggagattttcagcatgatcctattattctgtgtttaccttgacataatctagtcagcttgaagacagtgacaagctatgaaatctatgataaattttattcctctatttggctacaatagttttattttaaaacatggtagtaaatattaaaatagaaggaagctatgacatttctctattattattaaaaatttaaggtttttgaacatttctttttctatatgaacactgttatacaatgcagaagaaacaaactttatttagtagactttaatttctataatattaagttggtacaatctaaaaccctttttcatgttagtttaaggcatgatagagacaagacttcggatggattaggaaaagtgaatgttcagagtaaagatttttttgaaacttccctgtatatgctatggtagcattacaatatatgttgaaaataatattgttatatgtacttctgaaagtgtgagaaagcagagatctctcagagggtaattagtatgccagcacgcggtcccagttctcattggatgcactcatacaagccaggtgtggtggtgcttctagctagggcactgggaggggaagggaggcgactttggggtcccagaggccaactaggagagccagttggtatacttcagtatgcgagatggtttcaaaactgaagaatcatggaagataccaggaatccatgggtaaattcatgagcacacatacctgcatgtacatcacacatgcacattaacgtgttcagataccttttgtagggagacaatctgaaatttcttccacggagatactagtacaagaacaaatatttatgctttctttaaaaagaaaaattaagaaacaatgcaataaaaatgctgtccccacctagtgtctttctcttgtgcatgtaatagtaatgagagaattgtgaaggagggaggaatgccatgggctgacatcatcgctacaacagagttcacaggggtgaaggacagactgccggctctggctcattatgggccagatggagtaataatgcaactttgaataagcatttagaaatattttccaattctgatactgcagtggcatttttaatgtacctcacacagtttccaatctttaataggttagaagaatcttgttctttttaacaaattttgtttttatggtttcagcataaggaagataagaaaatgctagagcttcaaatcatttcagaactctgtctctgcagatgtcattcttagcatgtactttccttttggggttgtagagaatcttagcaggtagcagtgagttttggattctttaaattagtttatcatgttttattcattgaatttatattgttattagcccttaatatttactgtttctgttttgtttgctgaattgcctttttacatctatggatttttttacttttttaggtcatacagtggttgctacaagaaaaactgtgtgccctacagtgtgctgtgtttgataagacgttggcagaattaaaaacacgagtggagaagatagagtgcaacaagaggcataaagcagtgctcaccgagctgcaggtctgtcccatggacccaatctgcagccttgtacctgggttcattatcatttatcttttgatcgtgtgctaccacttttatatctttgaggttgagcagaaagtacatttacattctatgtaagaagaaaaagtgtttgttattagtttttcctggggctgctgtgaaaacagagccatacctagctggatgctttacccaatgaagtgattatctcacagttggaggtgagatggaggcccagtatgaaggtatcagcagaatagctttctctggaggtctagtattgtgaggaagggtacatgtcgtatcttctcttctcatggttgttgacagctttgtggagacatcctttccattcccagcattacctgtagaagctattctctttgtgtgcatgttgtatccaaatttctctctattttgaaggtaccagttacattcattagattaggggaaatcccagtccagcatgatttcatattaattacttttgcagtgaccctgagtttgtagactttatgataatgagctttagttagtatagcttaatccatagcagagactccgaaattacctaaattagtacttaagtttttcttgggggtgaaggtgggggcattattttcacatcagtatactttctctgtggatattgtgccttaatgatagtttattgtgttggagagatgacttggtggttaagagctttggctgctctttcagaggacttaggtccagttctcagcactcacacagtcacaactgtctgcaactcaagttccagaggatccaatactttttaactgatctccttgagcagaagacacatacatggtatacatacatacatacatgctggtggaaacatttgtacacatagaattaaaaaattagatgttgcctaatccatattaaaagtaaatgtgtttttctgtatatagttaagatgatcttgaagttctggataccatttcccctccccgaatgctaggattatgagcatatctgctttatgtggtgatgggaatcaaactcaaggccttgttcatgttgggcaaacactctgccagctgaaccatccccaactgctgctttttcactccctgcccaagtgtttctttattcgatcatttgagttccccctcaaaaaaagtttagtgtatttcccagtaattctgcagggagaacaaaaatggagaacaaaaatggatatagaatgagtactccttttatcatcatcatcatcatcatctttctcttcttcctcctcctcttcttcctccttctcctcctcttcttcttcatcatcttttttatttcaactttggcttacattctactttatcagatgtgtaggtacctaccccagcttgctttcagttatcatttggattatcattttccattttttcatattaactatttttaacagtgtgatgtgtttcttgcagacagtaatcagttggattttccttccctctgtttagtctgatcaatcagcctgtctgcatctttaaactagagattaaagatgatttacatttattactgataattatattcttattcctggaaatctgtctttgtggtccttgctcctcagttaatttgaacacacttttttctccctcatctttttttttgctggttcactgtgttaaacttgtttcatttcctagttctgttttcacatattttctcatggaattcatccttttctaaactttcttctttatatatgtaggattctctaattttctctaattttgattaagtagtcatggtttgatttagtgtttgttcatcttaaaatgtcttttttcccctctcccttcattagaatttaagggataacgtttttgaatataataacctgtttgataaatatcattctatgattccctggccttagctcttaacactgcattaaaattctaatgaattttcttaagatggcctttcacttttgtaactatcaacattctttgttgagtactcttgataatttaactactatgtgacatgaagaatttctttctgtctgatcagagttgtaaatacctcttatttgtgaaggtccatatcttataaatcagggaaattttctgctataatatgattgaatagattttctgtgcttttagtttgcatttcagttccttgtacctcatagatttacgtttggtcttttgatcagagttcctgaaagttgtagtcatggttcattattcattttttcctttattattatatgaatataagaatttctttacttgttttcaatttctggtattctttcttctgattgacaagctctttgggtgatacttcctactgaggttatataattgacctttccatttctagtatttctttctttctttttttcttttttttttttgttttttttttttttgttttttcgagacagggtttctctgtgtagccctggctgtcctggaactcactttgtagaccaggctggcctcgaactcagaaatccacctgcctctgcctcccaagtgctgggatcaaaggcgtgcgtcaccactgcccggctatttctagtatttctattatatattattctacagaatctctctttgttaaatatgaatttgttatctaaatgcccaatttttatttacttcatttaacttcatttttttcattgaggtgcttgttcttttttaaattatatttttgaattctttgtctggcattcagtcattttgttgttttggattcagttattaagaggtcattagcttttggagaactctcacacttctgtgtttttgcactttaatgcagtctgttggttgatacttctggttttatgtaggattgtcttagctggttgctttctcttgaggtttcagtctcttttactcctcagagacgagaaagcataccacagtaacaattgctatttaaaaaacaaacatatatgttgaaattttcattacgtttatttagtatgtatatgtatgcatatgtgtgtatgtgtgggggtgtagacatgccacggtgcacgtatggaatcacaagtacagctttctttctgttctctggttctgccggattaagtgcaggttgttgtcttggtgggaagtgctgagccatcttgcacaacatccttaaatgtagtaaaatagttagaaacattcggtcttatattcagggtgaaagatttatggcccaggaaatgtgtgataaactcaggagttcattaaagcacagttcagtggaaatagagaacagtgtaggaaaggacagaacgagagcagcaacgtcatgaaagacagggtggacaggctgtggaagagtgagagctgtagtgagcaatgacagcacagaatgagtgcagagccagaggaccagcagggaccagctgagtcctggttgtagaggggttaggagccctctgggtgttctctaagctcatccattggcacttcactttagaaggcccgggatcactgagttgttttctctgagaattccagacagggtagatatgaaagggtttttgccatctaagctcccttcatctttcaaagggaaatttatcagccctcacctgcccatctgaatagagtcagtaaagcctttctgaaaaacatttagaagacttccattagaatatgcgctaagaattctacttctgtgtataaacagaaaaaaatattctgataaaacaaacctaacaatcacagccttatgtgaatagcaaggcactaggaaacactcaatttatccaattttaaaaaaatgtgtttataatcagcttctagtacagtggttttcaacctgtgggtcacaaccccactggtgtgccacatatcagatatccttcatatattaagtatttataattcatatagtagcaaaattgcagttgcgaagtggtaatgaaatatttttatggttgggcatcatgacaacatgaggaactgtgttaaagggttgcagcattcgggaggttgagaaccacagatctaggaggaaggtgcatggacaaaagagcagtcagttactaccgtgcatagataccaagtagtttcgtccagggatctcttatgatttccgtggatacctctatcctatatgttttcagtaaaaacttaagtgtgactgtagccattttgaaaaatagctgtcaataaagccttacatattccaaataatctggtgttgagagcaaacacaccagttgttaagggcaggctggcctatgtgtgcttatacctggtagttattgcaaggaccacagtgggtttcctgtgatttttctctgttttccaatattttataaccatcttgtcttattttgctccggagagccaaagccgtatgtttttggtttctcctctgtgtagcaggctttaaaggatggtataccacttgacttttatttgtttattttctaggccaagatagccaggttaaccaaacgttttggagcagccaaagatgatcttaagaaaagacaagaagtaagtctctctgtttagtcttcatcagtgctctgtccctgtaagagatactatgatggtggcaactcttataaaagaggacatgtaactggggctgcttacagctgagagtttcctttgtctgtctgtggaaagcataacagcaggtatactgactgacaggtgctgagagagttctacatctacaccggcagacagggtttggggactgcaaaggaggggagacagagacagacacacgtacctctccgtgtactctgtgcctggcctgagcttctgaaacctccaagctcagtgacatacttcctccaaggtcacacctcctaatagtgacactccttggtgaccaaggatcctttgtggataattcttatttaaactactacatttagctactttttaggagatactaatatttcctgtatcatgaaagtaaaagttgcttttttcctacttattagtataggtggttttagagctgaatgtttagactaattagttcttgtcgatattagtgacgtcagcgttatgaatctgtttgcacttgcagactttctgaagctgtgtttctgtctttaacattatgttttaaaaggctgggcatatagcttggttggtgtgtgcttgactagtgtgcaagaaacactggaacccatcctagcattacatgggacagggcatgatgcgacagcacccaagaggaaggaggcgggaggatcatgagtttaaggccttccttgactatcgagagttttatgagagcctagatttctggaaactcggtttcacaaaacagaagttctcttttggagatttgtcttatcttgtttagctctttgtacgttcttgctagcatcttactttcatttatagttttccttacagtcaatcgtctgttgtgctgttactatagaatgcagacaaagattaggttattcttcttgcctctaacagttggaacatatatatttttttaattaatttatttattatatgtaagtatactgtagctatcttcagatactccagaagagggcatcagatcatattatggatggttgtgagccaccatgtggttgctgggatttgaactcaggacctttggaagagcagttggtgctcttaaccactgagccatctctccagccccggaacatatttttttaatagaattaaatataagcatcagcacagcctttgtctgactttggcttgttgttctttctttttggttatttctttattattccattatatttttattcctaattcagtatagaagttttaagtttattttcagtcgagtaaataccatttctgtgttttgatagctccattatctggtacatggtgattgctatcagccatcattattctcagagccctttcataattgacatagttccataccacatcctcctgaaggacctgagttactgttcttggtgcctgcaatcaccgtgtagtgggcctgcatctcacttaggcctgtggccagtatactaattgatggcagctgcctttgtagattggaagagaaagtgcctggtttccttccctgggagaataatggcttttcaagagataatccatgttccccaaacaaagccatttttaaggttggcttgaaaaaaagaaactggagagctttcgattccacagaaaatgaagaaaaagcgtctgaagctgagtggatctcaaatggatcacagcattgttgccgctggccagacctcattctgaactaagaagtttgtgagactgaagaatgattgcttcagtagtgtgggccacgcttgatgtctatgtttactttaaaacatggagtgaccaagagaatgggaaaggatctttacctatcctaaatcagataggggactaatatccaatatatataaagaactcaagaaggtggactccagaaaatcaaataaccccaataaaaaatggggctcagagctgaacaaagaattctcacctgaggaataccgaatggcagagaagcacctgaaaaatgttcaacatccttaatcatcagggaaatgcaaatcaaaacaaccctgagattccacctcacaccagtcagaatggctaagatcaaaaactcaggtgacagcagatgctggcgaggatgtggagaaagaggaacactcctccattgttggtgggattttaagcttgtacaaccactctggaaatcagtctggcggttcctcagaaaattagacatggtactaccggaggatcccacaatacccctcctgggcatatatccagaagatgtcccaaccagtgagaaggacacatgctccactatgttcatagcagccttatttataatagccagaagctggaaagaacccagatgtccctcaacagaggaatgaatacagaaaatgtggtacatttacacaatggagtactactcaactattaaaaaggatgaatttatgaaattcctaggcaaatggatggacctggagggcatcatcctgagtgaggtaacccaatcacaaaggaactcacacaatatgtactcactgataagtggatattagcccagaaacttaggatacctaagatataagatacaatttgccaaatgcatgaaactcaagaagaacgaagaccaaagtgtggacactttgccccttcttagaattgggaacaaaacacccatggaaggagtacagagacacagtttggagctgagatgaaaggatggaccatctagagactgccatatccggggatccatcccgtaatcagcttccaaacgctgacaccattgcatacactaacatgattttgctgaaaggacccagatatagctgtctcttgtgagactatgccggggtctagcaaacacagaagtggatgctcacagtcagctattggatggatcacagggcctccaatggaggagctagagaaagtacccaaggagctaaagggatctgcaaccctataggtggaacaacattatgaactaactagtacccctagtcggccatcagtggaaagagaggcccattagacttgcaaactttatatgccccagtacaggggaacaccagggccaaaaagtgggagtggggggttaggggagtggggggtagggtatgggggacttttgggatagcattggaaatgtaaatgaggaaaatacctaataaaaaatattaaaaaaaaaaacatggagtgagttagttgaaagaagctggaagttctgtgaagccactcaggaagagaagtagctcaccattcccagctgtgacgcgcacagagctgtgtgcctgtcacatagcgtaagtgtcttgatacccgtgggctcgctgtccagcaaaggccaccacacagagagagcaccgccacatgagcacagagtccctcagggggttctgagaaactatcaagcaaatgaccaagtcctaaagagaaggagagtgtgtggccctgtctcctaagttagagataagcatcagaaagaggaattgactgaagtctccagctggagactgacaaaatgagaaagttcgaggtttatgaagataaattatcaagagaagataggaaaagacaaagtggtgttgtttgatcttgcagtgatttctattgtattagttattagtaaaataacagatcaggaaatgagaatgccttgaagggcttatttttttagacaattcctatatattagaatttactttattatttccccccttacttcccccttccagagccctccaaacccacccatatcaccaggaaagcctgccaatgacaccaacagcaataataatatgacctacaggtaagacctgtgctctctttatctgttgtttatggtggaaagcaaggttaatcttggcatataatgtagatacctaggctgcaatacatggtgtattgggtatataacatatattaggtcatgtaattgtttttttacttctctcttataattcacaaaaacaatacattttcttttgttaagacttaaagctgctttaaaagaaagttatttgtttatttttaggctttctgtttttttataacttactctaaatcttgctcactacccctctcatgatcactacctcccacaatccttctcccactctctttctccagtgattggttggggcccccccctgggtatcacacacacacacacacacacacacacacggtactttaagtctctgtgaggctaggtgcatcctctcccactgaggccagacaaggcagaacagatcccacatacaggcaacagcttttgggaccccccccccaagttgttccagacccatatgaagcccaagctgcacacctgctacatatgtgcaagggaggcctaggtccaggctgggtatgttctttgattggtggttcagtctctgagaccccccagagtctaggtcagttgactctgttggtcttcctgtagagttcctgtccccttcagggctgcaatccttcttcctattcaataagagttcttaagctccattcactgtttggctgtgggtgtctgcatctgtcagtcagctgttgggtggagtccctcatagaatagccatgctagacttctttctacaagcataacagagtatcatgaatagtgtcagaaattggtgcctgcctatggatgggtctcaacgtgagccagtcgttggttagccttccctcagtctctgctccatccctgtccctgcctttcctatagacaggatgaattttgggtcggaagttttgtggatgggtcctttttttttttttttttacatgtatttatttatttcatgtatatgaatacaaggacctctgcttgccccagttagtcccgcttgctcaggctcaaagatttttatttattattataaataagtactctgtagctgtcttcagacgcaccagaagagggcatcagatctcattacaggtggttgtgagccaccatgtggttgctgggatttgaactcaggacctctgaagagcagtcagtgctcttccctgctgagccatcttgccagcccatttgggttctgtatctgcagtactgataccccagttcattcttgggtacctcccttatctaaggtctcttccttgtcctagagatgctgcccacctcacctgtcagttgcaggtttctattcattctcatggccatctgttcatctctcctgtccttcccctcacctgatccagaccttactccctaccttttctcctacccagttccctccccagtctgcctcttatgactattttattcccccttctacatgggactcaagccttcctttttgtctagcttctttggatctgtggagtgtagcatgggcatcctgtatttttatgactaatatccacttataagtaagtacatactgtgtatatccttgtgggtctgggttacctcacacaggatgatattttcaagttctatccatttgcctgcaatgttcatgatgtctttgttcttaataggtgaatagtaatatattgtgtggacgtacacattttctttatccatttttcagttgagggacatctagtatttgtctagtttctggttatgacaaagctgctatgaacataattgagcaagtgtctttgtgggatagtagggcatcttttgggtatatactcaggagcagtatagctgggtcttaaggtagaactattcccagttttctgagaaactgcaaaactggtttccaacgtagtggataactttgcaatcccaccagcaatagataagtgttcctcttgctccacatcctcagcagcgtgctttatcagttgtttttgatcttagccattctgatggatgtaacatgtaatctcatggtcattttggtttgtatttccctgatgactaaggactttgaacatttcttttagcttttctcagcctttcaagattcctcccttgagaattctctttttagccctgttccccagtttttaattgggttatttgagttgttggtgactaacttcttgagttctttataaattttggacattagacttctgtcagatgtagggttggtgaagattttctgccccaatctgtaggctgccgttttggcctattgacaatgtattatgccttagagaagctttgcaatttctttcttttttttttttttaatttatttatttattatatgtaagtacactgtagctgtcttcagacactccagaagagggagtcagatctcgttacggatggttgtgagccaccatgtggttgctgggatttgaactccggaccttcggaggagcagtcgggtgctcttaaccactgagccatctcaccagccccaagctttgcaatttcatgaggtcccatttatctattgtgtgtcttagagcctgagccattggtgttctgttcaggaaattgtctcctgtaccaatgtgttcaaggctatttcccactttcccttctataagatttagtgtgtctagttttatgttgaggtccttgaaccacttggacttgagttttgtgcagggtgataaacatggatatatttgccttcctttacatgtagacatccaattagtttagcaccattttttgaaaatgctttctcttctctattgtatggattttggccactttatcaataatcaattgtccatatgtgggtttatttctgtgtcttcatttcaattccattgatcagtatttctgtaccaatactgtgcagtttttatcactattgttttgtactacagtttgaggtaagcgatggtgattcctcctaaagttcttttattgttcaggattgtcttggctatcctgagtttttttgtttttccatatgaagttgaatattgctttttctgggtctattaaaaaattgtgttgagattgcattgaatctgtagattgcttttggtacgatggccatattcactatgtcaatcctccctatccatgagcatgggagagcctttcatcttctgatatctttcttaatttctttctttaagaacttgaagttcttgtcataaagatctttcacttgcttggttatagttatgccaagatattttatattatttgtggctatagtaaagggtgttgttgccttaatatctttctctgtccctttatcatttgtagaaaggagtgctactgttttctttaagtttgtatccagccacttcgctgaaggtgttgatcaactataggagttctctggtggaagtcttggcatttcttatatatactatcatttcatctgtaaataagtgatattttgacttcttcctttccagtttgtatccccttgaccttcttgtgttgtcgaattgctctagctaatacttcaagtactatatttagtagatagggagagagtgggcatccttctcttgtccctgattttcatggaattgcttttccatgttgttacatgttgactatcgacttcctgtctattgctttgattgtgtttcggtatgggccttaaattcctgatctccctgagacgtttaacatgaagggaaggagtgttggatttttcttttctttcagtttgttcatatagtgaattttgttgatggatttttgtagattaaacaatccctgcatccctaggatgaagcctacttgatcattttgatgtgcttgtagattcagtttgcgagtactttattgattattttttacatcagtgttcatgagagaaatcagtctgaagttctccttctctattgagtcttgtgtggtttatgtatcagggcgagtgtggattcagagaatgagtttggcagtgttttgtttctattttctggaatagtttgaggactattgatatgagctcttctttgaaagtctggtaaaattctgcactaaaaccgcctgtccctaggccttcttggttgggagacttttaaagactgcttctatttcttaagggatatagggctgtttaaatagtttacctgatcttgattttggtacctggtatctgtctagagaattgtccatttcattaagattttccggttttgtggactataggcttttgaagtaagacctaatgattctttcaatttcctcagtgtttgttgttacgtctccattttcatttctgattttgtttatttgtatattgtctatcttgattagtttggctaaggacttgtctatcttgttgatttttctcaaagaaccagcttttgggtttattggttctttgtattattttctttgttggtaattgattgatttcagcactgattttgattatttcctgccttctagccctgtttggtttgcttgcttcttcttcttttttttctcccagattatgggatctcggagtgttgtgccttcattttcattgattctagaaaatatttagtttctttctttttttcttccgtgatccaatgatcattgagtagagagttgttccgttgccttgagtgtgtaggcttactccatggtggtctgatgagatacaaggtgttgctccagttctcttgtgtcttgaggcttgctttgtgaccagctatatggtcagttttagagaagaatccatgaggtgttaaaaagaggtatattcttttgtgtttgggtacaatattctatagatgtctgttagattcataatgtctcttagtttcaggtccatttgattcataatgtctgttagtttcattatttctgtttttgtcagaatgacctgtcagttggtttgagttgggtgttgaagtctcccaatattaatgtgtggggttcaatgtataatttaaactctagcaatgtttcttttacaaatgtgggtgcatagatttttcctttgatgagtataaagtgaccttccctgtgttttttggttagttttggttgaaagtctatattattagatattaaaaaggctactgcagtttgcttcttgggttcatttgcctgaaaaattttttttcagccctttagcctgaggtaatgcctatctttatggctgaggtgtgtttcttgtgtacagcaggatgatggatcctgttttcacatcctttctgtcagttagtgtctttttattggggagctgagtccattctgttgagggatattaatggcaggtgactgttctttcctgttacttgctgttggtggtagtagtgtgtgtgtgtgtgcgcgtgtgcgtgtgcgtgcgtgcttccttgagttttgctggtgtggatttacttatttctggtgtttttcttggatgtagttattctccttgtgttgtaattttccttctagtattttctatagggcttgatttctggatagatattgttcaaatttagatttgccttgaaatatctagttttctccatctttggaaattgagagttttactgggtatattagtctaggttgacatttgttgtcttttttttagaggttgcaagatatctgtccaggcccttctaactttagagtttctattgagaagatgggtgtgtaattctgaggtctgcctttgtgtgttacctggccttttcctcttgcatcttttctttgttctgctgatttttgtgttttgattattacgtggcggggctagggtcttttgtttttttgttttgtttttttctggcccaatctgattggtgttatatacactacttgtatgtttctaggaatctctttgtttaggttgtaaattgctttttctgtgattttgttaaggatatttcctggaccttggagttgcagcttttcaccttcttagcttgggtcttttcatggtgtctcatattttctggatgttttgtgttaggaattttttagagttaccattttctttcactgatgtctcaatttcttctatagtgtcttctatgcctgatcttctctgtgtctcctgtattctgttggtgatgctggcacctgttgttcctggtctcttcccctgggttttccatctccaggatacccttagtttgcttctagttccactttcaggtcttgcatagttttatctattttcctccacctttttaattgtattttaatgtgtatctttaaagaatttgtttcctctttaaaaacctgtattgtttgtattttcctatattttcttaagggatttattcattttctctttaaaggcctctatcatttataccatgaatatttaaatcatggatttaaggtcattttcttgtgctttggttgtgttataatatctagggttgctgagcatggtagctgtactcggaaggtgttatatttctctgacttttgttgattgtcttctttcaagggcctttagccatctggctggcttttatccctggattttcccatggtagtaggtattgggaggggggtgaacctcaatggttctagtagggcaggcctctgatgggtgtccttgggctgtatggttctggctctgcagatctgtatgtttcaggagcctcaggtctgatgaaggtgagtagagatgtgtttgggagattggagctcctgctagagtagcaggctgcttggagcagcttggcctgccttggtggactcagcgagcagggaagatgggtgggggaagggctgttccctgtatggtttaagatttgaaggtctgttaaaggtgggtggggaggtgtctgaatcttttttctttagttttgcattgttaattattaaatatatagggctaaccctcccccagactctgtatttctttataagcaggttattagtagtttctagcaattgagaattgcttaatcagtgataagaatgtgcctgtgcctatatttagtcttcaggtaacatacagatgatgttcgaatatagactaggactcttgtgcaatgctatctgatatggagtggtctgtataccaactttgtcttaagggataggacacaaaccacaaatgccatcaccctttccttcctgtcctttggtggatctctcctaggatggcataaacactgactgtccatgtatctttttcatagaaatgcaggcacagtgcgacaactgctggagtccaaaagaaatgttagcgagggtccaccaccatcctttcaaactcctgtgaatacaggtaatggtgttgttgttattgtttttgataccagcatacattttcctaagaaactctaacatctttggttcttttacattcttttgtggttagaaatgggttagaaaacagggcactttggtataaatacaaatatatttcaaaaaaccacttcggactataactatggtgcatatgcagttgttcagatccttagtgccgaacttctcagacggcccaggttccgactggcacagtcctgtgcagttactaaagtccagagagattgttgaattaaactcattggtattaccaattaggttaaaataaaaattgaaggactttttgttcacttaaaattaataataagcctagaggcaggccattttctgtgagttcaaggccagccaggtctatatagtgagttctaggacagcttccccatagttcgtcttgtctaagaaatgaaaaacataccgaaatatattataataagcttgtaatatgcatgcaaggaacttgtttttttttttaaatagaaaatagagttgctgggtggtggtggtgcatgcactggggaggcagagacaggtggatttctgagttcaaggtcagcctggtctacagagtgagttccaggacagccagggctacacagagaaaccctgtctcgaaaaaccaaaaacgaaaccaaaccaaaccaaaccaaaaccaaaccaaaccaaaacaaagaaaatagagttaattttcaaatttaaaaatgattagtgagatcgtagagagctgagctccgtttctagacaagtaaaggtggcccaccgtggtgtgggtggtgcccaccgtggtgtggtgcacaccgtcccaatgctggggaggacagcaggctctggcaagccagcctacacagtgacttccaggccgttgggagagcctggctcaacatagaagaaatacaaggggcagacgggtgtgtgtgagagtgagtgtgtgtgagtgtgagtgtgtgtgtgtgtgtgtgtgtgtgtgtgtgagtgactgtgataaagatactgaagactgtgtgtgaagcttccagtgactaaagaaacaatattaaaagaaaaaagtcagtggtaccagaggaatgacacctgatctctgctctgctctccgcatgtgcatgccatgagcatacgtgggcatctgtgattagcagtgaaaacttatatttacatagacatatttcttgaaaatcatatttgatgttatacagttaaaagatggctggctttttttgtttttgaagagggtttttctgtattggcctggcatttgctctaaagaccaggctgcacccaaacttagagatgttcctgtctctgcctcccccgtgctgggattagaggcgtgtgccaccactgcctggcaagctggctggattcttctgtctgtatctcttttcaatctcttcagtctgctgactttgtacatgaaagaaatacagtctcatccaggcagatggaaacaggctgcccttagatagttggtatcccctttggtagtttctgtgaggttaatgcagaacagagtcagaaatcatattaatatgcttttctcattggttttctaagtcactttttgaagaaaattggccctgctaggcatggtagtacaaggtagtaatcccggaacttagctgactgtggcctgcaggtgatagagtcaaagccagtcagcgcttgtacgggaagatggccataatcaaaatggcagtttttattgcctctttatagttattttaaagtgaaatttacttttccctaaatactgtaataagcatttgctagttcagagttgagtgtgacaagaacatttggtgctttgagaccaccttatccacggtttattttccatggactacaaatattacatggaacacttcataaataattcatatctttaatcatattgtaataattactctattttattattgggtaccttttttttttaaaccaagccgaatcctgtgccccataatggcatttcagagagttctgaatgcacatgagacagttatctggtgagagcataatggagccaagaagttctttatcagctgctgcggccttagctctctcactgttgtagctcagcatgttactcacgtgtatgtatattatggtcatgggagtagccctgtagccccgggagctacacagactgcagcaagtaggattatgtaggacacctgactgcacctgtgctacgcttagttacacgtatcactagcttactgtaagcagatatgctattttagccttgtactaggtacatatatttcatatttactgtcccatgacccatggaatggccgacatacccaatcagatttgtacagctttgcgatcataccgcattagaattatatagtgacacatttttcaaaacatatccatgttgttaagggttatgtggctacatagggagagacacagtgtgtatggggttctctactgcctgctttgtgcatcactgggactgagtacggcttcagatatggacctgctgaactgggccaacaggcattttgcttctgtccacatagtgcaaatgtcaaatgtctcattagtattctgcagatagctttgacattgctaactccacacaggggttcttaggaaagcacaggtgtccctctgcgttcactgaccgtcatctggtgtagcggttgttttgggacgactagatatgtgaacacttcaactaagttacagtttaagcctgttcagtgagactaagccttgcagtcagcatttgtccttgtccctcttaggtgtctgctccatttcttagctcactcctgctgtgctttctccataccacgaatgggctgcaggctccttgaggggcttctccctgttagtcctttcccaaggaactcggggaaactgtcaggcttccaatagttcaaatggccgactctttctacattctaagttagatagtgctgatggtttaaggtatatttataatgttgaaaatgaggttttaaaaatattggtatatttttacttagtttttagtattttattttttcagttcctctgaagtgaatgtggtaatttcaaaagctgttttgatattgagagaacaatcttcatattaacgttaagtcatgtgacatttcataaaacaccaaacatatacacatatctaagctggccggtggttgtgggtgccttgcttctcagcctggtctacagagtgagttcaagacaacaggcagggctacataaagaaaccctgtcttgaaaaaccaaaacaaatgcaagtacttctaaacatttcagagtttcatactggtttttgggtttttttggtggcttttctgtgcccgtgtgtcagtgttttgtgtgtcagtgttttgtgtgtcagtgttttgtgtgtcagtgttttgtgtgtcagtgttttgtgtgtcagtgttttgtgtgtcagtgttttgtgtgtcagtgttttgtgtgtcagtgttttgtgtgtcagtgttttgtgtgttagtgttttgtgtgtcagtgttttgtgtgttagtgttttgtgtgttagtgttttgtgtgtcagtgtttgtgtgtcagtgtttgtgtgttagtgttttgtgtgttagtgttgtgtgtcagctaagggagttgtctagactgacttgtgtttacctctgtagtgtcttcagccagtcacgccacttctacagcagttgtcagtagtcagcctaaactgcagacctcagcaacctcgggctctctgccggcggcacctcttcttcctgcgcccagcacagccaccgtagttgccactactcaggtgcctagtgggacccctcagcctacaatctctctgcagcccttgccagtgatcctgcatgtgcccgttgccgtaacctctcagcctcagctcctgcaaagtcatccagggactttagtgaccaatcaaccatctggcaacgtggagttcatatctgtgcaaagccaacctacagtgagtggtcttaccaaaaatccagtatccttgccacccttgccaaaccccactaaaccaaacattccgtcagtgcccagtcctagtagtattcagaggaactcttcaaccaccgccgcaccgttgggaacaacgcttgctgtacaggccgttccaaccgcacattctattgtgcaggccacaaggacttctctacccacagtaggcccgtcaggactctatagctcttcaagcagtcgaggcccaatacagatgaaaatcccaatatccacttttagccctccatcttcagcagaacaaaatagctctgccaccccaagaattggtaagttggtttgctttataacaaaaacactttaatggtctattactcattaaactctttctaacatcactgggaaaatggggtaaacaatttgcttgattatttttaataattttccgaatccctaatgacactgctaaagtggagtgagaggggtttatttcacagtgctttcttatggaggcatatttgtagaactttatgggctctttgacaattacctgatgcatgtatacaacatttaataatcaggtcagagcattgaactctttatgtgcttcagacaggcatttttgtgtgttgggacttcattgctgttttttctgtatttcagagatgattttggcaagtaggtaccttactgtgccctatgatgcaggcagaactcttcctgacttactgtctctgtgcccctttacctgtctcccctctgccccgactttctccttcccctgtccaccccctttcctctccccttccatgtaagagaagttgtaattgagaacagaatttctgtttgctattttagtaatttattttcgtgagtttttgtacaatctttgtagtgagcattgtgtgtaatttgtatttgcttttatgataggtggatcaggacaattgagtaaatacattataacggtctaattttagaggtttattgtaagagaacatccataacaatatattgccaggctgtggttgcagtgcacagctttaattccagcacttgggccagaggcaggtggatctctgagttcacagctggcctggcctacagagcaagttctaggataaccagagctacacagacacaaacctgtctcaaaactaaaagaataacaagaacaccgacacccatgtatcttcactctgtatcattttctctgtcatattctgtaagacatattatctaattgttgtattttacttcaaaatataaggtgaatttggctgcaactgctatttcaaattgcactcctctatcctggctgtcctcagagaggtccgcctgcctttgccatgctgggagaaaggcgcgtgccacctcacttggccacaaaaacattgttaatgcacgcatttctaagacagatgtttactcataatcaaatcagatgacaagccagctaagcttcattttcccctgacttttctcttctcttctcttctcttctcttctcttctcttctcttctcttctttcttaaaagatttatttattattatacataagtacactgtagctgtcttcagacacactgggtgtgttgtgagccaccatgtggttgctgggatttgaactcatgaccttcagaagagcagtcagtgctcttatccgctgagccatctcagcgaccccaccccccaccctgatttcttttacaaaactttcagtatttttaatgtcagatgatttataatcgactttattttatgtgatttgcacaggatcactgaaattttgaagcaaagttggcattgtttttaaaatcatttaattcatttacattgaatttaaataaatatagaagtttactataagaccatggcctgtaaagaaagctttaaagagtatttgtttaatgctgtgagtacttatcccttaaatatgcacatttcagattatcccttcatcaacatgttcttttaaacaatttgtaaacatttgaaaatgctatactacaaaattatctagcgtacggctgctttagtgtcatcagtctgtttcagatttgctttgatattcagtgttttgtaagatgaattcctcacataatcattgattaatatagcattctctttttgagataatatatccttaaaatgtttctattttagagtatttatttggtatatttatatataactatatataaactattgaagttaccttcatatggaattgcatttgatttgtgatgaaaaactaatttctagctattagtaataaatgtgagtggcgcatacggtgttggcacagtattcattaggaagcacttacgtgaaaaccacggccatgcctaatttcagcgatgccataatgatagcaagaagatcatttatccttttagactacctggaatttaagtggaatcaaatggaaaagctttgcagaatataaaaattgaagctaaattacatatccttatcgttataaataattataatcatatagtcaaaacctatcatgtcttatatttatatacacataattagtaaaaatatgtgccatataactagattatatttgtacatatttacaatagtttattaaattcttactggattttaagtaaatagtacttgcttataatgaagtagagactctttaggctcaaattgtactttattcattcaagaaataattggtgtttgtaattttctcaagtcctacaggcacatagaaacacataagatatcctccttttcactaaccctacagattaaatatgcagccttgccattaaataagtagctataaatataataaatattatagtatgctgttttctttgagaagatggaaaggaggaggagagccattgaaaggtctgagttagtgaacagaaaacgggggaaattcctcattacactatttttttaaagggggggggtctggaggagtatggcatccgtgaatattgattgcagtgtggaaaatggttagatagaatgaagttgtggatgccagcaatgatgcatacaggagtggggcattagataagatggcaccataaagagatgcagaggggaaaaactggtgtacttgatcgtttgttaatttaagatgagacagcaagggctggagagacagctctccaaactggctgttcctccagaggacacaggtttggttcctaacacccaggaagttgttcacatcattcctcttatcccaggggatctgatgccttcctctggctttcttggttatccaggcatgcacgtggtgctcatgcagataatgcaataagacatcaccgtacgcaaatggatcaagtttttcaaacagagattaatataagaggaatgctaaatttaaagattggatttttttaaaatgtgcatgtctgtgtgtgaggaggacagagtgtcatctgtctgcatatgaggaagatgggggtgccatgtcagtgtatggggaggatggcagtgtcatctgcatatgaggaggttggggatgggagatgccatctgtctgcatatgacgaggacagagggttgtgagtctggtgtaattagagctgcagttacagttagttgtgagctgctcatgtggtgtgttgagattagacctctgggtccactgaaagcacagtatgtgcgctcttatccactgagccatctctccagttcctgatttggacctctaaaatattgaatgctagtctgatttttaaaaacccaatgttaaggagttgatttgtaaagagttatgtagttgcataacattcactaaacatctctgatttccagaagtatgggaaaactagagcttacttaacaccaagcagtttactccttcaaccacaatttcctttgagtttctacaggctttctgtgttctgtttctactcagccagttatccagacctactaagagaatactatcactttctactataaagtaccgtggcaactggaactgcagtgcaaagatggctcagcagttctaagcattgctgctcttgcagagaatctcagtttaagtctcagattgcaaaactcacgagtgcctgtaacttgaactccaaaagattgcccccctcttatggccttcagaggcgtctgcacacatgtgtccacgcagacactccagacatgagcatacgcacacacataagcaaaagtaaatgtaaaccatgtactcaaaagagtaaaggaaatactggttaaaatgctggtcaccccactcgctcagtccctgcttgctccagcccagagatttacttattatatgtaagtacactgtagctgtcttcagacacaccagaagagggcatcagatctcattatggatggttgtgagccaccatgtggttgctgggatttgaactcaggacatttggaagaacagtcagtgctcttaatagctgagccatctctccagccctcggtttttaggtatttatggtctactcttcatattatccgagagtttgaaaataacaggaataccatatttgaccaagaaattatttccagaacgaggatggatgtttttaatatgagaacacttctgataatgcagttaattattctcagagtgaaagcaaatttatttcaatggacgtaatagacttttaagttcctcatctgtcctttagaaatttgatatgaacaaacttgctcttcatgctgttcttgaagtggttttcaggtctatacaatcttcccatggaagcctgacacaagtcaaaagaaaatgaatagaggaaagtaatctgggtaggcagatgacctcaagtcaaagtcccaacactcagataaaggtcaggcctggtggcaggaatctaaacccggtggaggcctcacgcaggtggattcaggcactggccaaccaggcttgcagaggcagtggtctccaggttcagtgaaagacggcctcccaaaataagctggagggggattgaggagggaacatgatgtcactctgacctccatacatagccatgaacaagcatgtgcatcttcacagcacacaaagagcttgaactaatacatgtatgtacttctcatccttgctatgactttctgcactgaatctattctgaacatttttatataagattttcctcaaagacatatgataggaaagaatggcgttctgccttactaccatttactcagattgaacattctcgctgtacacatgtcaggttgtatcctcagggactccttagggtagtttcagttgctctgcaatgagttatatgaagcctgaagttttatattgtgagggctggagagatggctcagtggttaagatcactgaccgcttttccagaggtccctgagttcaattcccagcagcaacatggtggttcacaaccatctgtaataggatttgatgccctcttcctggtgtgtctgatgacagctacagtgtactcatacatacaataaataactttttaaaaggaaaagaaaattttataatgtgaattagctttctaaaacagtgatctgtgagagaaaccatctgtaacatgctgacagaaaaccattggagaagagtacagaaattatgtgtgtaaagcagcctggccttttacatattatgcatgtgttaaacttttctctttttttgtttaagttgcagaaaaccagacaaacaaaacagtagattcttctattaataagaaagcagccgatagcacatcacaggtaagatgtttccctttgccacagcgccatggtatggttttccttccatcattaattacagggcttattgttcttttttgagacatgatcttttgtagcctaggctagtctcaaactcactgaacaagagtcttctgttcgttttccttctttccggagggaaggctttgttgaaggtgggattttggttgcgagggtcaatcggcagcatgtgcatggcctgctgagtgtagcagtgactctttgctgctctacagagtgtcactgtggtctccaccttagtattctttctgcttgacgtccgtggtacttttcagaattgtagatgttttcaccaggtttttggaggaaggtttttatttcttcatgtactcaactactcaggcctcacttaacaagttgtactacatttatttgttaggagtgtagcagtgcacaagctgagattagaggacacctacacgtcaggtctctggggctggagctcaggctttgactcaaagtagcagagcctttgtctgctgagccactcactgcactgtccaccgttcctcagccaggtgtttgttgaactccacttgatatccagctctccttttcctcctctccctcctccccctcctcctcctccctttcctcctcctcctcctcttttgtttcattctccattccttgggtggaaaaattcttttggtcaaacatcattttcactgagatcatctgcatcctataactgccttgtgcccagccaaatgacttttaacataacattggataattattcttttaagaatcttgcacatgtatacagtgtattttgatcacatacccttcctcttcctctaaatgctcccaaacacatctcttcccaacttcaccccgctcttactatccagaatcgttactgtgcccatgtgggcacaggcgtggggtgtaccagtgatccaaccctcctgcagcagccatcagctgttactaatgccttagctacagtaggcctcataaaccctttctttacccctgctggaatctaactggcttgatctcatgtcgttgtggtgcagatagtcccggctgatagtccaagttcatgactacagcttctgtgtcatgtcacaggctccgccccatcccttggctcttactttgtttccagctcctcttccaccatgtactcagtgccttggatgataatggtgggaggacgggttgcttacagattgtcccactcctggctgagcttgcacaggtctctctcagtccctgacaacttttgtactgatagctgctcattacggagagaagcttccctgactaaggcaagagcagtacagatctatggctggaaacataaatatttagaagacagtttgacaacatgatagtttagcaaacaacaataattctattattgttctaataattctaataatcctccaaccccagccatgggctttggcaaggtgtacaataccagacacattcccttctgtggagcagacctgcaatccaattggaaaggagttgtttataccctggcactaatgtcaccatgacatgctactattgtaccactgggaatgtcacgtgactcagctggcagatcagaactgttgcgtgcagggaacagtactggctgggtaagaccattgatagctttcctctcccagtggcctgcatagtgcctgcctgcctgccatagtgcggaagtctccagtcagctgcagaatgatttctccatgtccgagactttatttaataacccatgtgtcctggaagcagcactgtccacccatgcctgcctctgcttcctgactgctgggactaaaggtgtactgacttcttttttttcttttttctttttttgtccaaagttaaattccactttactatatagttttttctttccatgttaagtaatatctgcgatctgttgtttcaaaatttagtagcattttgaaaactggaccttgtaaataatatagtaagtaaataactttgcattccttgaggactagaaacttaattttgaattaaaccaatttgtgtttgtaaatctgtaattttctatgaaattattgtagaagagttttacaagatttagaatcattatctggattttctaaggtctgggaattcttttcttaattatttattattatcattattgctattacactaatctatttgtgtgtaagtgccacagaaccctgtggtgctcagaggacagttctgcattgggtgggtcctggatcagtctcagccagtctagctctgtagcgagtcctcttccctgtggagccatattcctggtgcaacctctttctgtagtttcacaagatgacttgacctttacagatgaggttgctaattatttagatccaatctcagaatggtatgtcaaaacagattataattatcatttattaagcattatcatattccacatgttctattaggcatttcgtatatacatttatgtacacattttgtatatctttgtaatgtcttacctgtgtgcactatagagattgattcacgtaacttatgagttggaatcctgctgcagatgctggctctccagccagtgctgttccttcagccttctgctactcctggttttgtttttgtcttaattctaattgtcttactaatgattttggacagtgtactgagtttggtcaaattggacatcacctaatgacataaaaatgccacctcactaactgtaactgatcatctataactgatcgtttaagaataaggttgccaggattttcatcgtcagagagtggatgtttgtatttaatcccatagcacttaagagaatctaggcactttggttgttctgtgtaacagacagctttatttctaaaactaatacaatttctgtggaaaatatttgaaaattatgtttcttgtactaatgacagtcactatagtttgtctattttctctgggcacttgcacatatgtgtgctcacatgccacagcatgcacatgcaggtcagaggacaacctgtgggagagtccgtcctggctgggcttgcagcaagtgccttttactcatgagtaaactccagtgtgctcagcggtgtggtgctcagcggtgtgctcagtggtgtgctgaggtggtggcctgccacactgttgagataaagggatttggggcttagcttgaatgaggccattctctcctttgcccttactgttaccacatatttccttagtagcttcagctccattgcagaatcaaacaagttttatttttcagagtggaaaagcttctagcagtgactcaagtggtgtcattgatctcacgatggacgatgaagagagcggaactacacaaggtacccgaacaatgattctttactcatgcttcatgaatgttcccttcctaggatttgatgaaactttctagtggtgacgttgatgtatctacacctcccccctttttattaatcattttatttatttatatttcaaatgttatcttccttcctggtctcccctccatgaacccctcaccccaagttcctcccctttgcctctaagagggtgctccccccacccactcctgcctcattcccgtagcagtccccttctctagggcatcgaaactccataggaccaagtgcctcccctcccactgattaagcagtcctctgctacatatgtgtcaggagccatgaactggcccatgtatactctttggttgatggtttagtccctgggagctctgaggggtccggttaatactgttctttctatgggatggcagtccttcagcccttcaccaactcttccatggggttcttgggctcagtccagtggttgccaagggtgactatctgcatctgtcttggtcaggtgctggcagagcctctcagaggacagccataccaggctcctgtctgcaagcacatcttggcaccaacaatagtgttggggtttggtatctgtatatgaaatggattgcatggtagggctgtctctggatggcctttccttcagcctctgctccatttttgttgctgcatttcctttagactgggacaattctgggttaatttttagatgggtgggtagccctatccctccattggggccatgtctatctactagacgtggtctcttcaggttctctttccctgctgttgnnnnnnnnnnnnnnnnnnnnnnnnnnnnnnnnnnnnnnnnnnnnnnnnnnnnnnnnnnnnnnnnnnnnnntgctacttatttctattcgttcttctggttctctggccatctctctgtatcctttttagaatgagagtctttgacattagaattaaaagcagcagtcagctcctgagtgagtgtgagcgggctgtagagggaggcagcagtgagaacacatcaccgatggcacaggcaaaggagctctttcaaatgaaacctcgtcctcattctagacgtgaagcaagttagcagacttaggaagcatcagaatcaataagagacccaggaatcaagacgacaagtttggtggttgcttgctcccttaatctcccccttctttcttttcctctccttctccagtccctttcactccccttctagtgtctgtccatttaatttttatcctttgaattgctatataaataaaaatcaaaattttataatcattcttatcaagagtccctaataattttcttagttgcagtattcagaaactaacttggatagatactaaggcatattctgcagtgtttcatgaataaagttcctgggtcaaatctaattgcaaaagtgctaaatttagaaaaatcaatgttttttttttttaatgtacactaatttggcctttactgtgataatttgtagtgtaaatgcccagctatgattcacagtatgatatttctcagatttctttggctatcaaaatgtctttgctcacagacatgggaaagcatgatgatgataatgtgtttatctaatgctaattgtttttatcttgaagtaagtgaacttacaaagtcatgttttagggtataagacagttgatttgggagaaataaaatgagtaacgatagctaattctaagcagtgtacagaagaaccgtataagctgaggtacagtcgagacatttatgctgtccttcatcgcggctgacctcttgatggtgtgatgactgccatgactgctatagtggtgattttaagagttttaaatcatcattttactttcagttttgtttattctgcttttgtagattggttttgctctcaggaattcttagagaacaaaaattaatactgaagcaagattctgtgagggtagagctggccatgcgtgtcccaggcattccacctgccactgtgctagcctcttcaggatgctttcattgacccacgtttgagtcatattaattttcccattctaaagaatattgtgctcctattgcaacaaactaaaggacccagagctattcaataggacacaaatggacaagggtccactcctagagaaagtagttggcttatcttcttcagagtgctccatgtcagggtttttttttttttaatggtaaagaggcctgttttgacatttgaagcctttttactttaagaaacagataatgatgattagcaagcacttatataaaaatctaagccgggcatggtggcgcacacctttaatcccagcactcaggaggcagaggcaggtggatttctgagttcgaggccagcctggtctacaaagtgagttccaggacagccagggctatacagagaaaccctgtctcgaaaaaccaaaaaaaagagaaaaaaaaatctaagcaactctttgtaattgagatttaaaacctttactctatgatttgcctagaagaatgtctctggggggctggagagatagctcagtggttaagagtgctgactcctcttccggaggtcccgagttcaaatcccatcacccacatgaaggctcttaaccatccttaatgagatctgacgctcttctggtgcatctgaaaacagctacagtgtacttacatataataataaataaatgtttaattaaaaaaaagaaatcttgccttgtataatttagggaaaaaaagaatgtctttggtacattgataaatatatatacgtgcatttttacaatgaagttaatattgtatattgagtccaaagattgttgattgaagaccatgactgtatttctataagagtgtgaactggaatctgttaagatccactattctttaaatagctcctgactgagttttcaaatcagcaagaatacacataatgagaacagaaaaacatggtttctgaagaggacaatgtgatgtgcaggtagcaagcagatgagtaaatgtcagggaagtcaggcctgggtcacctgtgtcttcttgccatcactcatgtgtctcatcttttaattaacagaccccaagaagataagtcctccttcttcgtcaactgtgagcacttctcagcccatgtctcgaccgttgcagcccattctgccagcaccacctcttcagccatcaggcgtgcccacaagtggaccatctcaggcaactatccatgttctgcctacaggtaaataaatctcctgagtcaccacgcaggaacttcagtaacccatttgtagaacgtctgggtcattgtcattagctactctgaagaacagaagtaatttagcgctccagaaaggctggttataataactgttctgaatagaaacaagacattccaggactggtcaaattttgttttttaagttggagattgaacctagggccttaagcatgctagataagcaatctattcctaaggcagggtctgaggatcaagctggttttaaccaacctaccataatatcagtgttctagggttttattgctgtgatcaggcaccatgaccaaggccactcttacaaaggcaaacatttaattggggctggcttctacacttgctccaaaggcagccaggagactaccgtactaggcatagcttgagcttatataggacacctaaaagcctgtctccacagtagcacacttccttcaacaaggccacacctactccaacgtggccatacctcccactagtgatacaccctatggacgagacattcaaacatgaatctgtgggggccaaacctggtcaaatcagcacagtcaggaagcctgtgctcatagttcccctgtttcatttcaaacacagtaggattgggtagtgtcactccatagcctgtgtcacctgaatggtaagattgggtcgtgtcactccatagcctgtgtcacctgaatggtaagattgggtcgtgtcactccatagcctgtgtcacctgaacggtaagattgggtagtgtcactccatagcctgtgtcacctgaacggtcagattgggtcgtgtcactccatagcctgtgtcacctgaacggtcagattgggtcgtgtcactccatagcctgtgtcacctgaacggtcagattgggtcgtgtcactccatagcctgtgtcacctgaactcttcagaagatctggtttcttgcaggtcaggttattatctatcgcttacagaagcacaccctcctgagtgagctaaatgacatttcacccatgagagttacattgccagaagaatttgtggctagattattttctaatggctcaccaagtcatttgttaatctttaagatcgatcttggtgcagtaagttcgtgcagtttagtgtagtgcctgggtggattgtttgcctttcagatatgcacgtcctgttgcttaaactactgtttatcctgttgccggctctagccaacaccatgtgctatgcaactgtgttctgcatagaagttttattttggtctttatattcgaatgccatttttctgtctaaatagctacattgcatttaatgcttagcagttgtgtgtctctaccttatccaaagttaaagtgacaggtaggtaatttatagtttaaaaggaagtgtcattatgcaaagagatacattggtagttgtcatcagatgctgaagaattcttgcttcccattctgagtacgaaaattagtaagtaagttataaactatagttgaatgtccacttaaaagctttggacttataaatttttgggactgcctcactaaagatccttcttggaagctgtgttttaaatgtacttggcatcaaatgtcaactcaatgtaaagtaggaagcgctgacaggtaggtaggagatggcctcttttgccagtgatttcatctaccacatcagtgaaccaaaggagtcatctttgagaacactagcgaaaggcaggagttgctaaaatgttgaagcatcagcaccgcatctttatcaggccagactgtgtctgcattgcaaagccttaaagattcttcatcttatttcctttatggttccttttatgaggtcacaactgggaggttatgcttgtgccagttcagccatttatgtgaagaacttgaaacagtttccattatccacatcagtcacccagcaggcctttagcagatgcctcctacagtcaggctgtgctgtgcacactgctgcagtgacctcaggactgtagggatgagcaccagagtggcttttgctgtggttcaagttcaagggaaggaggccacagaaagaatcaaagttactgatgaccaaggagcatgcttgttaagttttgccatggtgccacttttgagttttgtgtgtgcatggtggatctgaatcagagtaagccatcatcagtcaatgccaagttcacctctctgctcagctattaccatggtaacaacatagagaattcaataaagaagggacgagtgaactgactttgccatttttagtttcttgatacacattattattttcttctacttttatttgttttgctttattttgggttgtgagcttatcctttgacagcagagccatctcttcatcttcaactctttgactttctctgtaagcgagggtctcattctagcccagaatgttcctaaactcatttgtagtcacggtggcttcaaactcactattaggattgcatatgtgagccttactaatagtgagttattgccttactagaattctgcatttgccaacttgaagtagaacacagcactgccgttaggttagacatgacccacattccaagtactgagtagcaccgaggagagcaaatgtaagcgaatgagtccattcttggtgctggggtggggagtgttgtgcaaacaaggatcaaggtaaagccacctgctgccaggcctgacagctcgacttcagtccttagtgccaccagagtggaagaagagaaccatctcaccctgattgttgcctgatcatcacgcatgcacacaaaaaataaataaaatgtaaaaacaaattaaaagttttatgtcaagattataaaatgtggctcccaataaggctttgctgtggacactggtgccctgagaaaggaatgcacatggagggggagagtaatttcataccatgttccccccaaaaccatcttccaacttcatcatgtacaatgttaacatctgctggggcgccatgtacagtgcctgggtgttagaactgtgcgtttagtaaccactctcaaggttgtgcgtcagagacctacttcaaggttctcagctattacgtgcttctacgtctgcagcacccaggaaggtttctggaaaatgcttgtgtgctttgagttcagtgaacagagaccacaaccaccaaaggtgacagttaagtcaggggagaccctggggaggctcctgcacgagggaaaagatgacctcatcagccagccacacacacacacacacacacacacacacacacacagccagggtcataaactccttggctgttctttgagctatgctgctttgtttctcttcagtctgctgagatgatgagtctggttggtgttagatgagagacttcagcaggaacttgtcccttatttgtaagcagtggcctgatctccctctttccttgccatagttaactcaggtagacagacacctggagcagggaaaatgcacatgaccttcagaactggagggagggctggagatgtgtgatccacatgtggttctgacagcccttttctcctgtgcttagactgtgtgtaatggtaattgctgcttcatgatatcgtcttacatagaattggctacattcttggtatcttttgtttgcttcctttagctccaaccaccgtgaatgtaacgcatcgtccagtaactcaggtgaccacaagactccctgtaccgagagctcctgcaaaccaccaagtggtttatacaactctcccagcgccaaccactcaggctcccctacgaggaactgttatgcaggctcctgccgttcgccaggtcaatcctcaaaatagtaagaggctcttttcttatatatggctttgaggggtatgtattgctctatatgacgtaagattatcatactaagggacatatggaacagcacacttgcatggaataattagcaacaatgtagtacattggaaattactgataccatagatcactggctagcctggaactcacagagatccacatgcctctgtctcccaagtgctacgattaaagggttacagcactacatctagcctttcttatgttctaaagaaagatatttaacatgtatactataaaatttgtagcctttatatcatctttagtttaactttgttattatagtagcccataatattactgttttatagattcctgtatatccctggctgcataggagtttgcgctatggaccaggctggcctcaacttcgcagacagctgcttgcccctgcctcctctctgctgaggtttaaaagtgtgcacttaatgatgactacctagtcaactgaagttagaatgatgagttgtggcttagcccagaaaagggaagttattgtaagggttacctcaaatattacagggaaatcagttgatttagatagtaattatgcccagtctgtataaaactagcatgtgtgtattaatatcatagagtacatggcttaatcacagagtatagcatagaaaaacaaggtatataaaatgtaaagaagtataataaaagtgaaacacaagtgacctttgccacgttagaaagtacaattttattactcttctgtctgtctgtccctctgccatcctctcttaattgacatcagtgtaggagtcacttacatatgctcatctcacaggcatataaacatagaatgctaaatgtatagtaatgtaaacaaagctaatgtatagctgtgaatatctatttataaaataacaaatatagctgtctaacaaaactataattccattattaattcttctaagggaaattaaaccaaatggcatctttggatcatagtctggtttaagtttctcaagtttgtaaggattttctctaggctgttgtgtgattgggtcatgaatgagttctagagcagtcctggcacttagtgtgggtcgcatacggaatgtctgaccagtgtgattgggacagtggatggcacggctctaaagtctgtactcggttgaactttgtgatgtcactgcagtcttcctgggcatggagtgtccttagctgcttagcagtataaagagaaaaagtgggagccccactaacataggactggtggctttaaaaaaaaagatttattaatgtgtgtgtgtgtgtgtgtgtgtgtgtgtgtgtgtgtgtgtgtgtgtgtctgtgtctgtgtctgtgtgtgtgtgtgtctgtgactgcacaggcccgaaaaggatgtcccgctccgctccatggagcaggaattgcaggcagttgtgagctggctgatgtgggtgcagggaaccaagctcagggccttatgcaagggcagtatgcgctcctcactgctgagctttgccccaaggacagactgctttggtaggagcgtctgtctgcagatccttggagccattggctccatccggtttagctgctgtccaccttggagggcagggccgttggtgtggggttttatttctagtcgtcctcaggatgatctctgtctgtgctgtccttgggtgtcattgtcatgtcttcctgcttcttggttccttcccgttgctgcatgcagcctgcagtgccactgcagtagtgtctgtgagaggtttgggtttttgagttctttatctgatgtagacttttcagttggaattgctcatcttgaaatttttttaaattttttttttactgtttataatggccgaacacaaatttatagtagaattttcatgtttccctcaattttcttttgcaggtgttacagttcgagtgcctcagacaaccacatatgttgtaaacaatggactgactctaggctcagcagggcctcagctcacggtgcatcacaggcccccacaagtgcacaatgtaagtatcagtgcttgccttctggacctcctcagtcactaagctgctagagcattccagctgtcttcctttccttccctcctccctctctccacccctccttttctttcaacagggtttctctctgtagccttggctatcttggaactcactctttagaccaggctgacattgaccctggaaatcatagagacccacctgcctctgcctcccaagtgctgggatgaaaggccttagtcaccattgcctggctaccacttccttttttaaagtaatgttatcaaaggaaggagagagctcttcttccctctagtagagggtcattgtagacaactcgatcttatcttggggaaacagtaccggatcgaggactgatgctcactctgacagacagggtgatggcccaggcttctgaggtgacagacagtgccccaaactcaggtgtaaatccctcgagttatgactttgtatttcttaaaatctaactgctgtgttgtcattagtttatcttaaatgatgcactggcatttggaatggattttgttacaaaagaacagaaaataaagtatttccctctaaatttagccttaaacaaagtcatactgtcctgtgagaggattataactggttttaggagtactttagcacataggtgaaaatacataggatgtataagaacaagtgccgctctcagagaggtgagctaggagggccgagagttctccgtggctgttcattgtgtctctagaatgctgatatccttgtcctcacagggtactcttaaggctgttgctgaaggactttataggctttcctgcctgtttggaagctgacattcagaggttgagtagccaacccaaggctgtgtgtgctgtctgcgagcccacactccccagtgcttatagctatgtattcactaaggtatcttctgaaattgttctgtaattgctagaaaccaatccatctcttcttccgttaggagcccccacgccctctgcatccagcgcccttaccagaagccccacagccccagcgtctgcccccggaagctgccagcacttctctgcctcagaaaccacacttgaagttagcacgagttcagagtcagaatggcattgttctgtcgtggagcgtcctggaagtggaccgaagctgtgctactgttgacagctaccatctctatgcttaccacgaggagcccagtgccaccgtgccctcacagtggaagaagatcggggaagtcaaggccctgcccttgcccatggcttgcactctcacgcagtttgtgtctggcagcaagtactactttgcagtgcgcgccaaggacatttatggccgctttgggcctttctgtgacccacagtccacggacgtgatctcttcctcccagaacagttagaccttggagtcgtttagcttctacttttgaaagtttcacatcttgggcttgtttttaatcttgtgcatgaaatccattgtaaaaatccaccttgtgcaagatctcccggacaggtgactgtatacactacgtttgtttataaccggaagcaaaataaattcagcccataaagcaagccttccctgaacaattcaaacttcggggttttgaaatgtatatttattccttgctttttggttttgagttttgaaactggggaatatgtatgggtgtttgtgtgttttcttcttttgttttgaatttttaaatttctagttgtgtgtgtatcacagtgcgatctcctgttttcctctcaaatttacctctcttccagaaggaagtatattgctgagcgaatctgaggtgcagagcaggtgtgattctgcctccagaggaggctagaaggtcaaagaatctaaataaaacccgaaggaaggaaggaaggaaggaaggaaggaaagaaggaaggaaggaaggaagggaaagaaaagtatttagcttaaagtagatgaattggagcagaggagatattccctctgtgtattctttgatttcttctgagttgctgacgaggtgaacagtggcctcaccccgagttcctaatctggcttctccttttgtgtttgtgccttaacagaatccacagaccacgtccattgtggtaaattcctctttcagcttctattgggtcttcattgccaccaaaaaccccacaccctttaagcattttagaagcaaactgtgaacatgtgttctcttcctccgtgacatctctcagtaagttgtgacttactgttatgttttaagaacatatttttatttttgcccatcttttaactctgcataaaataggccatattgtttaagaacaattttctttaagcctgtttaatagccatgttacattgctaaagaatcggaagggagtcctggttcatctcagcactcatgggatagagtcctttcaaaggcagtgcacgtcagactccatgaaagaccggggtgaagcacagtctcctcagattctcaggaggtcgttcctgctttagtctgaacggtttcggtggtgccaagtggactctgatttcatcagctctgggtagagcctaaacgctatcctctgggtcattccacactgcaggtagatctgcttgctttactagttcttattccttcaaaatgttagcagactcaggctcagccttgcatttccaaggcatggcagctgcagggaatcgaatcaggcaggtgttttcgagacctgagcagaaggccaagtgtttagggatgagtgaggcctctggagtctgaaggcactggtgagctgtcttcccttacggtattttacgtccttgcaaagtctacctttgcaagctgcaccagccgttttgttcacttgtcctggtattaaaagcaggagctccgttccctgtgtgcatttgcctctatgatggcttggcttacagaaggaatcgttgagttataaagaaattgtctttgctgacttcacggggtggtgttctgtcatcttcggcgtgaactttggttaatgaaggaagcctgcagctggcaggtgtaattgctcctgtcactctgagaaagaggagagcacgcgagacccacttcccacaagttgagcttggggagcagtcatgcagctaggacctcacgggcatgggaaacggttgcccaggtcactgcaaagggtttggaaaggaagaaatgattttttaactgtacatgagcacctctgtaccaggagtgtttctgtcatgtgggtacagtgttggtcttctgttcagcatcgttcctgtctctagtagaaagtgcatattcaaaatggtcttcaccagtgggtctgctcactcgctactgaaagtctctctagatgaatatgtttgtttatagtcagtaattattttatatttactagttcttttttaaaaagttttcctagtgttaatataatcatgtgaagaaagcccaatggaattcatattattttattgttttggcttttacttgggtgtttttttgtcaaaggaaaaaaaaaaaaaatcccaaatagtggctctagatgtagatttactgtagaaagtaattacggaaacctgtttattcccagattggaaagaaggtatagacagaaacgagttgggaagaggaaatgcacttgtggatcggctcctcagctcaccgagcaggacgcgtgcctcgggcagcagtggtgctggcttcccggagtgtgcgccgcttacacgaggcagaatgtgggtgctgaggggccttggctttttctttggctgtctgtggggagagtgggggacagtttccaccctgggatctcttctcaaagtgttataaagaagctccattgtcccattttgggggattcaagtttgctacattttttagcctgacaatactggtaagtgttgtcttagtgggagtcctggaaacttctggaatctgtagatgaagcgacagatgcttcttgagtaactagcagtgacagctgtctgtcactccctcatttgcactttgtctgagtacttttcaccctgttttaagtgtgagtaagcctctttatgttctggcgaatggcatacagaagcagcttgttgtagcagttcactttacacggtggctctgtccctggctccaggctccagtccatccttgtacatctgcagagtgctttctgtactgtgtgatgcagtatgactttatgaaaggaacagagctttcttccttggaaatacctgttgggatagcatttgcctcacagagcagtgttcttcccccccccccccccccacctatgccagataaaggatacttttgcaagcgtgaggcatctcttcagagctctcttccagtgttggacaggtgttctgggggcttgctccaatcgctttaaatatcctcccagttgccacttagtgtgacatggcagggatgcccatttcttccctggtgtctcccagtactgtctgatttagaatgctctgtgtggcatcctctcttgacaggctgtgatttcaccccgtaggtaccacaaagaaagcctttcaagtgttctcctgactccgtaggccatttccgtatcctcaatatggtcaaattttcccacttcccagtgattgggtggcctggttggctctcatggaactacacatgtccttgtgctataggcaataactgtgtaatcatgtgtgagtctgtcttccttaatcattttcagggcaaatggctttaaaaaaatatttaagggacacataaagattagagcaattatgaggggtttgttggagcaggagactaatttgtaaaactcatcgccttgagtcagcagagagggaggaggtgaagtcactgctcccatctgccaatgactctgtcatgtttgagcttttgttttgtgttttctatgttagccttactctgaatacctacctatcatttaaatatttaaatgtattttctctcccttcttctttttgtaaataagggaacaaagcaatcaaacaccttctgggggatcctagcttgaggattttatcaaccatttcaaatgtaaatgtaaaaatcagtccctgtaggaaactcgcatccaaatttctgtttgttgcagttgaaaatgtaaataagatgctgtaagaccctccttaaggtctaatgctaactgggcagtagcaggttggttgccctatttttattaggttttgaaggttttcattttctttctttcctaaaagtacagtagaatggtgtccgtgtgtaagtgtcgactgtagtggggtttgtccagcaagcctgaactttatactttgaaataaatgactgagtttttaacattctgagtaccctgactcattccaagagttctcagtccttgtgtttctttaaaaactcccacttccatcacaaaaaccccttgctccctgttcagtgccttgttcagcagttccctccctggtactccacccagatgttgtgccctggctttgggaaagtaggagttacacagaactgctacttggttagatatggtgttttcaactagtgagagagaacagcatgtctaacctgctgcccattaacaaccaggaaggatccttcccctgttagcagcaggggaaggagaaagaccttgggaaatgcaggtgtctctaacaggccttcgtcctgcctccagctccacttgaacttggttctagcttgaactgtgattgatgtttgcaggcctaaaaggagaacagtgaactgagacagggtttctgtatccttctgtgtatttgtttcatacatgtttattctgtagctttctacccttcaggaaatgtttgctgttaaacaactctatggaaaatggatgtgtgtagggcgatggaccatgccaggaaacttggtaaggttgcgtgggttctgagacccaggtacccatctgcggactgtaggcatttccctgctccctgccatattcctggcctggaacacatgaccacgctccccacagtggtcttgtagatcagaacagagttctccatgctaatgaaatagctggatgggccctgggcgtttagccaattagcttcccttctcagacattccttcctgcaaaaggtacctaatctctggtccatcctgaggaagtggtgttttccatgatgaacagtcaataaacaatttgaaaccaaggactgactcatcaagaactcccatgggcagcaaggagacaggcttcatctacagagcctcgctgtccaagtctctggcagaaggccccttcagctccctgactcactgctgctaggctagagttcccccattcattccccagcgcccatgggcccccaactccccgtgactgctagtggcatctggatgtccagtttaggagcccctggcccagggctcctcaggagtcagggagctgcagccccagcctatgtcgtgtctcacttgggctgaggccccatccaaggctgtgttcttccacctcgagtggtgaatcggcacttggcatttcgcccgaccaagcggcattcccagcaaggctaaacgcaggaccacagatgggaatttaatattttttattaagagtacagatgggaaaatacagctaagagtgcctttggtgtcctattcgcagctttctgtcatctctatgtctcactttttgtcctatgacaaaattggtttcatggtaacaaaattaaagtcaaagacttctggcatcccccgatggagcgtttcattgaaccgattccagttaaaaggcgggagtccatcttgtaccgtgggaccactaatggcataggctttatactgagatgcaagaaagatgtctgccacctggaaaaagagaggaaaacatttgagaagaccatctaaaatttgactgtgtaatcttcattcgcccttctcaaggtggagtgtggtttgtttattttatttaacgagtatttgtctatgagagtatatatgtgtaccaagcctgcagtaccagtagaagcctgaagagggtagtagatatcccagaattggagttcagatggttgttagccagcgtatgaatgctgagaatctaccaaaaatctgtagagccaggtgtagttatatacaaagctgcttcctgaatttaatatgtggttggacaaactggcctttatgctacaaaaacatcttgcctctggcctaactccttgttaggagtaaattggaaagcatcagagtgtctattaccttggtgtcatagcatcctccagggcttggactggctccattcaggtcctcacgacagcagatggtactgcagggatcccccttgctgtaggggtcctctttataatctaggagacacagtggtgaggaagaagagatatgggctactctgagatatacttagcaagattttgtatctatccatgcctgggtcattaaagagcatatcccactggcctccccagcccagcctgcttctagatacagagatcgctcgaggattgcactaggaagtacaaatccccagtcctggggcagccccgaagaaccataccccaaagaggaaagggggaggggatggagaaggagaaagagagagagggagaaggtaactcaccactttccacagatgaagtacaaactaggcttggaaagtcttcaccaaaagaaagcacttaatgagtattcttagctgcctttgtacttgggaggtgtgctagcaggaggctgggcgatgctaaggagatagccctatgtggattatttctgtattttacatgtttgtttgtgttcttgtttttttctttttagggggagtgggatgtgaccggtcaggcaaaaataaaatctgtagagccaggtgtggttccaacactcaggaggcagagctgggttggtgaagaattcagtttttgtgtctttgtctgtgctaacaagggtgtgtgcacataagcataccatggtgtgcttgtggaggtcagaagaaaagctgtgcaagtcagttctctccttccactgtgtgggtctagagggtcaaactcaggtcagtaggcttgacaacaagtgccctcatctgctgagccaccctaccagcctttcagaaatctctctgaggctttataaaggaagcaacggctctatttgttgagccatatgtgtacagcattaatagtatccgatattgacttcggtaatttcttataattccctctcgtacagagatggcgaacttacacaattcttatttcacaggaaagagaaggggttttgcagaatgactcgagaaatgtgctacatactgttgtatcgcatgatatatttcatggaggccatgtccgtcacgttcccttggtcacgcctgaagattttggcacgtggagctaagtcataagagtagtccaagcccagcttgtgaaccagcagagggtagccactccagttgtagattgttttgtggaaagggatattataggaagcccagtatcctgatgtggaatggaagagaaaggtagggttggacagagggagatgggaagagagggggaacaaaagaagaaagttatttagtgctgctatatttgaaaattaccacatgtgtaattacttaggaaatgaacctgcgggtcacagtggtccttctaaagcctttggttttcactgcaacttgttagtataatcttaaaacccagagagtggctttgctctctagggaccaaaaaaaaaaagcaaaggatgatacagtgttctgggagctgcctgaggtccatcatctgctgagtaggatgccccgcagaggaccacagatgctcatcacactgggagccgcctgaggtccatctgctgagtagcatgtcctgcagaggaccacagatgctcatcacactgatggaagacaccgcactggcatcaggaaacccaagctctagctgggtttatggatgaataattaggtcctaggcgcttagccccatttcatgtgtacaagggaaggggtgaccataatgagtgggcatggggtgcaggtggtctcttgtgtactgaacacatttcccaggacccatgtcatccaaaactgtacctcaagccactaagcacggacatgtaaaacaattctaggaacatcttggattacaccagactattgcctatagaatcctcagttaaaataagggagactctagctactatgggaggtttctcaacaaactgcagggatgtgctcgagctatacagcgcctgggaattcacatcttaaatcaacataccacactgacccctgggcatctgtttatagtagctatagtactgtttatagtagctaaccaatagaactagtccactgttcaacaacaaacaagaaaatgtgacatttatactcggtagactttattcggtcacaaaaacatttcatctgcagggaagggtgcatctgaagatgatcacgtgaagggaaatgagccactcagaaagactgcgttcctgtcggtgtgctttctatacaagatgcaaaagtagaattgagggaggggctagcaggaagagggtggacggatggaaccagggaggagtatggcagatggatgaggtcaaagggcatgagggacttgaatgagaacgtcttgatgaagcctgtcacttatagtgaattgattccaatgtgaagaattatgagttgctccacttgcttgcattttcaccaaggcttagtggccaagtaagcaagtttctgcactttgcagctgttggtatagcaatgaagtgtgcatatggtatgttaatacgtcctcatggggaacccctcatatgtgtataagatattgatgctatcgtgtgtgtgtgatctagttaagaagttccctcaccccatattctcaagccttgctcgctgactggtgatgccaccaagaggtcatgggtcccagctatactgattaagtgggttatcagaaatgggcctagatggaggaagtactccaccttcgaaggtcgtaccctgacctgggttatccctgtgcctcttcctcaccactgtgatgaggatggttttcctctaccatatgtgtcggacaggatgctctacctcaccaatggttcagaaaacacaggctgggaaagtgactctcagtaaattctacctcttttaatcatcatcactagatttgtcattgggggggggggtgaatagcgtgtaagtaatgtctttaggaggggacacaggctgtaagaatatagttcaagcccattttgtcagatttgggggcagctctttttcctaccaaattagttcagttcgaatcatatttttctaacaaataacttagtaccaaaacaataacttctggcattagagttctaggattttaatagtaaataggtgattggtgggtctgcatctggattgcatttgaagagagtaaggttttgagagtttgagtcatttacctgagactatgagaagccaagattctatccccgagcttcacctgcctgggatatacccttggtggccacagccagcatctctgatccctcccactaatggaatcctctttaggttctaccaggcctggtacctcagactttattccagctcttcccattctgggctatatgatgctccagtttctagagagaagcaatttggcatctttgctttcccagcctgagtcagagtaacaccccacagatgtgctcagtggaacttacaatttagccctcagaattccagaaagaaggcgactttagagctgttagaggtcagaggtcacaaggcttgacgacatcccaacctcccatgagagaatgaagtgcccactcacttcattgcatgatgactctttaccaggatgcccgtcactgccagccctgccagccactcgcacacagcacatcccgcatcagacgcactggtcttaattttcaacctgataggacctaggatcacctggcagaaaatctccaggagggattgtttagatcaagttggcctgcgtgtgtgtgcatgtctggaggacaattgtcttagctgatctgggaggacacctggaagtggtgtcatagtagctcaccctggatctgggccctggactacaagaagagccaagaaagctggctgagtggtaaacgtgtgtgcatgccctttctctccgctctagatttcagacgtggtatggttagctgcttcagcttcctgcctcgacccgaccaccgtggtgagctgtagcatggcattgtgagttttccatcaatactttactttttcccctaccacagggtatcacaacagcatagatgaaagcagcacacatgtattggtacacagtcctgacagagtaggaagagaaggtaccttttcttaggacattggtttgatcggagtattctacatatgtagggatttgctccacaatatagagagtgcctttgtccaggctcctattgatggtcaccttcttcaggtccaggcaccatgtactggttgttgtaggtacctgaaatgttggaagacacaaggcgacagggatatgcctcaactggttaagtgattaataacgtcaactgattaacaactgtaaggctagacataggcacataggccttaggactgctgtacagaaccacttaccaga

SEQ ID NO: 362 - DNA, 4210 bp, Mus musculus
cggcgagtggagcgcacggctgagacggcagcgtccgggacggctgcacgggacggctgcgtaggaaggaactcgggtcccaggctctcacctcccgcccccgaagattcagaatggatagtgtagaagaacctcagaaaaaagtcttcaaggctcggaaaacaatgagagcgagcgatcgccagcagctcgatgctgtgcacagagtcaagggggagctgctgagagccgacgggaagctgctgaacgggagccatgagaatggagacttggatcccacttcacccttggaaaacacagattgtattcaagatcgagaagaagtgaatggtattgatgggatttgttttcagtcagaagaaagtacaacggaaatggaaagagaccccttgtatgcccaatgttgctgtaaaaaacaaacaagaagatttgaatagtgaagctttgtcccccagtataacttgtgatctttcttctagagtaaccactgaaccagcttctggtagtccagcctctgataacccaggctgtggtaccccagtctctgataacccagcctccgataacccagcctctgacaacccagcctctgacaacccagactctggtgatctggctgcaggagagctggccactacagtacaggctactggtgactctgcctgtgaggagcctccctccagtgatccctcttccagtgatcccacttccagtgagccctcttccagtgagcccacctgtagtgagcccatctctggagatcctgtttctgaagaagccgcctctcatgatcttgtctctggtgattccacttgtggcgagccagtttctggtgagccggtgtctcatgaagcagcttcgagtgagccagctacaagtgagccagcttcagatgaaccggtcgcaagggtcgtggcggcctgcgaactggctcctggggagtcagccttggatgattgtgccccctccggtgattcacagtctgatgagccaccttctagtgaggactcccttcctaggtctgtctgcagcggactggcttctggtgagctgactcctggggagctctctgtggaaccagccaccgacactgttaaaccaagctcatcggcagtttgtgaagcaggtcctgaccctgacaagacagagccgagtagcaataacagtgatgattgtccaggcaagagtgaagacgacgaacacttagaccaaattcaaagtaaagactcctgtgatgagggaaataaagtgaacagtaatgtcgtcgagaaggaagaacctctcgaaacacacagtgcaattatttgttctgatctacctccagaaaacacaacgaagatagcggaggatcccatcgctgagcctgctctcgaggaagaggccatctccagcagcatggaagttgaccaaagcgaaaaggatgagcataaaagtcctgcagaacctgtagccgctgtcagtgaggaccccgccgaggaggacaaggaggatactgtcgtagacaacacggactccatggaaacagatgagatcattccgattttggaaaaacttgcacccaccgaggatgaactcagttgcttttcaaaagcttctctccttccagtcgaaacaagtcaagatttggaggataaaatggagggctctttcggctcaccctcgaaacaagaaagtagtgagaatttgccaaaagaagcctttttagtcctttctgatgaagaggatcttttgtgtggaaaagatgagtccgaagctgtagcgcagactaagatgagcactccagagggagaaaagagtgagaagggcagcaaagctgaggaagaggagcgagttccagccgaggagcagccacctgtgagaaatgaattttctagacgaaaacgttctaagtcagaagacatggacagtgtagagtccaaacgccggcgatatatggatgaagaatacgaggctgagtttcaagtaaagatcacagccaaaggtgacatcaaccagaagcttcaaaaggtcatacagtggttgctacaagaaaaactgtgtgccctacagtgtgctgtgtttgataagacgttggcagaattaaaaacacgagtggagaagatagagtgcaacaagaggcataaagcagtgctcaccgagctgcaggccaagatagccaggttaaccaaacgttttggagcagccaaagatgatcttaagaaaagacaagaaagccctccaaacccacccatatcaccaggaaagcctgccaatgacaccaacagcaataataatatgacctacagaaatgcaggcacagtgcgacaactgctggagtccaaaagaaatgttagcgagggtccaccaccatcctttcaaactcctgtgaatacagtgtcttcagccagtcacgccacttctacagcagttgtcagtagtcagcctaaactgcagacctcagcaacctcgggctctctgccggcggcacctcttcttcctgcgcccagcacagccaccgtagttgccactactcaggtgcctagtgggacccctcagcctacaatctctctgcagcccttgccagtgatcctgcatgtgcccgttgccgtaacctctcagcctcagctcctgcaaagtcatccagggactttagtgaccaatcaaccatctggcaacgtggagttcatatctgtgcaaagccaacctacagtgagtggtcttaccaaaaatccagtatccttgccacccttgccaaaccccactaaaccaaacattccgtcagtgcccagtcctagtagtattcagaggaactcttcaaccaccgccgcaccgttgggaacaacgcttgctgtacaggccgttccaaccgcacattctattgtgcaggccacaaggacttctctacccacagtaggcccgtcaggactctatagctcttcaagcagtcgaggcccaatacagatgaaaatcccaatatccacttttagccctccatcttcagcagaacaaaatagctctgccaccccaagaattgttgcagaaaaccagacaaacaaaacagtagattcttctattaataagaaagcagccgatagcacatcacagagtggaaaagcttctagcagtgactcaagtggtgtcattgatctcacgatggacgatgaagagagcggaactacacaagaccccaagaagataagtcctccttcttcgtcaactgtgagcacttctcagcccatgtctcgaccgttgcagcccattctgccagcaccacctcttcagccatcaggcgtgcccacaagtggaccatctcaggcaactatccatgttctgcctacagctccaaccaccgtgaatgtaacgcatcgtccagtaactcaggtgaccacaagactccctgtaccgagagctcctgcaaaccaccaagtggtttatacaactctcccagcgccaaccactcaggctcccctacgaggaactgttatgcaggctcctgccgttcgccaggtcaatcctcaaaatagtgttacagttcgagtgcctcagacaaccacatatgttgtaaacaatggactgactctaggctcagcagggcctcagctcacggtgcatcacaggcccccacaagtgcacaatgagcccccacgccctctgcatccagcgcccttaccagaagccccacagccccagcgtctgcccccggaagctgccagcacttctctgcctcagaaaccacacttgaagttagcacgagttcagagtcagaatggcattgttctgtcgtggagcgtcctggaagtggaccgaagctgtgctactgttgacagctaccatctctatgcttaccacgaggagcccagtgccaccgtgccctcacagtggaagaagatcggggaagtcaaggccctgcccttgcccatggcttgcactctcacgcagtttgtgtctggcagcaagtactactttgcagtgcgcgccaaggacatttatggccgctttgggcctttctgtgacccacagtccacggacgtgatctcttcctcccagaacagttagaccttggagtcgtttagcttctacttttgaaagtttcacatcttgggcttgtttttaatcttgtgcatgaaatccattgtaaaaatccaccttgtgcaagatctcccggacaggtgactgtatacactacgtttgtttataaccggaagcaaaataaattcagcccataaagcaa

SEQ ID NO: 363 - protein, 1235 aa, Mus musculus
MVLMGFVFSQKKVQRKWKETPCMPNVAVKNKQEDLNSEALSPSITCDLSSRVTTEPASGSPASDNPGCGTPVSDNPASDNPASDNPASDNPDSGDLAAGELATTVQATGDSACEEPPSSDPSSSDPTSSEPSSSEPTCSEPISGDPVSEEAASHDLVSGDSTCGEPVSGEPVSHEAASSEPATSEPASDEPVARVVAACELAPGESALDDCAPSGDSQSDEPPSSEDSLPRSVCSGLASGELTPGELSVEPATDTVKPSSSAVCEAGPDPDKTEPSSNNSDDCPGKSEDDEHLDQIQSKDSCDEGNKVNSNVVEKEEPLETHSAIICSDLPPENTTKIAEDPIAEPALEEEAISSSMEVDQSEKDEHKSPAEPVAAVSEDPAEEDKEDTVVDNTDSMETDEIIPILEKLAPTEDELSCFSKASLLPVETSQDLEDKMEGSFGSPSKQESSENLPKEAFLVLSDEEDLLCGKDESEAVAQTKMSTPEGEKSEKGSKAEEEERVPAEEQPPVRNEFSRRKRSKSEDMDSVESKRRRYMDEEYEAEFQVKITAKGDINQKLQKVIQWLLQEKLCALQCAVFDKTLAELKTRVEKIECNKRHKAVLTELQAKIARLTKRFGAAKDDLKKRQESPPNPPISPGKPANDTNSNNNMTYRNAGTVRQLLESKRNVSEGPPPSFQTPVNTVSSASHATSTAVVSSQPKLQTSATSGSLPAAPLLPAPSTATVVATTQVPSGTPQPTISLQPLPVILHVPVAVTSQPQLLQSHPGTLVTNQPSGNVEFISVQSQPTVSGLTKNPVSLPPLPNPTKPNIPSVPSPSSIQRNSSTTAAPLGTTLAVQAVPTAHSIVQATRTSLPTVGPSGLYSSSSSRGPIQMKIPISTFSPPSSAEQNSSATPRIVAENQTNKTVDSSINKKAADSTSQSGKASSSDSSGVIDLTMDDEESGTTQDPKKISPPSSSTVSTSQPMSRPLQPILPAPPLQPSGVPTSGPSQATIHVLPTAPTTVNVTHRPVTQVTTRLPVPRAPANHQVVYTTLPAPTTQAPLRGTVMQAPAVRQVNPQNSVTVRVPQTTTYVVNNGLTLGSAGPQLTVHHRPPQVHNEPPRPLHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSSQNS

SEQ ID NO: 364 - DNA, 81748 bp, Homo sapiens
  misc_feature (1)...(81748): n = A,T,C or G
ccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccaggttagcatataacttaaatgttaaagattttttattgactttgatgaactgtttaataaaacattatcataatgttttaaatttattttagctgcagagaaagttgagaatagtgatgactctatagaaagatgtcttaacttcatagaattcagaattagtgtgtgtactctgtgagtagcattgtactaaatactaagaagggagataaaataagtagaaaatatgcccttatagtctggaaatagagatgaagtagagcaccataacactgagataacagtttaagttagtacataattgactagagttgtagcagttctttcttgctatcacttagcgaacaaataacttagaactaaaagcctaatagtttaatctatttgcttcaagtgtaacaaattatattttcaattaatattcccaatgaaatcctgttctttaatattctttgtccaggaatgacagcaccattgttgtaagccagaaaccttaaagcttgattatccatttgataaagactttacccatttgctccctcagcccttttgattctacccagcctattctcttcctcattttctgaatgagctccctgtaacccaattctcttatttgatattgtccgtctatgtcttagatctctgttacttttaggttgatttcaaactccttatgtaaaaggtacattaactttatgatttgttcagtacctatctctcccatctcttttattttatttattattcctagagaaaaagaatgagaaaaattctaccttcttttatggtcaaactgaaaaacattattcctctatgaaactttctaagcctgtggaagactgagaaaagcatgaatacctttcttttcccattatatcacattcttttagatttagacatctctgagagaagtgaccttgctagcataaaacaccatctaatttcttcaaagaaaaaaaaatggaggcaggtctaagagacagagacaacttttttccccaatatatcataccagcttttggaggtagagatttttttcttattaaaaaatggctttttttttttttttggccaggtaaggtggctcacacctataatcctaggactttgggaggctgaggcaggcagattgcttgagctcaggagttcgagaccagcctgggcaacatggtgagaccccgtctctacaaaagtacaaaaattagccaggcgtggtggcacttgtctgtagtccagggtacttgagggcctgaggtagggggatcacttgaacctgggtggtcgaggctgcagtgagccgagatcgcgccactactccagcctgggtgacaaagtaagaccctgcctcaaaaaaaaaaaaaaaaaaaaaaaaaaaggatggctttttattttcaaagagcattcaactaaacctatataaagagacaggccaggcccttcttggttctagagatttgaagatagtatttgccctcaggatacacacaagaattaaatcataggccattaaatacaagactgtgagtacagtgataatgttaaattggcattctgggagtgcagattaaggtaactttattagagcaccagatgtattagggatgtcttgccccttttaatatctgtataacagaggttttttttgtttgcttgtttttgttttgtgagacagagtcttgctctgttgcccaggctggagtacagtggcacaatcatagctcactgcagcttccactttactggcttaggtgatcctcccacctaagcccccagagtacctgggaatacagacatgtgccaccacacttggcaaaattttaatttttttgtagagacagggtcttgctatattggctctgctgtaacatagggttttaatgagtctaattctttttttttttttccgagatggagtctcgctctgttgccccggctggagtgcagtggcacgatcttggctcactgcaacctccgcctcccgggttcaagtgattctcctccccactccgcctcctgcgtagctgggattataggtgcgcgacaccacgcctggctaatttttgtatttttagtagagtcggggtttcatcatgttggtcaggctggtctcaaactcctgacctcgtgatcctcctgcctcagcctcccaaagtgctgggattacaagcgtgagccaccgcgtctggccaagtctaattccttttaatggcagctccatcctacttgctgaggccagaaactttggaaccatttttattttttctttcacaccccataattagtccatcaggaaattctgttggtactactatcataatagatctagagtccaattcacaactgttattactcctgctgcgagtcaccatcatcaggccaaaacggtgcctggcacacagtaagtgcccagtaaatatttgtaaagtgaatgaataatcaataatgtaagagaagcatatcatggaggaccttggttataatgctaaagctttatgatggcgctggaatgccaataaagaacttcaagcagagaggagaatgaaatttacattttggaaaggtaataggtgacagtgttgagaatgaatttcatccatttcctataagtgtctatacagagtgtggcactaggccaagtccataaaaaagccttataagtcctttaaaaaaaaaaagtctgtataagaaagttaaaaaagcaaattgcagcttatgatttaatgagtacctttatgtcagaatcttgatattggagggcatcccacacaaggcagttaagtgctgagagatgaatattaagccatccatgttgcatactttgaaaattcaaagttgggaatatttttggttacttgcctttaatctgatggtatgctattagcagggtaaatttagtgatagatttaatttcttggctcataactaaacttttattttgtatcttttccccttcctctgaaggtaattttgtgtattttgagtttaagaatagtttcttaattggttcttaaactgtactctgttctctttatatggcgacagaatctgttgcatgtcatttatgttgctgtactcctgttgaaatgttacttaaataaatgcctttattcttgactaatttttaatatactcagaacacagaattattagctgaagtactaaagttggcttcagtactggctcttccttctagctactaacatctatgagtgtagtaaaaggaaaatagcataaccttctgtcatttcaggcacttgttgagcaaatatgttttaaataaagcaattgtgatgtgtatcagcagcaacaagaaataatgaaagataaagcaaatagaaaagctattttaattttacaaaagtagaagaaagaactaaaaaagtgttgcatatataccttaataggtctagagacattactgaattgtgacatagtattatgttataactaatactcactaattattaaaatgataatctgtttaaagaggatagcaaaataaagatttatctctctgggaaagttcaaacactagaggagcttcatcgccataccatatactttcctctaactactatttcatctctttcctttcttttagtgccattcttcaagttatattaacaaagctaggaccatttcttcttctgttaggccttccacttaattggattttgatttctgccttggtagctgccgccctcctaatttttctcagtgaaatgacattgatgatcatgttattaaatccggggacatcttttctttgtcttatctattcttccatacttggatgacctcttaataacagttcttccctcttgagactccccttagctgttgggttactgcattctccatcttcccttcttttttggcctttctcattctatttcttgtggaaaaatagggataggcctcctccacgtgcttttttttcttaaacataagatttttgaagagaaaaatctgttttagagtgaactagattttttttgcattaaacactgacatagtttccttgcagattttatttcagattaaaataaaaatctgtggttgatattttcctccccttgttcattggatctttaaggtaaataaaataaacataaactgatgctaatgaggataattacattagactagaatttgagacttccttctatttttgctgtaggttagtattgatagaattggcatgatttagtcaatttactgttaatttgttgtcactgtttattgtgttcagttaaaattctttatcatctcaatccatttatatttagctgttacttatgtacttggcttctctttgtggagcttcttagttctattcactagtgtgcaagttgcagatttttcttttcagagttgaggaagaccaaagatgaagtagattttggaaggaggtgtataggaggaagatcatttttcaaatgagtactgttgtccaagttagatgtgtaagtctggatttcagatcagagacttgacttgtattagaaaaatatagtaggtagcatgtagctattaggtgacaagatgaaatcacctcagagtaagtatacatggagaaaagatccaagaattgtgcttttggcatttcagtgtttagggttggggagataaggaagaaccaacaaaggagctgagaaagagcagcccctgaggtaggaagaaaatggagagattttggtgtttcagagattttggtgtttcagaagccaagtaaaaacactgttttgaggagggaataaggtaaccgtttactatatcaaatgctgctgtgtgtgctcataagatggaagagaagtatttaacaatctggagatcattggtgacttttaccaaggggcagttttggtgaatggtggagtggaaaacctgatttgggtttcagagagaatgggaggggaagaattggagataatacaatgggactttccccgctaggttttgcttttaaagagagcacaaaaattcacataggagatattatttgccattctgtattggttaaataaaactaatacaaaatgtctggaaaagtcacattaccagtcatgccttatttttctgatagatcttgttaggttgagaatctttatatgtttattggccttttatagttccttatctgtgaattgcctgttcatctcctttgcccatttttctaatggatattgtctttaatttgtctgtaggaatttcttgttttgttacaaatattttcatggagccagtaatctaaatcagtgaatggggtagactggcctgtgagccctgtttttgtaaataaagttttatttacataaacatagctatggtaatttgtttacatgtcacatagcacttattgcacttatttgtttacatgtcacatagcacttattgctgattcctgcaacaaggacagaattaagaggttgtgtcagacagaggtcatgtggcccacaagattgaaaatatctattttttggccgcttacaaaaaagatttgccaatctcttatctaaggcaatggtttttgtcctccatttttccttagaataaagttctataaagtataattctgaaatgggaaactaagtcccctaatgtaaattctattttgtaatcctttaaaaacacagttttctacctttacttaatggaaccttattaaagatagtagtcatctgatagtattaaacatgtaatttgtctcagctatttctcaaagtgtttgggattaccaaaattatgagatctggtatctgcccttaatgagcttactgtctagtctgcttgaaaggaaagaatatggaactatgaaaacttgccaaattgtgataaggctatagccttatcctcaagaaaatcaaaggaattataacagaaacttatctgtaagtaaggacagattctaaaaaaaacattcttttttttttttttgagatggcgtctcgctctgtcacccaggctggagtgcagtggtgcgatatcggctcactgcaagctccgcctcccgggttcaagcgactctcctgtctcagcctcccgagtagctgggactacaggcatgtaccactacatacagctaattttttatatttttagtagagacagggtttcaccatgttagccaggatggtctcgatctcctgaccttgtgatccgcccgcctcggcctcccaaagtgctgggattataggtgtgagccaccacacccggcagtaaaaaagacattgttaacctactatttggatgagtttcaggagtcccaggaactacctgaaattatgtctaaagttgtctgtgtaccaagggcctttgattattactctgggttgaaggagacccattcttagtttttcttcaggctttgtggacaaaataaaattaaagaaatataaggccctacccgtctctgtagaatttgttaataccattttttaaatcccaagttctttccgttacaaaaaactctagcaactctattttaattctgtgaattctgagtgttttaagtgttggggatccagtaatatcttctaagcatatctggaaactgggagttgggtgataggaggaggtttttgaataaaatgaagaaatctcaagctgagcttgacatatggagaggaaactaacatgcgtataaaagaggcaaaccatagcaggccagtttactctgctgtgttctggatgctctggcttggagtcactctaattggagccatggctaattttgtgctttgtgcgatgtgaggatttgctaaataaagactatgtaaacctttcatctcaagcatcccagttactctgtctctctggaaactctggggactaggaagctcaggagttactaacaatgagtattaaaatcagaaagatatggaaaaatatagaaagaaaaatgtattttaatgagtttgtgatctgtttacaagaaagcaaacaaatttttatttcactgaaactgaggttgagagatgaggtcttaaaacacttaaaatgagcaaagggtagtaaatggagagttaattttcaaataatttattttaaagttcaaaaatagttttagtaatcctgtgtactgtgttagcttattgtttatcttacagtgaaaaaaatacttctagcgccttaataggtattcatcaatgatccttgtccttgcctattttcacctaaaatatcttttaaatttttttaaccttgacttttgctattagggctgttgtgattaaaatcctgatgattggagaagaaatgtcttatcagaatctttatatagcataatatactttatgattgtttatttaatattagttgcagaacgtgatgaaacatagcatgctttattgaagccactgagaagcaagttgcaatgacgtaagggggaaaatagaagtcaaacatcttaatgaatttttttttgtagctcccttattcctcatttaatgagtaggttagttgaagagacattgattgattgaccaaaagaacattttggtacctcttggattttatttaatataattgtatagacatttttagcaatatcttttggcagcactcttcagttgttacattttatatgactcatgcaaattaacccttctgggccagtcgaggtggctcacgcctgtaatcccagcactttgggaagctgaggtgggaggatcacctgaggtcaggagtttgagaccagtctgcccaacatggtgaaatcctgtctctactaaaaataaaaaaaatttaggcccagtgcagtggcttatgcctgtaatctcagcactttgggaggctgaggggggtggatcacgaggtcaagagatgaagatcatcctggccaacatggtgaaaccctgtctctactaaaaatacaaaaattagctgggcctggtggcaggtgcctgtagtcccagctacctgggaggctgaggcaggagaattgcttgaacctgggaagtggaggttgcagtgagccgagattgcgctactgtacactagcctggcgacagagtgagactctatctcaaaaacaaacaaacaaattagccggatgtagtggcgggtgcctgtaatcccagctactcaggaggctaaggcaggagaatcacttgaacccgggaggcggaggttgcagtgagacgagatcgccccactgcactccagcctgggcgacaagagcgaaactcagtctcaaaaaaaaaaaagaaaagaaaattaacccttctgaatgttttcctcatctatatgatgacaaaaaatacagtttacagtgtgagattatattgtggccatgtgataactatattaagcacctagctcagttgttggcactgttatcaaagtaggtatatatttaaagtttttattatatttgggatagcctttccattccttatttatgaactctctataccataagcattaaagtaacttaaggattcaacctgttttgaattttccagtagtttggaatttttttgataattgtcacaggcactattttagttttaattattgaatgtaaaggaatcaaaatgctctacagcagttgttttcacattttattaatgttactggtgacagaaaattattaagtaatttttttaaattacttaaaatctatattaagattaaatcctgtgttgagtttgttctgaattgcagaacagttgaatgtggacgtggtcattcattcgatcagttcctgctccccttttcccctccccaaattttacattttgggactctgatttcataaaaggttggttttgtaactggatagtgactaaaaatgtaaattagtgagctgttatgaattctagtagaagtaagattttcttttctatatttgttaacagcagaagtagaaagtaatgaaaaggacaacaaacctgaggaagaagagcaagtaatacatgaagatgatgaaagaccttctgagaaaagtatgcatgtataaacaaacttgaactggattgaaaaataataattcactgtttctatatttacaaccgtgtaatattcttttttgcccgtgaaataattgtaaaattttgcaatttcacaactataccattttgttgatggctaactgaaggatttctgaaagtatgtttcatacacttcaatattttattttgtttatttatactttttattgttccacagaaagatttagcttaaaatttactaagttactgagtgttttgagataaattgttttagatttatgtttagagaatgaaactacaagaattttgtatgggctaacgtaagtgaatggaaggatgtattttagttcacttaaggttcttcatcttcatggggccagatgtagtggctcacccctgtaatgccagcactttgggaggccaagatggaaggattgcttgaggccagtaatgcaagaccagcctgggtgacatagcaagaacctgtctctacagaaaaaatatttgaattagccaggcatggtggcacacacctgtagtcccagctactttggaggctgcagtggtagtattgcttgagtccaagaatttgaggttccagtgagcaatgattgagccactgtactccagcctgggtgacagagtgacaccttgagagagagagagagaaggagggagggagggagacaggaaggaaggaagagggaaggaaggaaggaaggaaaagggaaggaaagataaggttctttagctttatgggaagggaaggaaatgatggactgagtgtccttaggtttatggaaagatcattggactagaagtcaggaaagctgggttcagtaactttcctgtcatgctgctatccatatatgaccatgggtaagttaagattgtaagagaaattgtagaatagagtggatttacaagtaggcatatagatacagacacatacagagggataggcatggtcacataagagcatttgcgtttaaaaagtgtgaagatattagtgttttaatttttttagatattgaagaagccagatacaaatttgcttatgatctcatgaatattaacagcacgtgaaacagattttctaagtgaagtcttctagtctatattctttataaatgtacttttaatgacattaattttatttttatttgaaattcattaggatatgttaagaataactattactgtgctagttttgtaaggctgatgattaagaattttttcctatacttacggaggaaaaagaataaataattaaagctgtgcatagttaaaaatctgacatgagaatgaatactatattttgtcagaggattcatgtgcactgtgacatttagttacaggaatgaatatgagatgatttcatctaccttcttcatgacacaattgtgaggcagttcttagtatgaagatttcaaggaaattctgtgttcacagtgtgcattgcttgaccattagggagttcttatttagtatattgaaagtcatttgaagtttaaagctaaaagctatataccttctaagatctccaaaacagtttacaaaatagttggttgagaaggctattatgatagaaataatattttgctaaggatggataatatgcattaagagctataagaaaaacacctgagtgtgatcattgtggttttccttctcagatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggtattgtgtcaattataagttataaaccatattgaataaatagcaccactatcttcttctaggtttctgacattattctgtattttattgacataatgtggtttatcatagaaagaaagaacttgaagaaagtggttgagcttttaaagtctattactggccagatgtggtggatcacccctgtaatcccaatcctttgggaggctgaggtggatggatcacctgaagtcaggagttcaagaccagcctgaccaacatggtgaaactctgactctactaaaaatacaaaaattagctggatgttgtggtgggtgcctgtaatcccagctacctgggaggctgaggcaggagaatcacttgaacccgggaggtggaggtggcagtgagccgagatcatgccacttcactccagcctgggtgacagagcaagactccatctcaaaaaaataataaataaataaataaataagtctattactatccttgataatttaattttaaaattctttctgacttctttttggctacatctttttttttttttaaaaaaggttatgattatcaaaacaagggagagaaggtaacatttttatttatttgctttggtaacaaaactgaatgttgtttttcagcttttctttttccttctcacattgaactttatcttattgtgaaaaggaaatgttagagttttaaatattagcattttaatctttataaagctggtttcatggttataagtctacattctaaactctttattgtgtacttgagggttagtataaaagtggtagagacagggtgttaaaaggactagagaaaggagtatttagaatacggagtttgaaattccccttacatctgtttgactagagatagaaataatgaaaatattcagtattttatgtttttcaacatgtgttcacaaatgtttttacaaagcttttcttagagaggaatattaaacttcgatgataactagtttttcaaggtcttatatatttaaggatgacattttacaatcaatgttttaggacaaaattctttcattaaaatatagcatacatatttgcactttgtagaaaaaagaatagtgaggctgtagaaactctcagtgttgtttttttcccctagtttctttttatttgacatatggagataataatgcttattcagtctttcttacagagctgttagaattatgaaggtagctatgtgaaagaattttgaaaactgaggtttcctgagagtttacttctttagaacagtgttactcaagtatggttcatgggtatgtgccaatgtctttgttgtggacccataatgagaatatggaactttttaaaagtttactctctggaaattttctatttttagtatgtattaccctcttgaagtagattttatatatataaaagtagaggattttagcagatagtattgtgttacagattctagcatgttttattcattaagttagtttgtcattactgtcttcttggtacttaagaatatttactggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagagcgagactccgtctcaaaaaaaaagaatatttactgtttattgcttgctggaatgccttcttggcataatgaaggaatatttgtttctttaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggtttgtacattgacttgagttgtatactccatgtgtcattgtttttataacttattttctgagatatatatttgagattaactataaaatacatttaaattctaaatgtaagaaggaaaaggagtttgtttagtttgccagggctgctgtaaagaaagtgcaataaactgagtggtttaaacagtagaaatattctgtctcacagttctggaggctagaagttgaagatcaaggtgtcagcagtgtagattctttttgagggctgtgctgtgaggaagaatctgttctatgcctttactgtagcttctgttggtttgcggacagttctttggcattgtagaaacatcaccctgatctctggctttatctttacatggtgttgtccttgtatgtgtgtctgtaaatttcccctttttacaaggacaccagtcattggagtaggggcccactatactccaacatgacttcatcttaactaattacctctgcaatgaccttctttacaaataaggtcacagtctgaaatactggaagtttagacttcaatatgtgaacttttaggggacacagttcaaaccataacggagactcagaaattcctggatctaacttagtgcttcatatttttttttccagtcactaaaggaaggctgtcatttagcatgctataataagtactaaataatatttgttagggattctttttatgttaatctacctcctttcgtggaccttatgttttaaagatgttagtttaataacacgtatttattaatttctacttgtcattttttattaagtacaactatatcttaacatacaataccagagcttctggtcagctgaaatgagcacacagtagtgtgctgtagtaatctactttattccaaagctaagaagctggtatttgaatcagtacattcattctgtcataagtaagtgtatggttcctattgggttattttatatatgagcatatcccaaagatgctgagtggtaaaccatgtatagggccttattttgcaaatgaaggaaaagtggcccatggaagtcaaatcactttttccgttacgaataaaattttagctaaataggattagaatttaagtgtgtctcccagactgacctatctaattattaaacttcattttactagtactgttcagacttttgaattaaatttgaaaatgcctgaagatttgaaagaataattttattcattgtttctcatcacacccacgggtgcaactatgaaattgtgtttttaaaacctaagtttttggctgggcatagtggctcacgcctgtgagctcagcactttaggaggctgaggaaggtgaatctcttgagtctagcagttagagaccagcctggccaatatggtgaaaccctgtctctactaaaaatacaaaaaaattagccgagtgtggtagtgcatgcctgtagtcccagctactttggaggttgaggcatgagaattgcttgaacctgggaggtggaggttgcagtgagctgagatcgggctactgcattccagcctgggcaacagagtgagactctgtctccaaaataaatccatccatccatccatccatccatccatccatccatccatccatcctaaaacagttttcgacacctatcatctcacacataaggtgcaatccagatttcttaacatttaaatttgtacttaaatgttgcttgtagtctcagaatttgaatctttctaacaccaagccaatcatcttctctgcaaatgttcctgttactgacaatttctgaattcttggaaaactcttgaaggaaaatcttcccattgttcctcttattggcagctcttgaattcttggaaaccgatccctctcaatcatttcatatacacagtgagttgccaagttacaacttgattatttcctagaaaaaataaatctcaattcttttcacttttcattaggccatcattacccaattccttgattatagtaacaccttttatatgagcactctggtactagtttttaagttctttctggtccttccaaagcattgtactaatttttctaaaatactgattacttcagtctctttatagtccaagttcctcaattgtgtaccggtaaaaccagtattcatttttaaaatttttaaattttaatctcttaattttcaatccactttttctaatatccaccagttgcttcactgtcctacagggtactattaatgtttattgtattttgataccaggcttttgacttcgtattgtttcccctgttcactcacccatgatcatgtgcccaatttaattccatctctttgtgtcttgttccagtattttgtttttttatggaaataaaattcagataccaaactgttttaaagtgtacaattcattgttatttagtacattcacaattttatacaaccacaatctctatctagtttcaaaacatttttgtcaactcaaaaagaaacgttttgcccattaagcatttgctcttcttttcctcttacactagcccttggcaaccactaatctgctgtctctatcgatttacctgttttgcatatttcacatgcctctttcacttagcgtgttttccagcttaatctgtgtttgtagcatgtatcagtacttcattccttcttagggctaaataatattccattatatggcggtatatgccacattttgcttatacgttcatccattgaatggcatttgggttgttcctactttcagctattgtgaatgatgctgctttgaacttgtatacaagtgtttgtttgaatacttgttttcaaatcttttaggaatatacctaggtgtggaattgtgggccatatggtaattctttgtttaacttactgaagaatcacccagctgttgtccacagtggctataccattttctgttcccaccagcaatgtatgagggttccatttctccacatcctcaccaatacttgttatttttactttctttttttattattatagcatctgaatggtatgaagtggtatctcattagggttttgatttgcatttccctaatgataaatgatgttgatcaacttttcatgtacttgttgatcaatcatatgtgcttgtttatagaaatgtctattaaagtcctttgcccatttttaatttggattttttgcttttttgttgttgagttgtaagaattatttatatattctggataccaaagtcttttttttttttttttttttgagacggagtctcctgccaattcccaggctggagtgcaatggtgtgatcttggctcactgcaagctctgcctcccgggttcacgccattctcctgcctcagcctcccgagcagctgggactacaggcgtctgccaccacgcccggccaattttttgtatttttagtagagatggggtttcaccatgttagccaggatggtctccatttcctgacctcatgatctgcccacctcggcctcccaaagtgctgggattacaggcgtgagccaccgcgccctgcccaggataccaaactcaccgcacccggcccaggataccaaactcttattagatacatgattgcaaatattttctcccgttctgtaatttgtctacaacttcttgataatgccttttgatgcacaaaacttttaaattttgatgaagtcttacagatggtatatagtttggtcatgatttattatcagttccaccaatctctaccttttaatcaaggagtttatttacatttaaagtagttactaataaggaaaaacttctgcaattttacttttcttctatatctgataccttttttgtttctactttctccattactgccttgttttgcaattgattttttcctggtatatcattttgattccttcttgtttctcttcctatatatatttttagttttttccttagtggttaccctggggattacacttaacatcttaactttataacagttaggtttcaattaatatctacttattttcagtagcatacaaaatcaaatatcattatgattgtgctctagagagggaaatatgtttttttggtgtagatactacccatgtggcaattgttggcaaccgttctacccacattttgctgcctgttttgcaatgtgtacatagttcagcctgattctgcccttcactctgggtatagtaacacttagccaatcgagtcctgttacaacaaatataaagcatagtgcaagatcatgagaggagtttgttgagatcagttgtgctcattttggctaaatttatgtggtgcagttggtttggaaataaaactttgaattcgttcttactgcgtatttcagaacaatttcctgttagctaatatgatattttgacttttggcttaatatgttttagtataattatccagggacaatttgttcagttgaatacatctgagacaaattgttctattggtctgataaatctttgacctagaaataaaataaatacaaataaactgcacaaggattagaaaaggagacaagatccagaagggattctttaagaacgtttttatgttaacaaccttgtaccaatgaaatctgttgtatacaaaaaggaagcaggaggccaggtgtgatggctcatgcttgtaatccgagcactttgggaggctgagacaggtggatcacttgaggtcaggagttcgagaccagcctggccaacatagtgaaacctcgtctctactaaaaatacaaaaattagctgggcttgatggcacatccctgtaatcccagctactagtgaggctgaggcaggagaatcgcttgaacccaggaggcggaggttgcagttagccaagattgtgcccttgcattccagcctgggcaacagagcaagactctgtctcaaaaaaggaagcaggaaagctaggttttgaggaactgtatcaaaactatagtcaaagatctatttctgaagaagtcatggaacccagaaagctttgccagataattctgacaaatcattgaggaacaggtaattcttgtctgatgtaaactgttccagggtatggagaaagatgagacttccattagatgaagtaagcccatctgtgaaacctctagcacaagaagagaaaaaaacatagtttagttttattccccagcatagatttctcttaagaatgcaaacttggttcagtattaacaattatacgttactctgctaatgtaggaaaggtgaaaaatagtgtgatcatctcagtacatgccaaatcaggatttgttaaaattcactggtcattcatggaaaaaacaggaggtaaataccttgaatctcttaaagggttttcagaaacctgttgtaaatatcatatttaataatggattattggaaatatttctaccaaagttgagaatgagaaaatgcctattaatagatgttgctatttagagctttggtgtcagtcttgggcaatacagtgagacaggaaaaagaaatgagtaacaattggtaagtgggaacccaatagaattaagttggcaaactgttgaatgaagaaggaaatatagcaactacctcatataaggacaatatattctaatagttttccttatatcaacaataaccaattagaaaatataatgagaaaaagatttcacatatggtagttatttaaaaatgagtaagcacttaagaataaaccaaaaaataaaattttaagaccattatgaagaaaaaggacagaaccagaaaacaggagtcaacagtgattagtactatgctcttaaataggaagacttgattcctctcaaatcacagtatagttcaaattcataatactcggaatttcaactagatttcttacagaaatggaaaagctgtcaacacactctggaatataacattccgttggttatgacttagaaaatgccattttaagtagatttaactaaaaatgtctattttactttttcctttcagcctcggctcctgttccctatcaatgaagtaaatttatgacagcctaatacagagacagttttaaataatagaaactgtgggtctgtttatttacttgcttttatgagcagtaatatttgttataggccaaccttgatgttaaggaaacctctttttttttgtagacagagttatttcctaagaggtttcctgggtacatatgcagtgaaattcttggtttgtctagtttcccaaataaaacccaatgtaatagaatatcacttttctggagttacaaaaatgacttgtttattcatttttttaaaatgtctcagaatatctaccaaaatagccattcttagacacagtatggcagatattttgaattataattaaaaaagaattgtacagcttcctatgtaaaaacaaaaaggctgctctttgatttctctgttttataatattaaatatcagaaaactataaatcagtgtccacattttgagtttgtttttctgctactggattcatttttaaaatgataattcttttaaaaaagagtttgaataccacaaatgtatgtgatgtgaaaatgaggtccttagttcattttctttcccactttctgccaatcatagcttccagcggtgactacttttaaccttggaatgtatagatctttttctatacatgtgacatatacaagatgattttgggggggcttaagtaaaaatagaataataatattatgcatactatgcaatttttagtgtaaccacctagtttttttttttttttttttgagacagagtcttgctctgtcatccaggctggagtgcagtggtgcgatctcggctcactgcagcctctgcctcctgattcaagcaattctcctgcctcagcctcccgaagagctgggactacaggcgcgcgccaccacgcctggctaatttttgtatttttagtagagatggggtttcaccatgttgaccaggctggtcttgaactccagaccttgtgatccacctgtctcagcctcccaaagtattgggattacaggtgtgagccactgcgcctggcccacctatatgatttgactaaagaaaaaatgacattctcgcatgagctggggtacagaaaataccttccctttcccatatacctttcttttctttttctttctttcttttttttttgagagagagtctcgctttgtcacccatccgcccaccttggccttccagagtgttgggattacaggcatgagccactgcacctggctttcccatttacctttttagaaagttatttgagatattttagtcatcagaaaggtaaatccatgttaaggatatgaaattatgctttatgatcttgagccttaataacatgcataaataactaagtccttagggaaaatctttacctttgagagtcataggtaactgattgcctaggccataatattggacttaagcacattttaagatttgggttctcctctagaagtgactgctttctgcaagaaactttaaaagtaaatcataacattttctcatttttatgaaatgtatgcccttattggataaaataaattctctggcagagctcttccttaggtagggcctcatgaatacactcagaagtttaattttcttgaaaatatgtttaatttaaaatggcttcagcagcaacagcaacagaaacagttgaatattacgtctatgcttagtaaaagactgaaaggagatactaccaaatattcatgtggtgaaatgataatttttatttttctttttgttctgcttttttttccctcagatttcctttcaatatgtatttgggcaaaatatgtgatcagggagtttgtataagtacaacaaatgattaataatctcactgaccatgttgacacaaacaaggtaatgggttttttgtttgttttttgttttttttttgagacagagtctaactctgttgcccaggctggagtgcagtggcgcgatcttggctcactgcaacctctgcctcccgggttcaagcgatactcctgcttcagcctcctgagtaactgggattacaggcacgtgccaccacgcctggctaatttttgtatttttagtagagatggggtttcaccattttggccaggctggtctcgaactcttggccttaggtgatccacctgcctcggcctcctaaagtgctggaattacaggtgtgagccaccatgcctagccaaggtaatgtttttatcagattgttaaagactaacagaatatgtaatttaatttgtgaaaaagtaatatatgagcattcatttacacttctgttgaaagtgtcacagtaaagcctatacatccatccatatgtagtattggcaagggatcttttatgacttacagatatttccactttataattctcaatgagaaaatcaagtgtgattacaactgtgttaaaaaaataacaaaacacaggcttacatattcaggaatgtactggtaagtgagcaacactcaaaagttcgaggaagaaataggctaacctaattaagagtgtttacatctgagtactgaatttaggggtcacttagttttagtcataactgtattttccaagtatatagtttataatcaacttaatttattttctttactcagctatcttctgaggatcctgttttctataggtttctttttatatattcatggtttttttttttaatgctgtaatactatttgatttccattcatttttgtctttttttttttttttcaggccaagatagccaggttaaccaaacgctttgaagcagccaaagaagatcttaagaaaagacatgaagtaaaatttttctattcttgcataattaatatttagcactaagtggtaatcttaggaaatgctgaattaggaggaaactgtattacaaatctgaaatttgctttcatactgtgtactcctctatgtaatttctggatcttcagccctagaactaatgaacccctttcaaatcctcatttactattctcatatatcaacatttatattctattttaggttatgcaattctttttttttttttttttttgagatggagtctctctgtcgcccaggctggagtgcagtggcaccatcttggttcactgcaacctctgcctcatgggttcaagtgattctcctgcctcagcctcccaagtagctgggattacaggtgcccaccaccatgcctgactgatttttgtatttctagtagagacggggtttcaccatgttggccaggctggtctcgaactcccaacatcaggagtccatctaccttggcctcccaaagtgctggaattacagacatgagccattgtgactggccccttaggttatgcaattcttgaagctgtattttctgtccatctttaaaattaggcttcagggatttgtcttaccttgtttctttcattttgcattcttgtcagattcccagtatggtctcttactattttccccaaagtattttagtattctactgcctgtagtattcctgttctccccttcctttcttccccatgtagtcagtcctcttttatgctttaattgtaatatacagagattagattaagtcactttattgacttaaacagtttgaatattttttaaagtatacaattaagtccaaacatagcataaattgacttccatagtctggcttttgcttgttggtgtttccttcatttttcctttgtttatcattttgccactcttctgttatttcctttattattcatattttaatatagtactttgtatattgcattatagtttttagttggatttattttcttttcctcctgaattttttttgtttttaatttttttatttgaacaaggtccatttcttcatcttgatagttccattgtctggcacatagtaaattgccaatatcaataaatagtaatcatttttcctagaggttttctgtattgatacatgttcatatattctttcctgtttttgcagcaatagtacatagagccctatgaactcttcccctagcttcccctgagtggtgaaatcttatcgctgtagtacagtatcaaagtgaagaaattgacaattttgtttacaaagtagtttacagacttaacagtttctaccagtttttacatgtgtatttaaaaattcattgtgcatttatgtctgtctgtgtttatgattccatgcactttgatcacatgtatagatttatgtagcccccatcacagtcaagatataaaattgttacatcaccataagtggactccctcatgctacccttttctggttttatttttattattgttacatctgttgatggacacttggtccattattatctttgggctattttgaataatgctgcaatgtacatgggagtgcagctatctctttgagatcctgtttttaattcttttgcatatatacccagaagaggaattactaggttgtatggtaatacttttagatatttgaggagcccccattctgttcttcatagaggctgcaccatttcacatttataccagtagtgctcaagagttccagatttcccataacctcgctaacgtgttattttctgttcttttgatagtgaccatcctcatggatgtatgtgatacctcattgtagttttgatttgcatttctctaatgactagtgatgttgagcatcttttcatatgcttgttggccatttatgtatctcctttggagaaaagtctcttcgggttcattgcctatttttaaatcaagttccttatttttgttgttgttactaagttgtaggcattccttatatatgctgaatattgactcttatataaattatttgcaacttttttgcatcctttgtttccttttctctcgattgtttcctttcatatacagaagttattaagtttgatgcagttctgtttgtctatttttgcttttcttacctgtgctattagtgtcatatacaaaagaatcattgccaaatccaatgtcatgaaactttttccgtatgttttcttgtaggaattttatggttttaggtcttatatttaaatctttagtcaattttgagttaatttttatatattttgtcagagtccatcttctttcttttgcgtgtatatatccagttttcccagcaccatttattaaagaggctgtccttatcccgttgtgtggtttaggcagttttgttgaagatcatttgaccgtatatgtgagtttatttctaagctctctattcatttcctttggtcactgtctatttttgtgccagcacctcacttttttcgattattgtagctttgtaatatattttgtgtggttcccccaccccccgcccccttggctaacttagcctaatatgtaatatgttttcaaatcaggaagtttgaaaacctccaactttgttcttttcaaaactatttttgcaattcaagatcctttgagattccatatgaattttaggatttttttctggaaaaaaaaaacaaacccactattgcaatattgatagggattgcattgaatctgcaggttgctttgggtaatacagatattttaacaataataagacttcccaatccataaacacaggatgtcttttcacttatttgtgtctttaaactttttccaacattgttttgtagtttttattgtgtaattgttttctccctttaagtgtattcctaagtattttattcttttcgatgctattataaattatattgttcatttcttttttatattttttatagtttatagatatgcaactgatttttgcaggttgattttgtatcctgcaacattgctgagtttacatatgtttgaacagttgtctttagggtttttacatatgagatcatatcatctgtgaacaaagatatttatacttctttttctgatttggatgtcatttatttctttttcttgcataattgtttggtttagaatttctcatactatattgaacagaagtggcaagagtaggcatgcttgcttaattcctgatcttagaaggaaagctttcggtttttcaccattgagtatgatgttaaccatggagttttcatgtatggcctttgttaaattgagataatttccatttctggtttgatgagtgttttatttatttttttccatgaaagggtgttgaattttgtcaagttcttttgctgcatcaattaagatgatcatgtgggttttgtcctttgttctgttaatatgttacattgatttttatatcttgacctatccttgcattcctcagataaaccaacttggtcatggtgtataatctttttacatgctgttgaatttggtttgctaatattttcttgaggatttttatatcagtattcatcagggatatttgtctgtagttttagtatctttgtttgactttggtatcaaggtaatgattgcctaataaatggaatttgaaagtactcctacttggaagtactcctcttggaatactaccaattgtttggtagtatcctccagtgaagccatctggtcttaggtttttgtttgttaattttatttttaaaatttattatttattaatgattattatttttgcaacagagtctcactctgtcatccaggctggagtgcagtgatgtgatcttggttcaagtgatttgtgtgcctcaacctcctgagtagctggaataataggcctgcaccaccacgtctggctaatttttgtatttgtagtagagacgggctttcgtcatttggccagggtggtcttgaactcctgacctcaagtgagccaccgcacctggccttaggctttttttgttaggagatttctattactgattaagtctccttaataattatagatttatttatttatttacttttaataattcagtcttggtgggttgtgtgtttttaggaatttatttcttctaggtaatcaagtttgcaggtgtgtaattgttcattgtagtctcttgtaatccttcccatttatgtagcatcagttctaatgtcttctctttctttcatttcttttcatctttaaagtcatctgttttgttagttagcctagttaaggatttatcaattttgctgattttttttaaaccaacttttaagttttgtttttgtttttctattctctatttttgtttacttccaccctaattttcattatttctttcctcttgctaattttgggtttagtttttcccctctagttctttgagttgtaaagctagattgttgatttgagatctttgtgtttgtgttttaccactataaacttccttcttaccactgttttcactgcatacaatttattatattttgttttcattttcatttgtctgaagatatcttgtaatttaccttcttctttgacttgttggttttttttttttaaacagcatgtttaattttcacatatttgtgacttttcctacttttcttctgctgttgacgtcaagtttcattccattattgtcagaaaagatacttggtatgatttcattctttctaaatttgttaagacctgggttgtgacatgcgacctatccatgagaattttctatgtgctcttgagaagaatgtgtattctgctgttgtttgatccaagcttatcctatgtgtctgttaggtccaattagcatatagtgttgttaaagttctctgtttctgtgttgatattctgtctgatggttctatccattattgaaagtggggtattgaagtttcctactatcattgtgttactgtctgtttctcccttccattctttcaatgtttgtttcatatatttggagctctgatgtaggggtgtgtgtgtgtgtgttacagctggtgaaagtacccttttatcattatgtccttcattgtctgttttgacagtttttgacctaaagtctattttgtcatacataagtatggcccatccttactctcttcttgttaccatttgcatggtaatatttttccatcctttcactttcattctgtgttgtattttggatccaaagtgagcctcttgtaggcaccatatagttggatcttattttaaaaaacattaagtcaacctgtcgtttgattggagaattttatccatttgcatttaaataaactgctcattggaagggacttattgttgtcattttgtttttttctctatgacttgtagcttttttttgtttcttgattcctttgtgtttcattgctttttgtttttcttttggtatagtagtgtgctttcattccttttacagttcgttttgtgtattttctttagatgtttcctctgtggttaccgtggggattacataaaacatcctaaagttacaactgtctatgttaaactgcaaataactttaatcatataagagcgctagtctatatctgcctcactatgacttgatgttactgttgtcgtatatcacatctttttatgttgtgtatctgttaacatatttttagtttttttaagcttttaagttctataccagaattaaaagtggtttatgcaccaatataacaagaatacaggattctgtatttttctccttatcaacattttcttagagaagtttatatttttgtatgcttccatgatgcatacactctttagtttccacgtgaagggctttcttcagcacttcttttaggacaggtatagtgatgaaactccttcagcttttactaatctgggaaaaattttaatttcaccttcatttttgaagcatattattgccaggtatagtattcttgattggcaggtctttgattcagccctttgataatatattatctcactccttcaggcctacaagatttctgctgagatatctgcgtgttatcttatgggagttcccttgtgtgttgttatgagttgcttttctcttactgctttcaagattatttactgtgattcagacagcttggttataatgtatctcagtgtagatgtttttgggttaacaatagttggaggtctttgagcttcttgaatttgcatctccattttcttcttccagtttcagacattttcagcaattatttatctttctctctgtcttcctttacttcccttatgtgtatattggtctgcctgttggtgtcccaaaagtcctttagactttcttagctttttttcattctctttttgctcctctggcttgataatttcaaatgacctgtcttcaaacttgtggacttatttttcggtttgatccggtctgctcttgattctctacagtgaattttcatttcagtgtattcttcagctttttaatttgtattatgatacgtttttacagtttctctttgttgatattttcattttgttcatgcacccttttcctgattttgctgttttctgtcgtctctttcactttcacctaattgagtatcttttttttttttgagaaggagtttcgctcctgtcgcccaggctggagtgtaacggcgcaatctccactcactgcaacctccgcctcctgggttcaagcgattctccagcctcagcctcctgagtggctggggttacaggtgcccaccatcacgctcggctaatttttgtatgtttagtagatacaagctttcaccattttggctaggctgctcttgaactcctgacctcaggtgatctgcccgcctcggcctcccaaagtgctgggattacaggcacgagccaccaggcctggccagagtgtcttaatgatagttattttgaattcattggcagataattcatagctctctgttactttagggttggtttttggagatttattttatttatttgattggaccatgtttctctgtttatttgtatgcttgttgaaattttagcatttgaaaaaacagccacatctcccagtctttgtggactcttgtacacaggaagggcttcaccagtcagccttgttagagagtctgtgggcctctaacacctttttttggctatgtgtcttctctgggcttttgcttgtactcttccatctgaagaggtttgcctctctactctgaagctccctctggtacctgtctttgctatagcagcctctggtactttggcaagctgttgtattagtgcttcccctgctgtctgtctgtgttactgcaatttctctggtgctctatcaagttgagggtcctgcctttggtctctgaggctcacaggcatccgaagtgccatagtcacagttcttgctccagattagtcctccatgttgggtaagacaaaatctaatgcgttgggcatctttcttaaacagttggattcaagctccaactttctctttcctttctgatgtagaagctgtgttgggaggttgatggggtatagtgagtaaatgcaatgtattttcctaactgttccagtgtgcctctttttggccttgtgctcacctgggatggcataccctctcaactaatttgtggaaatctcatgcaggcaatatgatgcttatcttgttaagtcatctccatatgggaagcagaggggacttcctgttctgacatgttgctgatcataccacagttttcaaaaatcctccatcaaatgactcctgtgttctaaaccatttatttattctctatgcttttattcttcttgtttttctcctgaaatattcttttatcttaaccattttgagtgtaataattactcaatgatggccaggcacagtagctcatgcctgtaatcccagcactttgggaggctgaggcgggcagatcacttgagttcaggagttcgagaccagcctggtcaacatggcgaaaccccacgtctactaaaaatacaaaaattagccgggcctggtggcaggcacctgtaatcccagctactcagaggctgaggcaggagaatcgcttgagcctgggaggcggaggctagagtgagccaagatggtgccgcaggatggtgcactccagcctgggcgacagtgagactctatctcaaaaaaaaaaaaaaaaaaattactcaacaatgtgcttaaagatgcattcctttccctaaaagcttttcttttttaagctttttgcattcgccttacacagttattttaatgtgcttttctcttgttttacatttgtttatcttgacagccagattttaagcacctttatagcagattgtcttaattctattgtttttccctctacacgtatctaatgcaatgtcatactagaaggttgaaattattgttgtgtcatataaaaagtagcaagatgtatttgttgttaagaagagtgattaatggcatctgctcaatgtaattctaagcatttactacctttggtttaatatgttattcttacacttgacttagtcttgagtagagatattttattcttccattttttgtttgtttgtttttgaggcatgttctggctctgtcacccaggctggagtgcagtgacacaatctcagctcactgcaacctctgcctcctcggctcaagctatcctcccacctcagcctcccaagaaggtgggaccacaggcgtgtattaccacgcctggctaatttttgtattttttttttagagatggggttttgctacgttgcccaggctggtctgtaactcctgagctcaagcaatccttgcctgtctcagcctcccaacgtgctagtattacgggtgtgagccactgtgcccagcctcgttttaagagataaatgatgatagtgttattaatgatggaggcctaaataatgatagttaatatgtaggcgttataattccatttctgtattccctggttttggggggaaaggctgaaataagttgttactgaagcttagatttgtgacattttattaaataatttaagtcacatagtggtaggtagtatttttttaaaaaacaacttaaaaataattttgatttgtgacattggataccacttatttgttgaattggtggtgctaatatgatgcctgctacatagtaggcattcactagctatttgttaaatgagtgagtctggttattctttagatttatattgttaatgttttttaaactcttacagcatgtgagccattctggtgtttttaatttattcttcataagaacactgagatgcaggaattattatattaatctctcaaatgataagcagttgtcttcagcaaagtaaatgatttgcttaagatacaatgaacaagtgataatgccaagattcaaattattgtctcagctggcaatgtttcccattatattagaacagtgacagataatatattgacaggcatctacaggtctaatttttttttaaagattccctgtgtgttgagttttatttttaccttgatttttttttctcccccagcatccacccaacccaccagtatcaccaggaaaaactgtaaatgatgtcaacagcaataataacatgtcttacaggtgagaattcatagtctgtctagtttttaaaaacagaacaaagttctactttctttatttggtcaaagaatcttgcagtgtaatcatggtatttatgtagaaataagtgtttggtgtacttggttagtatattttctttttctgcttcattatattgttcatctgtgaataatacttttgctaacttattataaggcattctttggtcactatatatttctttaaccacttgtcttaaatagtattctttcaagtaattgagaaatgcttctgttaagggtgagaaagactaatgtctgtatatattaggacctacttttggtattcaggttaagtactgataacagacattagaatacaagagttaagagttaagagttaatgccacagaccccagcatttagaagtctttgtgccagctatgcctcactgtttttgcttgcagtttaggattgtgaaacccaagtctagccaccctttttcccctgtgggccactgcttattctagatatcagttggtattccctgagtggcatatctattgactattggtgtgtatatgtatttcatagaaatgcaggcacagtgagacagatgctggagtccaaaagaaatgtaagcgagagtgcaccaccatcctttcaaactcctgtgaatacaggtaactttttttttaaataccaaaatacattttcttaggaattaaaggctttggttctcttttcttacattcttttgaggttgaaatggattaagaaattgggcacattggtctaagtacaaaaattttgttaaaaattcaggatcaaactgggtatggtggcacatgcttatagtctcagctacttaggaggctgaggaggattacccaaacccaggagttcaagtcagcttgggcaacataatggaatccagttggtctcttaaaacaaaaaaatttagggtcatagataagtatatgtgaaaatacagtatagatattcaaatctctattgtagtagttcacaaactttctggtctctagatccctttacaatcttaaaaaattattaagaaccccagaacttttgtttatgtgggttacatccattgatatttattatcagtcgaaatgaagtagaaattaaacagaaatttaaaaatgtttttaaaatgtttattcatttaaaataatagtaggctgggcttggtcgctcatgcctgtaatcccaggactttgagaggctgaggcaggcagatcacttgaggttaggagtttgagaccagcctgtccaacatggtgaaaccccatctctaccaaaatacaaaaattatccaggcatgatggctggtgcctgtaatcccagctactcaggaggctgaggcaggagaattgagcttgaacccgggaagtggagtttgcggtgagccaagatcacgccactgcaccccagcctgggcaacagagtgggacttcctctcaaaaaaaaaataataaataataaatataaaaatagataaagtaatagtaaactcataatgtctaacacaaaaagctttttaaaatgaaactgtgtattttccaagcttaaaaatagcagcacaaagagcattattctcttacattttttacatatctctttaatactttgagacattaagacagctaaagatagcttaaaggtatgtatactcatatctatatctgtttttagtctgttttaaaatgttgatttggctgaagcatatgaaagaaatccagtcttttacaaatatatagatggaaaagggctagcccttacagataattgtggatattcttctttaatactatccagtagtagtttctttaaggttggttgtgaagtgtaatctgaaaccacaccaaagaacttttctaactcctccattaaaatccatttattggacaagcgtggtggcttacgactgtaatcccagcactttgggaggcccgaggcaggtggattgcttgaactcaggagttccgggcctgccggggcaacatagtgaaactctctctctacaaaaaatacaaaaagtagccagacatggtggtgcacaactgtggtcccagctactcaggaggctgaagtggaaagatggcctgagcccgggaggtgtaggctgctgtgagccaagattgcgccagtgtactcgatcctgggcgctagaggcaaaccttgtcttagaaaaaaaaaaaaatccattcctctatcttgcacttggatggagttttactaatattattcattgatcatttgaaaactattcaccaagttatgcaaatcttccaaatgacacattttattaataaatattatttttaaaaattacatttactgattttactatcagttctactcagagaagtattttaaggatttagggagctgtcatgctttcaatgacagatacaagttttttctaatgttcttagttttgctttaaaacccaaatgttattattgctgataaatacagttgggcttttttctttgaagtgactggcttacctagtttatttttaagaaaagatcttcaaaatacccaaacgtgaattatcagtgtgtctgtaggtcattcattcaagtaaaaatagtgtttcatgggaaagactgctagttgagtttacagctcaattgcacaagcatttttccttaactatcctactttggcacgcagtagttgtcttatatgtactgcctatttcttcacatggaatattaagaaaagaacccctattcaaaggttgagatataataaagttaatagtttttaccgctgtatcatggggattcttaagtaaaactgactttgttttttactgtaagcatgtgatgaagaatgcagcgatgtttggtcccattatactaccttgatttttgtactaaagcatcagaagttttacttagcattgcttttgctccattggtgcaaatgtctgcttatttaaacagtcaaataatgtctcattgttatgaaaatagttttgacattgcaaactccctgaaagggtctcagaaaaccccaggcaccccgctggaccacactttgagaaactgctgctctagtgaacctgttatttttggaaagactataaatcaatgagaaagaagtttggtcatgtattttaaacctgttgcaatgagaataaacacaagtagttgaaaattattataaaactagtgaccagcatttgtattttctctgttcttctgtatatgctacctcatttcttcttaattcatctgtcatcttcgctcagtgctgttttccatatcatacaatgtcagtagggtgtcagtagagggaatctcccctcaatagttcctctcccaaggaattcaatcaaacttgatccaaagatacagacatggttcaaataataaaatacgatgagtaagcctacctgttattcattaatggtcatgactctttttagatttactatttgagtttatatattacttgtgttgtaaggcatttataatgtttttaatgtagtttcaaaaatatatatttttacttaactttttagtattttttatttgtttactagttaggtactctaaagtgattatagtaattttcagagaccgttttgatcctcagtagtcttgcatattaatcatcgatcatgtgctgtttttgtaatttactaaaactacatgcaaaatgcttctatgaatttaattctaaattaaattttggaatttaaatctggaaaaaaatttcatgataaaagactttacagtctttgcaatgtattacgcaatgtatttaatttgtgtctgtcatattttcttagttgataaattaatataaccatttaaactgaggcttctgttttctttctatagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattggtaagtcaccatgtaggtttaatactagaaatgcaagcatcttaatagccttgtaatgattgaactttttttttctaagtggctagcgttattggaagtacaaaataaatagaattttcttgattatttttagtaattttttagatacctgagagaaatgatgttgctaaaatggggcttgagaggggttttattttgaattagaagttagtatctgtgttttatcttttagtaattttcctaagtttggtgaatttttaatttatggctttgtggcaagcattatgagttacttttatgatacatttgccagcaatatcgtttaaaacattttaaagtatcaaatttacataatatatgcttttaagaaaaaaagacacgtttatgttccttacccatttggaaaatcctttgtgcactcactcatagcttccaaatttgaacaacttaaaaataagtttttctttcacatttgctataaaatgtttgagtccttcttgttttatcttttccgtgttttcccatatgacatattatatgattgtttgtattttacttagaaatattgcaaaaaggagcacttgattatacctgtttaaaatctgccaaactctgtgtcttcctagttcctagaaagagtttgttttgtatgcattcttgaacttgcttattcttcatttctgacttcacatttatgtgcactacttttggaaagtcatgcaagggtaggcatcatgtgtctagtaaaattgctacagtatttttcttattgatgttgtaagtgaccatgtaatataggaaacaaattctaaagtacaaaattacttttataagtgagatgtacaagccttagtttttatttgtcatatagccattactagtgtagttactccctaagtgttttctcatataaaacaatgacggtatttcacagagttgttaagaaagtaaatgaatggcagatcaaaattaatgttggattgaagctggatatcactcatcattatcatatttataagaataaactaatgttttatatgaaagtgtaattattatttatagtatttacaatttaaatgtttgcatagtacagggcaaatgtttgttagtgttatctgctaccacattattttttggatattctttcatgtttacaacactaaaagagatgcttacttttaactgaggtcagtggacatacaagatttttgggtgatagtttatttttctgtaacttctttttcttttagttcttagtattttttaatgtcagatcatttagtgatggacattgttttatgtgattttgggttttcctccttatgaaattttgaggcaaggttgacattgttttaaattcatggtcatgagatgagatatattcttaaatagagaacttttcctgaaaaaccatggcttgaaatattttaagagtattttgtttaatgtcatgcttgtactccaaacacttctaaaagtgtcagaattataatttcattattctgttctcttacaatttttatagaaaggatatattccccaaattatctggttgatgtacactattagtaattcatgtcagtctgtttcatttgactattcttaacttttttatataaaagtaagttttcacaatcattaattggtatagcattctgagataatgcacaattatttctaaacataaaattgtatattttaacatgtacatttatatatttttaatatgtaattatatcaagatcttcatttcaagttccatttagaatgcttacctacatttgataatgaataaatgtgaatgacaagctttgtatttttttcataatgctaactaaaatgagattttatgaatttgcttattcttcatttctgactttattaataaattattacttataatatgttatttgatcaggtataatttcagcagtgccataaatgacgttaaagtaggcatttggctttttaggattcccaaaacctaaactgaaaccaaactttggtacatctctactacatttagtagtttgtgattaattaattaggttatataattaaaattttctaagctctatacttatgtgggtattatgtttacttaaaagaacatatgctatatgttcatgcatttgtatgtattttattgtagctaagtatatccttatggattttaaatcactattttctgtttatagtgaggtaaatgtcctaagggcttggaaatttaaagctcaaactatagctaatttcattcattcacaaagtaatgaatgtctgtattatcttaggttctttagatacacagaaatgtataaaatagtcactatgatctcaccaagcttacaatcaaatagggaatgtggtaattaaataactaattaattataaatgtgatgagtgttagaatttgcaggtttttgtgagaggacaaaagagaacatgggaaatctggaaagatatgaagtaatgaacagaagaatgggggaaatacggttaaagggtttttgtagggggtaatgtgacatccatgaaccctggttacagtatggagaatggtttggaaggggtaggaatagtgttaggaagaccaattaagaggctggaggctcttgtactgtacaagatgagagatggtggtatgaaaaagatttaaaagttatttaagaggtagcattggcagtacttggtaattaataaaagttcagatgtgtggaagagatggagaactcaaagatgactcagctttctaagacattgttaaatgctgttccatttactaaactagatattaaaaaaagaacagatttgggggaaagttatatacaatccatatacaatgtacactctcagatttcattaaacatcttgttctaagactatataaaactagagttggctaggcatggtggcttatgcctgtaataccagcactttgggaggctgaggcaggaggatggcttgagctcaggagctcgccaccagccttgcaatatagtgagacccccatctgtacaaaaaataaaaaattagcttggcatggtgatacatgcctgcagtcccagctacccaggaggccgaagcaggaggccgaagcaggaggattgcttgaacccaggaggtcaaggctgcagtgagccatggtcgtgccactgcactccagcctgggcaacagaggaggtccctgtctcagaaagaaaaacaaacaaacgagagtttaaacacagcaattatttcttcaaccatttcttcaaggacataattaaatgagcgaagtgtttgccttttttctgttcatacaattatccagagctactaagagataactgccagtttaactcctgtaaagtgctttttaattttatttacttttatttgtatttttatggagacgtattccatatgatagaaggattttaagctataatttcttattttacatcctgaccagttttgttgcttgatagatggagttataatatttatatccagaagtcatccaaggtagatcttgtagaagaaaggaaaagcaatgcaatggaactataagatgttacattaagaatcaagggaaaaaatctgtaataacgggcaaggaatgttagttgagaatctagaataaggaatatcattacagttttgtgaataattaacatagctctgaggcaattaggtctaagagagaatcatgctgggtaacaaagaaatgtgtgtgtaacattttattaagcagtctaaatctttcttgcatctttaggaattttcttatatgaaaatgttatgacaaaaaataaaaatgaggccaggtatgttggctcatgcctataatcccagcactttgggaggctgaagcaggtggatcacttgaggccagaagattgagaccagcctggccagcatgatgaaagcaggtctttactaagtaaacaaaaattagccaggcatggtggcacacactggtagtcccagctactcaggaggctgagacgtgagaatctcgaacctgggagatggaggttgcagtgagccaagattgtgccactgcactctcgcctgggtgacagcaagactctgtctcaaaaagaaaaaaaataataaataaaataaagaattaaaaaataaaaatataaaagtgaaacttcctcatctactttttatgtaaagttatcttttattttgatttgaagatggaagtgtttcaaatgcaaatgaatgtattttaacattgtatataaaaacctttggtagtaatcactgatattttggtaatatcacctagtgtatcttaatactccactgtgtaacatcagtagcctaaaattagttttgttagtctttcaggaacttcatagtccaaaacagatgctcatttgtaataaatgaggtaatttgaatatatttttaaataaatagataatatattaatattcttcttacaaaaagaaagtaattcagataaggtaggagaaatcaaagggcattctttttacttctgtaccctggaatacttctcttttaacaggtgaatattaacccaacttgattttttagacatacagacttatatatatacatatgggaatacataggtagtttaacttcctgtatttttttaaacataaattgtttactctgtatgcattctgaagatttgcaaatgaaaggaatgccatagtttgaccaagagggttttatctccagaaagaaaggatgggctgtttcaacatttaaaaactccatgttaccaaacagnnnnnnnnnnnnnnnnnnnnnnnnnnnnnnnnnngataatttccaataggtgcaaaaaacctttgataaaatttaatacaatctttcttttcctcccattagaaattgggacaaaatatactttgtttattttctgtgctgttctgaaagtaacattttttaactgcgaactcattacaagttagttgaaaaatgaacaaagaaagaaaaatcaccgatgattgaactactgagaaatacacatgtgtattttcttggatttactgcaactgtttctactgaatttattgggaacatttttgacatactaaatttttttctccaaaagaacatagtgtggaggaattatattttgtttaactatttcctcatgttagaacatttaagttatgtgtatcttaaattatttccatgagatactgcttagagttaaaattgctgggccagtggaaagttttttttaatctgtattgtgatctgtatagtaatctgtatggtatctgaaagatactatagcagtggtctgtgaatttgagtttttatttatgtatgtgacatgttgacggaaaagtagttggagaaaactacatgaattgtttcatataaagcaacttaactttttacattttgtagatgtttttaaaaatggctttttttacttttcagaaaaccagacaaacaaaacaatagatgcttctgtcagtaagaaagcagctgatagcacatcacaggtaagatttttccttcttcttcaaagtaaaatcctaattatggtccacaggaaaatgaattttcatcattctttgattgaatgaaaattgttctatgtgtgttttttataactatccaaacattgtctcacagcttctctgtaatgtttgacaagaattgaggtttttgtgttttgtcttgttttgtttttgcataacagttctcttagaggtaataattagtttattctattaactgactgatttgattaatacaattgacaatccagtcatttgcctttacatactgtaaagattgtctgcaaaaagaaaacacatgtaatttcttccaggtacatcttttttaagagtgtctcattggtttaccttcacttgtaccacactctacccctaccacctttttaatttccccaaaggtaatcagaaataccttttgaggaagaattttttgtctgtctgcttgtttactagcactttgccagtctttgtactttttcatattaaatcttaaccacccggtaatagaataactacttctttcctgtattaacagtgttcttccttgttctttatggctttaggtgtagtgaatttatagtgattagattgttgatagttttattttattttcttcacttcctttgaatcatttcaaggagctcatatattcccagcagaacaaaaatctcgagcatgtcaggcatgaaaaaatgacaagaattttaaaacaagggcatcatttgatctttaaatatgactattttctttaaaaacgatggattttgaccaacctagatgtacaccatagtttatagatcaaataaaagctattaaaaatatcttaacttcttacaaatgttagcagtctttgtgtgcagtattagagatcagagttgtgattgtttctgagcatgtcttgtgggttataactatgttttcaattaaaattataagattgagatactttctggaagatgtatagaaaatgttgatatattcagtgatacttaagtgacatttataggaagtctagttaaactttaaacaaaggatttatgaacatctctacttccctcagtgagttttttttttttttaacaagtaatattttcaaggaaaggaaaatggacattatgatggctgtcttttgtccttttgtaaatggtggttcttctagagctgtgctatctaatatgatagccactagtcacatgtagctatttaaattaaattaaaaatttagttcttcagtcaaaataaccccatttcaaggttcagtagctacaaatggctagtggctagcatattggaccacacagatacagactgttttcatcattgcaaaaagttgtattaaactctattgtatagaatattttgctgaaatatagtatatgtggctgggcatggtgtctcacacctataatcctagcactttgggaggccgaggcgggcagatcacctgaggtcaggagttcaagaccagcctggccaacatggggaaaccgcaactctactaaaaagacaaaaatttgcctggtgtggtgacgggcacctgtaatcccagctacttgggaggctgaggcaggagaattgctggaacccaggagggcggaggttgcagtgagctgagatcataccactttactccagcctgggtgaaagagcgaaactccatcccatctcaaaaaaaaaaaaaaaaagaaatataatatatgtaacatcataaatacataagtgaaattaaaatggatataatataagacacttgaggtggggtgtagtggctcacgtctataatcccggcactttgggaggtgaagacaggaggatcacttgagcccaggaggtcgaaaccaacctgggcagcaaagtgagactccgtctctataaaaaagaagaaacttaaaaaaaaaaaaaagacacttgaaacaggaattgacttcatcagaaagcaaagcaatagtacaaattaatattaagctctcaatagatattttatttggcttcaaggaagaggaatttaatatctgagtataaaaaatgcgtacaagcagtttgagcagctagcctgctgaagcaatgccttatcaaaaataacaaagtttcagttttgaatcagtgtcaattatgtatatgaataataaatataattacaggagttttattgtgtaataagaaaccataatggaagtatatatgtgctttcagttatgaagttatgcttgtcagccagaattttttgaaacaaatatcatttttgttattgtgatgaatacctttattaatgttacactattgactaagaagttgttatctttttaccctaatgtgcaccttgctagcagatagaaactagtgtgaaacaggtagcctgtgattctttgaattgtcacattttaagtacaattggctaacttcatttttctgtcccaagcctacttagttgtacttgttaacactttaaggttatttagatcggaagaaatctggatgtctcaggccaggtgcagtggcttacacctataatcccagcactttgggaggccaagacgggcagatcacttgaggtcaggagttcgagaccaggctggccaacatgtctctactaaaaatacaaaaattagctggtcgtggtggtgcacgcttgtaatcccagctacttgggaggctgaggcaggaggatcacttgaacctgggaagaggaggttgcaggttgccaagccaagataatgccactgcattccagcctgggtgacagaatgagactgtctcaaaaaaaaaaaaaaaaaaaacttggacatctagtgtggaaatgcttgtgagctgtagttaattagcaaatgatgaaatatgtaaaatactctttctgtagttgttaaatgaagatttatctgatatccccaaataagtatttattaacatattgcatataatttattattgtatattttattactatatatcattttatataatgaattgttttatatagtgaaaaacaaatttattcaaattatcaacataagctataaaatagtgttgctatctgtaattgttgttttgaaggactcaagattcacctttaagtttgctgatttgctagaaggatttcataagacccagtagtaggttatactcaccattatgatttgtcacagcaaaaggtatagagcaagagcaacagggaaaaaaatttgcagagttgaagttcagagagatcaggcaaagacttccaagtcgtctgtctgggatcgcacagaatttgttttttctctggcttattaaccttagagacatgtgccaagagtcttcccagagaagcctgactgagtctcagggtctgaggttttttggaggtctggtcacatagtgacatttttctatataagtggccatggcattggaaactcaggatcccaacaatgaaacccaagtgtacatcatcaatcttcattcactgttcagagtgtatataagagaattaattgttaacatgacttccaagggcaacgttcttgataactaaccaagtctcaattatgggtccaagttcccttggagagatgtgcaaggaatgaacaaccagctcttctgcgtgaactctttcttcacatttgctgaagtgtgcctttcaagtatattcttgtttcattacaaaaaagctacaaagccaatatgtttgctctcttgaaattttcttagtgtttgcttattgagactggtcgttttggaaaacgacacatgattagctaagtttttaataaaatttctactgttaaaaactatttgatataattttttaatgatttcaaactgaaggtttcagtttgtaaaaacataaacgtgtttctgattagatttctcagacaatgttttgtcaggaaaagatgtaaagatacatgtatatgtatacatgtctctgtttgttcatttccacctggtggcatagaaataataaggtctacagtcagacagcctggagcctgtcacttaatagtgggtgctttggcaagttattgaacaccttagatttttcacttataaagtagagctagagctagtacttaccacatagaaatattgggaagagtaaatgtgttaatgcatgtaaagcatttagcacagagtctaattggagtagtgctagctatcatgactatcttataaatgtagttaatagttatggaaataattaccaattttatttgtcaaaaaagaaagtctattcaggaaactacttgtagtatatgataataaattgtatctgtcagtttatgatcaataaaaatcataatttatcattaggtcattgcttgtagatcttcttgatctatataagcatttaatgatacacatattcctctgagcactgctttgcctgcattccataaattttcatgtgttgcatttttatttcatgtagttccttgtcatttccttttgggtcctgggttgtttagttagtaatttgtttaatttcgtaatatttggggattttgcaaattttttattattgatttttcatttaatgctattggatttagaaaatatcctctgtatgactttgttacttttacacaaattaaatatgtgttataaagccccatctatggtatatatcttagtgaatgtaccattacacttgaaaagattatgctgctattgggtgtaatgttttataaatgtcaatatagcatggttagtagtgtaatttggattatttgtatgtttactgattattgccttttgctgtagtggttttatctattactaagagtggtatgattgtgaatcgatttcttcctttaattttgtcagttttgcttcataggttttgacactgtattacatggtgttttttatgtataatttgtaatcttgccatacttttatcattataaagtttccctctttgtctctctgacattaacatagttacagcagcatttttttttaactcttaaagaaaaaagtttaattgagtcacagttccacagggcttgggaggcctcaggaaacttatagtcatggcacaaggggaagcaaacatgtccttcttcacataagggcagggaggaaagaatgagagcagagcaaagcgggaagccccttacaaaaccatcagatacttgtgagaacttactatgagaatagcatgggggaaactgcccnnnnnnnnnnnnnnnnnnnnnnnnnnnnnnnnnnnnnnnnnnnnnnnnatcagaactacaattcaagatgacatttgggtggagacatagccaaaccatataaggaggtaggaccctgtattcattatcttgctacttttctaagttacctgtgtgtatagagtttaagaaatgatcattggaaaaaggcaatgatgctcttggaggaatgcagatctaacaattgaatgtttaaaaccaatattccatgtatattgtattaaaagcctttagaataaaagtatctatccatatttattttttaaagccaaagtgtatattagtgccacatatatcgtatagccttatagtgtagtattttaaggacatcttaactgccctctaatgccttgaaatctggctacatatctgacttattaccctgcccctaattagtagtgttttatgctaagtaagcatccttatctattgaataaatgctaatagtaaatgatgagacaaaagttgccatcaagttgcgtttttatgaaaaaaatgtggttatgaaaagcatgaaaaagcatgattttcatttataaattagtcacacatttctttgttatttagaaaataaaaattatactaattagcaatcatttatcagcaccaagtgaatattctgtcaactgtttgaccttgtagttgctattgcccagcttgaatgtgtgtagggatgtaggtatatacgcatacctattttcccacctgcaccccaccagtaacttttgttgccctttctttcctgaaaccaccctggtccagatctttcccatttttcttcaccttgacttcttaataacattcagcaccactcagtctccttcctttttgaaacattagtttctcttggtttccatgccattcacatgcttttgattttcctctacatctcttcttgggagatctcattcactcctgggattcagttactgcatatattcttatgtctggcatatttaaacctctagttcaaatctctgttcatcttcagtcatccatatatgtatatgaatgtatgcacacacacacacactatattaatctcttctcacattgctaaaatgaaatacctgagactcagtgatttacaaagacgaggtttaattggctcatggttctacagcagcatttttatgtttactgtttgcatgttacttttttcagctttttactttcaatctgtgtctttatatttaaagtgaatccgcaagagaaaaaaaatcatatttcttgatttgttgctgtgttatcccatctgataatctctacattttggtcggagtttttagaccatttatagttaatataagtattgataggattgtgtttaggtctgctattttgctatttgttttctattcatttcatctgttttctttttttgttggtttctgtgtaccttctttcctgctttattttgtatcagttttttttaaagcattctgtcttaattcctctgttagctttttagcgcgctctctgtctctctgtatgtgtgtgtgtgtgtgtgtgtgtgtgtgtgtgtgttttaggggttgttctagagtttacagtatgtatctaatcttaattataggaaccttgcaattttatgtgtacatttacctccttaatgaagttgctttccttaaatatgacgttcatgttttcacatatattgtggtcttgtttgcacatatattaccttgtttttaatcttcatgttgtagatctctaaatatattgtttttaatttttgccttatagaattttaaagaaattaagaacagaaaatagatatagtctttaatatttatccttatgtttaccttttctggtcctcttcttcctatgatccaagttggtatttcctttcaaactgaagaatgtccttaagctcatctttacagtgtagatctgctagtgatacattctcttggttttttagtatctaaaaaatgtacttttgtatcttttgtctccttttttcaaggagagcatcattggatatagaattcttaaagggtttttttttttttaaattatcggcactttgaatatgttgttccagtgtcttcttgcttccatagtttctgaccaatagtcagcagttactctttgctcctgtataacgtataatttgttctgtttattttcaaaatttttcattattggttttcagtatttgaactatgatgtgtatagttatgatttcttagtgtttcttctgcttgaggttcgttgaacctcttggatttgtaaactaatgttttccaccaaatttgggaagtttttggttattattcaattttttctttagatctttgtttcttctcatttagggttttgctgaactgtttcttattgcacaagtttcaggcgtttttcatattttcttctgtttttctttgtgtcctatggactagaaaatttctattgatctagcatcaatttcatttgagtttttcctgccccctccaatctgcttttatgcctacattaagctaatttttattttagtaattattttttcagctttattatttctttttttttcagtttctttttctcttttgaaatttcctgtttgtgcattcgttattattatatttaattctttgaatttttttttttttttgagatggagtcttgctctgccacctaggctggagtgcagtcgcgcaatctcagctcactgcaacgtccgcctcccaggttcaagcgattctcctgcctcagcctcccgagtagctgggactatagacacccaccaccatgcctggctaatttttgtatttttagtagagatggggtttcactatattggccaggctggtctcaaactcctgaccttgtgatttgcctgcctcagccaaccaaagtactgggattacaggcgtgagccactgctcctggctttaaacatatttttaatagctactttcgagtctttatctgctggatgtaatatctggctctgcttagagtcagtttgtattgacttattttttcgtcctaagttagttccacttttcaaagctggaccttaatgataatatgttgtagtgaaagattattttacatttgttgatgatttttgggatcttttagtttgggattttatagatttttggtgtttgtaaataacccattttctgtgaaatcattattgtagaaagatttataagaatgagaattgcattattgtcttgggattgggcctggatattataaagtcaaggcattattttctttaatttctcaacttgagtatcgcagatgaaaccctttatcatttggagattgatctcagtataatatatcaaagtaaattgtgattatcagttattaagcaattgccatgtatcatatatggtgttaagcaccttatatacacatttggattaatcctcacaatagcctcaatattcaaatattggaaattgagataattacccatactgaatcaggtagctaataagttagaactgtaagacacactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaactgtaaacctattcctagttattctgcagtgttaataggtgtttcatgaatataaagttccatggttaagtatgtttggaaaatgctgagtttaaagttaaattgatttttttcttaatgcagacttctctgagcctttactatgctaatttataatgtaaatctccaagaatgatttaagatataaagtatttctcaaacttacttggctgtgcaaaataacgttcagctacatatctataaaactggtgattattgcacatggaaaatataatatcatgtgctgagttacttcttattatcttaaagacattacttttttctaaaacacccaaatattttaaaaataatattttggggaatcagtctagttgagctttggaaaacaaaagttaaatagctgtacaactgattatatgacagtaaagtcggttttgttatttaaaactgaattgagaaatgtatgccatccttcatccgggttgaactcaagccagtatgattattctttaaaagtttcaaattatctctattgctttcacttatctctattgctttcactaatttttaatagacagccatgactattataatggatccctaaagaaaaaaataaatacaggtttttgagaggacacaggtaggcttaattctggattaaaaagtaaagtcctaaaagtttgttttcagtgctctcaccatttccctagcatccatgcctcatggggtctttttgttgccccacctttgggtctgtctcaaattctcacattcctaaagcacactgttttccaatggcattaaagtatccattgttaaagccttgggttttatttacatttagtgtggaattctataggacagaaattgatggggattattttggatagaaggacttttgggtcacaatcttcatagtggtttcctgtttttaagagttttttctgagatgcaaatatttatttcataggctattgaagaccttttttgagattagtcattctttgactattttaaagactatatagtgatgataagcaactatctgttatcaaagaacctaaataattatagtaattgaaattcaagatcacagtgaaaactcatcagtttatagatatttgtctagaagagtgttcttcctataggtaggtagattatatatttatgcaagtaatgagttattctagttgacatattgtactgatttacaagtaagattatttctgaatttctgtaaacgtgaatttgaatctgtgatagaaccaccagcaaattacatatgctcttaactcagttttcaaatcagcaaaaatacacgtaagcaaaatggaaataaattattctcttagaggtaaatgtgacacacaagtggcaagcaaaagtaaaatttgtccatagaggaaagacttgtatttcctgatttttttcttgtcagtcataatatttcacttttaactaacagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacaggtaaatttgttgaatcattgagtagaagctttggttttgcctgtagagaactatgactatggagttaagtggaaagataagacagaaaattaatattcatcttgttaatttgaggactacagtgcatgtccttttgaaggcagtataacttagtttttctgactgtcttaagcagcggcactggtaaagaatgattttaaagaaaagtatatatttatttacttaacattatataaataaaagtggaggtaattttaaaaagcattcacatccaaaataataatattctgagttataatatttagaaactgtaaaccatattcctagttattctgcagtgttaacaggtgtttcatgaatacaaagttccatggttaaatatgcttgggaaatgctgagtttaaagctaaattgatttttttcttgatgcagacttctctgagcctttactatgctaatttataatgtaaatctccaagaatgatttaagatataaagtgtttctcaaagttacttggctgcgcaaaataatgttcacctaatatctataaaactctggtgattactaatgcatgtggaaaataatactattctgagttatattcttgagaccagcctgggcaacacagtgaaaccccgtctctacaaaaaatttaaaaattagcagatttgtcatctgccacagcaaatgttctgtaaatggcagaaatgactgtagtttctctggaagggatggatatgacttattctgagtgtaaccaagaagttataactgactgatcaaacaacaatttttaaatgtgtcttatcttgaaatagctttaactagtctaacactaccaccaggaatcatatgcttgctacctttcaagaagctgtaaattcaaaattttcaagatttagcctgtatctcctaaactgttcagaaaccaatcaacatggtttgtcttctgtatagcagcagtccattgcttgaagatttatctgcacagtacttatataagtactcttctcattaaggaaaacattgaatttaagtggggttttatccagtgaaatttatacttaaaacaccagatatcttgtaggaatcaggatattttccatagtgatttagcaaactatttgttaattaacctttgagttatgaaattattgttgatgcagcaaatgtgtggttgttttggtagggactgtttagatttgttgaatttcagaatcttagatgcttatgcagactttcctatcagttaaaataaattttaccttgttggcatttccaggcaaaagaatgtgcctatgtgactttatttctggtgtgtagattttatattggttctcatatttcaataccattgttctatctaaataggcagttataagtaagttcaaccttgggagctgtattatctgtctttctttacatttatacaaagttataatgacagtcatcaaaattagatattttggaaggaaatgtcattattcaaacccatgggcagtgtagattatggaatggggagtaaagagatgaaaaaataaatgttctttcttgttaatactttcttctttcttcccgtttctgaagactcacatcgaaagttagtatctgtaaagactgaagagtctttagtaaagaaaccgttttatctttgttatagccagtattttcctccaactttatttttttataggacccattttttccataagaaagtagattgatttgttactttttattatatagttactatgtggtcatttgtaagatatgattctaattcagagagttgttaacaagaaagtgtcactaaaaatcattattatagatacatgctgtcagtgaatgtttatgactcattttttgataaatatttattaacattactcaaagtattaatgctttctggaacatacaataggaggaataccagagtagagaagggagaagtctgttgtttaatggattttatttactgttttaaaaaaagatagattggttcagctaaacaaaatgtgaattataatggtcaaagagataggttggctcacttgaaaaataaatgtgaattaacaatagctggtcagtttcttgatctttgggaatacaaaaatactcttttggatttacacccccttggtagaaggccgagagggcttatgattctactttgctaagaacaattaaaattaggaggtttttctcttttaagtcactcctgtggcatcatactcttaattctgcacctttttaaaaaatcttcacattgcttattatctggtcaaaccagagtgggaagggaattggatgtggtggagatgttcttttcctctgaagcttggattttaatattattaatgtttattggccctatcatttttatcttagaagatcataaaaggagactgttatttctgtttctgtctttattagttaattagattttatgcaaagataactgccatttaatactgtttgcttaacgtagaatttactgtattcttaatatctttttctgccttgcattagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtaagagatttttcttgtatatggccccaagatacatgtagttctcttcagcatttagttggaatggcatataataatgttaaattttgcaaaaatttcttataatgtcatattaaaagtattgttataagttcaagagatctgtactacaacatagaaactatagtatagttaaaatcaatgtagtatattcttgaaaatagctgatagagcagattttaagtattgtcaccacacacaaaaaaggtaagtatgtgagatcatgcatatgtcagttagctagatttagccattctgcagtgtatgcatatttcaaacatgttgtataccataaatatatataatttttgtcaattaaaaaatagttttcaaaaaagaaatggcagtataaccaaaactaatctattattatttttcttcccttaggagagttaaacagagaaaattgttgatgtatactagttgatttgtgctctgagtgttgtctttaatttaactttatttatggcctgtattagtatagtacacaatttgatattggtatattctctactctattaagaaacaccttacctagttagagtgggaatggtcaattgtgatttaccccagatgatggaaatcatggtaaaggatagccttcaatgagagtcttaaagatatggaaagtggctgagaaaagaagggaaaatgttaaagaaagcttgtagtttcttgtatatatcatatattagttacatacatatgttacatgcatgttacatatgtagatgacattttaaaattatatattaaccacatgtatataagcagtagtagaatatatcacataaacacaagcttatataaaaggtatatttaaactttaaagtaaagaaaaataataaaatgaactacgtatgaactcttcatcaggttaagaagtagaaatttttcagtatcctgtaagtggtcttgtattcctgtcttgactacatcccttttcctttccatcaaaggtaaccactgttcctacttttctattagtcattctgcttttctttatgattttgccaccaaaattgatatcatttaaacatactagggttctctagaggacagaactaacaggataaatagatatataaaggggagtttactaagtattaacttacatgatcacaaggtccctcaataggctgtctgcaagctgagcaaggaaagccagactgaatccccaaactgaagaatttggagtccagtgtcgaagggcaggaagcatccagcacaggagaaagatgtaggctggaaggctagccagtctctccatttcatgtttttctgcctgctttgtattcattgacagctgattagattgtgcccaccagattaaaggtggatctgccttctccagcccattttctgcctgctttgtattcattgatagctgattagattgtgcacaccagattaaaggtggatctgccttccccagcccactgactcaaatgttaatctcttttggcaacaccctaacagacacacccaggatcactattttgtatccttcaatcaagttgacattcagtgttaaccatcacaagtccaccccttgtcaacttgaatccatacacatctcctcagatcatacatattcttcaaataaagagagtaataaggccataattaaacctaacataatacaactatcctttgtacaaccggaaacacaccaatccccaagccaaatactattacataaagttaacaatacttaaatgttggtaggaagtcaataaatcttatgttacgtgatgaaggaaaaggaaataaagatattttcttgtacaagtgtatacatgcacaaacatgtttttagcaaaagaaggaggaaatactcatgacaattacagtctctgagttggcaactggtcacatggtcctggctggtattgatgactaccttcttctactacccattctgtgttctctttgccttcagcaagcacctcagctggtcgtggtttattcctggtggaatgacccaaaccttcattcttgagtatttttattgctgcctaaattgagctattatagtttcctattggccttaatcacagggcatggtaatactaagagacaccctaatggatctcctgtattccatgcatactcttccttacctccgttgtggagcagtagactaacttcttcttggtagtccgggacagtcaccacaaccaacactaactccttcgctagcctgttgacttaaaggtaagaggagcccaaagtgtccaggtggcaatcttaagttccagtttaatggaatcattttgtctcctggtgggagcgttcctccctctggaactaagacctctaggccagcagaaagtaatgtcgcaggaacaggaagcaaaaattttgctagtggatccctaggggtgaaggtgagtggtgctacttccacttccaccccctgattcctggacccatgaatcctggctatgggagaaacagcaccatatataatggatgctgattcagagcatacacggccttctggagaactttgccccagccctgcaaaatactgtcacctggttggggttgtaattgtgacttcaaaaggccattccttttgaatgcttcaggacaaaggggaacatggtaagaccagtggattccatgagaacgagcccactgctgcactcctttagccataaaatgagtgctttggtcagaggcagtgctgtgtggaatgccatgacggtggataaggcattctgtgagtccatggataatagtcttggcagaagcattgtgtgcagcataggcaaacccatatctggagtaagtgtctattccagggaggacaaacctcttccctttccatgatggaagaggtccagtataatcaacctgccacccggtagctagctgatcaccccgaggaatggcgtgctgtatcgagggctcagtgttggtctctgctgctggcaaattgggcactcagcaatggccatagtcaggtcagccttggtaagtggaagtccatgttgctgagcccaggcatcacctccatcactgccaccatggctaccttgttcatgggccctttgggtgatgacaggggtggctggggaaagaggctgagtggtgtccacagaacaggtcatcctatccactggattattaatatcctcctctgctgaggtcacccgttggtgagcactcacaagggatacaaatatcttcatagtttttgttacaacccataaatatatataatcatgcatctggccatctacccttccaagcaaagtgcacaactaggtgtgctgcttgaagttctgccaactgggaatatttcccttcaccgatgtccttcagggatgtcctagaaaggggctgtagtgctgcagctgtgcactttacagtggtgcctgcatatggtgcagaaccatctgtgaaccaggccctagtcatctgttccgctgtcaagtgatcatagggacccctgtgaggccatcagtacaggctggggaagagaacgcagggtgacaggagtggagatatgggcatttgagccacttcctcatgtaaattacttgtgccttcggaacctgcttgagcccaatcacgtatatactgcttccatttgatgatggaatgctgctgtgcatgacccactttatggctaaatgggtcagaaagcacccagttcatgatagtcatctcaggtcacatggtgacttgatgacccatagtcaaatgttcagtttccaccaaagcccagttaacaggccaagagctgtctctcaaaaggagagtagttacctgcaaaagatggcagggccttgctccaaaatcctggaggcctccactgtgattcatctatggggtcctgccaaaggctctcacagcatccctctctgcccctcacacctcaagcaccattgaatctgctgggtcctatggtccaagtggcagaacagcttgctcagtagcatggacctgttgcagagccttctcctgttctggaccgcactcaaaactggcagcctttcaggtcactcgataaatgggctggagtaacacacccacatgaggaatgtgttgtctccaaaatctaaatcggcccactagatgttgtgcctctttcttggttgtaggaagggccagatgcagcaactagtctttcaccttagaaggccccacaccactggaccctagaaattttactgaggtagaaggtccctgcatttagtaggatttatttcccatcctatggcacacaaatgtctcatcagtaagttcagtgtttttgctacttcttgctcacttgatccaatcagaatagtgtcatcagtgtaatggaccagtgtgatatcttccaggagcaaaaaccgatcaaggtctctctgaataagattatgacacaaagctggagagttgatacacccctgaggtaagacagtaaaggtatattgctgtctttgcccactgaaggcaaattgcttctggtgggccttatggacagaaatggagaaaaaggatttgccaagtcaatggctgcacaccaggtactaggagatgtgttaattttctcaaggaatgaaaccacatctggtacagcagctgcaattagagtcaccacttgattaagcttacagtaatccactgccattctccatgatccatctgtcttctgcataggccacatgggagaattgaatggggatgtggtggcaagcaccgcccctgcatctttcacgtccttgatggtggcactaatctcctcagtacctccaggtatgggatatagtttttgatttactattttttagaggcagctctaatggcttccatttgacctttcccaccatagtagccctcaccctaccagtcaaggagccaatgtggtggttctgccagctgctaagtatgtcagtgccaattatgcattttggcactggggaaatgaccacaggatgaatccagtaatccactggacccactgtaagtcagacctgagataaaattccattaattatctgacctccataagcctgtactttaactggaggaccacaatgatgctttgggtctcctgggatcaatgtaagctcagaaccagtgtccagtagtccctgaaatgtctgatcgtttccttttccgcaatgcacagttaccctggtaaaaggccagagatctccttggggaaggatgggagaaagattcactgcgtaaattgtcaggaatgtagtggggtctttcctcaaggggacgaggcctccccttcattcaaggggttcttggtctgtaaactggctcaagtctggaaattgattgaggggtcatcattctgtttttattattcaatttagtcttttgttccattgacctagaagttttttggttatataaattaagtaggaatgcagtaggcttcctatcagtttcatctctaggaacactgtgattaattatccaatgctagagctctatacaagtcggactcttctaactgccactttgcctctgctgtccattacggtagctacgcccaccttgcctttgacagttgagtgccaccacttggcccctgccaacttaggatccagttatttccattgtatttaaattttgtagttcagtgactaaggttcccaccgttagatctgacatacagagacgagcaattagagggctcttcaaagatacaagtgctgccctcacaaatctgtttcgcaaggcattggtcaagggtatatcttctggaccctcccagctgggatgactagctctaaagtgactgattcactctaccatcccaatctccttagtctttggatcccttcctctacattaaccaagggagataaatcatttccagctcactcacagtgtgccatcttttaatccttatttcaactaaccaagcaaataatctattagaaccttttttttttaactccctgagctgcaacattaaatgcagagtccctacttagtgggcccaaatcaagaaattcagcctgatccaactttgttccttccatcataatcttatacccttaatatccatccccatgcctgttctctaggtttctgtttatgtaaattagagaactcaaaacagttctctgagtgtagcatacctccttataggtcacaccttcaacctcacctctaggggcccaccagtactttagtgtagttatacatctagaagcaaagagaggtgtttggaggggctcctgagaagagtcaacattgtcttacctggcaactgcctcagaggaggccatcactgttgcctcacatatcacaggctttatttcctcagacaaagttggaaagactgatggcagcatggatcagggagggtacgttgccctcactgggtgtagggaagctgttccaatcaataccctcactttaactgtagacacctggtgagtctggtacatgcctcttttgttgtaggttagccaattgtatgataagagcttgtgtctgtttttctacaatttcagctctttctctataggagataactgtctctcactcaaggcagtcttagcagatttcaggctcagtatttgcttcagaagccaggagacagaatccctgagttcatcattttcttttatcactttgtccactgaacttaggaggaaccgaccagtttcattatgttccttggttctccacatatggtccaaggtatcgtgtatagagtccctaaactccttgcttctcacaagtggtgattcaggagtgtcaaatgcatttattttgcataactctctaaacagttcatgccaggtactatcagtgttctttatactactagaagtagagtccttagcatttgtgggtctaatcatattaagcagccaactccagaaaccccaaaatcaatgaaagaactccatccttaatattcggttcttctagacccccaatcctggtaccaaaatctgaattagggttctctaaagggacagaactaataagatggacacacacacatgcacacacacacgtatcctataaatttgtagatatagtatatttttatatatatctatagtataaagagtagtttatgaaatattaacacgatcacaagatcccacaatagtctatctgcaagcttaggagcaaggaaagctagtctgacacccaaaaacagaggaacttggaggccgatgtttcagggtaggaagcatccagcacaggaaaaagatgtaggctgggaggctaaggctaagcctgtctctccttttcacgtttttctgcctgctttatatttgttggcagctgattagattgtgcccagcagatgaagggtggatctgccttccccagcccactgactcaaatgttaatctcttttggcaacaccctcacagacacacgcaggattaatactttgtgtccttcaatccaatcaagtgacatttagtattaaccatcacaagtctaccgcttgtcaacctgaacccatatacatctcctaatatcatacgcagccttcaaataaagagggtaataaggccatacttatgcctaacataatacaattatcctttgtacaaccagaagcgcaccaatccccaagccaaatactattacataaagttaacaatacttaaatgttgataggaagtcaataaatcttatgtcacatgatgaaggaaaaggaaataaagacattttgtttgtacaagtgcatacatgcacaaacatgtttttagcaaaagaaggaggaaatactcatgacaattacagtccccatttctgcaactggtcacatggtagtagctggtattgatgactacctttttctactacccattctgtattctctttgccttcagcaagcacctcatctggtagtggttttactcctggtggagtgaccccatccttcattcctgaggggtctgggccatttttagtgctgcctagattgggctgttatagtttcctgttgacctcaatcacagggcatggtaatactaacagacgccttaatggatctcctgtattccatgtatactcttccttacctccattgtggaacagtagactgatttcttcttggcagtccgggacagtcaccacagccaacactaactcccttgttagcctgttgacttaaaggtaggaggatcccaaagtatccaggtggcaatcttaagttccagtttaatggaatcattttgtctcctggtgtgagcgttcctccctctggaactaagacctctaggccagcagaacgtaatgtcgcaggaacaggaagcaaaaattttgcaagtggatccctaggggtgaaggtgagtggtaccacttccacttccaccctctgattcgtggacccatgaatcctggctatgggagaaacagcaccatatattggacgctgattcagagcatacatggccttctggagaattttgccccagacttgcaaagtattgtcacctagttggcattgtaattgtgacttcaaaaggccattccaccgttctgtaaatccagctgcttcaggacaatggggaacatggtaagaccagtgaattccatgagcatgagcccactgctgcacttactcagccgtacagtgagtgccttggttagagtcaatgttgtgtggaataccatggcattctgtgagtccatggatagtagtcttggcagaagcattgtgtgcagcataggcaaacccatatcttgagtatatgtctattccagggaggagaaacctcttccctttccatgatggaagaggtccaatataattaacctgccaccaggtagctagctgatcaccccgaggaatggcatgcccgagcgagggctcagtgttggtctcttctgctggcaaattgggtactcggcattagccatagtcacgtcagccttggtaagtggaagtccatgttgctgagcccaggcatcacctccattactgccaccatggctactatgttcatgagcccattgggcgatgacacgggtggctgcggatagaggccgaatggtgtccacagaacgggtcatcctatggacttgattattaatatcctcctctgctgaggttacccattggtgagcattcacaggggatacaaatgccttcacagtttttgaccacttaaagaggtccatgcccagagctcttccccaaatttctttgtcaccaattttgtaatgatgcttcttccaagtccctgaccatccaaccaaaccattggctacagctcatgaatctatataatcacacatctagccatttctctttctaagcaaagcacacagcctgatgcactgctccaagttctgcccactgagaagatgttccttcactgctgttcttcagggatgtcctagaaagggactgtagtgctgcagctgtgtacttgccggtggtgcctgcatatggtgcagaaccatctgtgaaccaggacctagtcttaatcttcccactgtcaagtgatcacagggactccccatgaggccattggtgcaggctggggaagacaaggcagggtgtcagaggggagacacgggcatttgagccactcctcatgtaaattacttctgccgtccgcacctgctcgaacccaatcacatatataccacttccatttgattatggaatgctgctgtgcatgacccactttatggctaagtgggtcagaaagcacccagttcatgatggtcatctcaggtgacttgatgacccatagtcaaatgttcagtttccaccaaagcccctttaacaggccaagagctgtctctcaaaaggagagtagttacctgcaaaagatgacagggctttgctccaaagtcctggaggcctccaccgtgattcacctatggggtcctgccaaaggctctgacagcatccctctctgcccctcacacctcaagcaccattgaatctgctgggtcctatggtccaagtggcagaacagcttgcccagtagcacggacctgctgcagagccttctcctgttctggaccacactcaaaactggcagcctttcaggtcacttgataaatgggctggagtaacacacccacatgaggaatgtgttgcctccaacatccaaataggtccactagacgttgtgcttatttcttggttatagaaagggccaaaggcagcaactagtctttcaccttaacaggaatgtgttgacaggccccacatcactggacccctagaaattttactgaggtagaagatccctgaatttggtcagatttatttcccatcctctggcacacaaatctctcaccaataagtccagtgtttttgctacttcttgctcacttgatcaatcagaataatgtcatcaacgtaatggagcagtgtggtatcttgcaggagcaaaaagtgatcaaggtctctctgaataagattatgacacaaagctggagagttgatacacccctgaggtaagacagtaaaggtatgttgctgtctttgcccactgaaggcaaattgcttctggtgggccttatggacagaaatggagaaaaaggatttgtcaagtcaatggctgcacaccaggtactaggagatgtgttaattttctcaagggagtgaaaccacatctggtacagcagctgcagttagagtcaccacttgattaagcttacagtaatccactgccattctccatgatccatctgtcttctgcataggccacatgggagaattgaatggggatgtggtggcaagcaccgcccctgcatctttcacgtccttgatggtggcactaatctcagtacctccaggtatgggatatagtttttgattnnnnnnnnnnnnnnnnnnnncaagcaaataacctactagaaccttttttaactccctgagctgcaacattaaatgcagagtccctacttagtgggcccaaatcaagaaattcagcctgatccaactttgttccttccaccataatctcatacccttaatatccatccccatgcctgttcttcagatttctgtatatttgaattaaagaactcaaaacagttctctgagtgtagcatacctccttataggtcacaccttcaacctcacctctaggggcccaccagtactttagtgtagttatacatctagaagcaaagagaggtgtttggagtggctcctgagaagaatcaacattgtcttgcatggcaactgcctcaggggaagccatcactcttgcctcacatatcacaggctttatttcttcagacaaagttggaaaggctgatggcagcatgggtcagggagtggatgttgccactactggggatggggaagctgttctttctggcaaaaaagcttcatcagaatttacaaactcagtgtccccagcttcatcagggtgcttctacacacccccattccaagtttcagggtcccattcttttccagtcagtgccctccctttaacagtagacacctggcaaggctgtgcatgtatctttcattgcaggtcagacactcgcatgataagagcttgtgtctgtttttccacaacttcagcgctctctctacaggagataagactctcattcagggcaatcttagcagttttgagcctcagtatcttcttctgaggctgagagacagaatccttgagttcatcattttctttcatcactttttccactgcacttaggagcaactgaccagcttcattatgttccttggttctccacatatggtccaaggtattatgtatagagtcactaaactccttgcttcccacaagcagtgaatcaggagtgtcaaatgcatttattttgcataaccctctaaacagttcacaccagggactatcagtgttctctatactattagaattagagtttttaacatttttgggtctaatcacattaagcagccaactccagaaaccccaaaaccaatgaaagaactccatccttaatattctgttcctctggaccccattcctggtaccaaaatctgaattagggttctctagggggacagagctaatagaatatatatatatatatatatatatatatatatatatatatatatatatatgtgtgtgtgtatatgtatatatacacatatgtttcctatatatagtattcatataatatatactatatataaactaataggatatatatattttatatattatatatgtattaaactaatagggtatatacataaaatatatactacatataaactaattgtatatatactttatatcctactatatatatacagtatatcttaattatatataaatattaaatatatgtaaaatactttatatatagtgaatgtttatatatataaaggggagtttattaagtattaatttacataatcagaagttcccacaatagactgggcatggtagctcacgcctgtaatcccagcagtatgggaggccaaggcaggcagatcacttgaggtcaggagttcgagatgagcctggccaacatcgtgaaacctcatccctaccaaaaatacaaaaattggctgggtgtggtggcacaagcctgtaatctcacctacttgggaggctgaggcaggagaatctcttgagcccaggaggcggaggttgcagtgagccgagatcatgccactgcactccagcctgggcaacagagccagactctgtctcaaaaaaaaaaaaaaaaaaaaaaagatcccacagtaggctgtctgcaagctgaggagcaaggaagccagtctgagtcccaaaactgaagaacttggaggccaatgttccagggcaggaagcatccagcacaggaaaaagatgtaggctgggaggctaaggctaagcctgtctctccttttcacgtttttctgcctgctttatattttctggcagctgattagattgtgcccaccagatgaagggtggatctgccttccccagtccactgactcaaatgttaatctcttttggcaacatcctcacaggcccacccagggttaatactttgtgtccttcaatctaatcaagttgacactcagtattaaccatcacacatatgttgtagttttgcaaaatgtgacagcaagggaaaatatagctatttaaagaaacacagtaatgctatcatttagaaaataaactgattggagtccctggatcatagcttggcttcaactctctcaagtttacaagagcgttgtctgggaaaattaatcaacaaggttagaaatgagttctgggaaacttggctcactatagtccaggaaccaggccgaactacagcatgggccaggtactgaataaatggcaggagtatagttagggcagtaggtggctctaaattttctctttttgtttccctggtgtatgtcacagcagttttctgtggggtgaagtgagtatcctcaaccaaggagctgggcatggagaaaatgagaggaacctcattaatacatggcaaggatgacttattctggctttctgtcctggttgaaaagatgagactgcagagatttttatgaagatactcccagtttgtctgtcttttgagtcacactgctccattatggccatttaccttttacatgtggtacacaaccagtgttctaggatttttgttcatagttctcctggtaacgatccatttatttctccctgtgctggacctcctgttgcttgtgtctcgtgtttttctctttattttctcacgtactggtggcacatattctccattgactatttgagaaagggtttgtggtagttagaatttttttttagtgcttgcatgtaagaaagtttttttatccacaggctgattgatagcttggctgaatacgaacaggacctctaggttagaaatatctttcctttcgaatcttgaaaacattgcttcactgccttcaaatatttaatcagttttccaccaaatttacaatagaattatcattttatcctgtaatttttttgtttgtttgtaggtgttacagttcgagtgcctcaaacaaccacatatgttgtaaacaatggactaaccctgggatcaacaggacctcagctcacagtgcatcaccgaccaccacaagtgcatactgtaagtgttgatgcttggttttgcaaaattctcaactgtagaggtataaaatattattgtatttggcatttttctttaaaatggttatatccaagggaagtgttaggtcttcctgctttttcagaagtttatttctaaaaattgatcttaccattatgaacacatagttcctagggatgatgatcatttagaatcattgagtttgcttgtggtgtacagtgtacaaaaacaggtccacagttggggtatatgaagtgaaatatagaccatttctaattcatagttaaattaaaaaggacatttttcatttctccatgtgttaattttattctttcgttctaaactatgccacatctaactgctacattgtcatcaattaattgttctaaagaatccaatgatattgggaattcattagttaagaggtaacagagataaccaaagatttctccttagatttagcctccaaaacaatgtcacattatcctgtgacacaattttgtcagtgtttgactggtatgaaatatcattataatgatgatgatgttccagtgttagaaaagtcaataggacttcctaaagttagagtcatgttttttcatcatctggccttaacctacctttccagatttttcttcatgtaccctatgtccaagaaaaagttaatacttgttcttgtccatacgtcccctcactttactgtccacatgcctttgctcatgctttatttttggctgaaaggtacatgattatttctgcatctctggatcctccttcacagttgagtttaaatatcacctttttcttgtaaattggccaagaatatagtacacatttagtgttaatgtgcttatttataaataacttaaaaatgaaagtatatttgtattctccaattttatatgatcttggttgccatacatgatatttaaaaatgttacatcatactgaaatgataatctgtaacatagataattcaatcataaattattttgttagaaatagatcattacttccgtgttcctcaaaatgatgttccgtcagcaggggctttttatttcctaagaaaaactcaaaatattttaggtctaggaagtatagtaggaataacctcagcatcattgtttgtagcatgattcattacaaaaccccaaatagaacttgccaaatttgatatggtatttggtatttcctagaattcttgatataaaatgatacttctacgtatgttctctaaggtgttttaattctaacattctaaaatagttctttttgcaatcatcattaatcagtgtgacctgtttcttcaggagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaaaccttggagcctttatattttcctcttttaaaatttccaccttttggtcttgtttttaatcttgtgcatgataccccatgtaaaatccaccttgtgcaagatttcttggacagatgtgtgtatacactacatttgtttataaccagaagcaaaataaactcagcccacaaagctagaatcttttcctggacagtttaggctttggggtttggaaatgtaaatgtgtaccttgctttagttttgaggctggggaatatgtgtgggtgtttatgtgtgtttttccttatgtaggtgttattgcattggagtctcccattttcattctcaaatttacctcttaaagtacgaagtaagtagatcaaaggatttgagatgtgtaactggcatgattctgcttttgaaggatctatagtatcattttagttaagtgggtcaaacagaatcaaaacaaaacccaaagaaataaataaaaaacaaaatggctaaatagtttaaaataggttaattcgaacacaggaaaggatctatttgttgtttcttttgtctggtctcctgagttgttaattaggtgaaaaaagatctgcaatggccccctccctttcctaatctggcttttacatttattttgtgccttaaagattaactacaaagataaacatggccaaaaataaataaataaatatggccatatgtccgttgttgcttagtcttcccttgcagccttttacccttgatttctccttcatctctaccaaatatagcacaactcctcaagtaattttttttttttaagatggagttttgctcttgttgcccaggctagagtgcggtggcacaatcttggctcactgcaacctctgcctcctgggttcaagcaattcttctgtctcagccccagagtagctgggattacaggcacctgtcaccatgcccggctaatttttgtatttttagtagagatggggtttcaccatgttggccaggctggtcttgaactcctgacctcaggtgatccacccgcctcggcctcccagagtgctgcgattacagttgtgagccactgtatccagcctactcaagtgatttttaaaccaaggtgtgtgtatgtacatggatgtgtatgtacacacacacacaggtgcatgcatagtctcatcttagccgggcatggtggcgacaatcacatttaactccaaaaatttgacgtgctattttcttctaaaactatagatgcttttatttttggtcactatttaactttgtgtaaagtggaccaagagaaaaccatattgtggaagacagtttttcacacattttagtatccgtgttgcacactgtgttagagattatgaaaaccattctagttcagtttatcacccaaagctatcacccaacactaactccttagtattctttcaaaggaagcaaatagtaagattacaatatagaatgagctaaaatatcaaggggaaagcttcatttcctctttattctctttatcgtccttcccattttaaccttttaactttgttttgatggtgccaagttgagtctgatgtacccattgttagctttggatagaatttaaagtatatcccagaattagctgggcatgttggtgcatgcctgtaatcccagctactcaggaggcaaggctggagaatcgcttgaacccgggaggcggaggttgcagtgagctgagattgcgccattgcactccatcctgggagacaagagcgaaactctgcctcaaaaaaaaaagaatttaaagtatatcctttgaggtcattttatgtaacaattagatataacctcctgtgtatctctctgttcctcttcaaagttattaaaattcagcttaggtcatggatttttaatatgagggccagctgtactggtgtcaggtaggtgttttgggtgtagataatttaggactggagggctgagttaagttttaggaggagaatgtggttgagaatattttgaaaggaatttatggagtttgtgaaataacttcgaagtcctcttcctttacaatatttgaattcatatttgtaccttctcaaaatagtgattcatttttcctagaattacaggagggagctcttttactaatgttgttttgtttgcaactttgatggcttataataggaagtattctagttgtaaagaaaactctttagagacttttgactggtcagtatactgaggtgtgagatttgattcatgatgaagaaagcctatagattgccaaaaaattaattctccaaaccacctttcactctcagaaaatgagaccacaaaggagtatgctataaatcaaatttgccaaccaattatgtagatattactcattctaggactaatgatgatggtaaagaagttgccagtgttatggcaatgaaaatttcagaaaggaggagttgatgatcttctagatgtatatgaacacctgtctatatctgcatgtatatgttttgacctgcagtggttgcaatgttgatatgtgttcaagattattcctgtctacaaaactgaaggcccatgttcaaattgttctttattgggtgtttttatggtcacgtggtaacaattttcttacctaacctacaaaaggttctcttgatgaacatttttatttatatttactaatctttttaaaaaaaagctttcatagcattatataatcagatgaagaaagcccagtagaataaaaaaaaaattcattagcctagcctatattatgttttctgtcaaaggaaaacaaattctcaaataggaattctaaaaatatttactaaagtaaaataactacttaaaatgttttattccagttggaaggaaggtacagggagaaatcgcaattatttaggggagaagtatatttattataagatggtgtcctcaaattagcctaccatggcacgtaggggcagcagctatattagatttactagaggtgctaagttagaacactaggcttttattgaggcaggttttaatattgatagatgctttttgtttggtttgtttcttctgggagagaatggaggacttaagtagaagtagctactgataacagactttctagtagcagtttccactccacggttacctttttagtttcatagtatcttttcacaaagtattacaaataagctagattctcccagtttgggaatgcaagtttgctacatttttagcctggcaatatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaataatttaccatgttaaaataaacttttctttgttttttatttgtagagtcagctaagtacccatatttaaatgccgtctttattatttttttgaggtctttgtttttgtctgtttttgttttgttttgttttgtaaataaggtaactgggcaatcaaacaccttttggggattctggctttagtattttatcagccattttaaaattaaatataaaaatcctttgtaagaaacttgcatcctaatttttctttattgcaattgaaagtgtaaataataagacaatgtaagtaagaccttcctaatgtctaatacaaactgggctccagcaagtggccctatttttattagggttttgaaggtttgtgtgtgtgtgtgcgtgcgtgtgtgtgtttttcttttttaaatgtatagtagagtggtgtctgtataagtgttacctgtagtggggttttgtccagcaagcctgaaatttatactttgaaataaaactactgggtttttaacattctgagtactctgattaattctggttattcacccttgtggctttttttctttctttcttttttaagaatcttccaccttgtttagaatcacccattacatactgtatggtatggcttatttaatctacttggcaattccatggcactcagatcacatgtaactctccagtttcgaaagaaagttgctatgcagggttgctgccagattgtataggtgcttttagcttataggaggcaacagtaagctttactgtattgtatgcctaacctacatcacaaaaagactcaacttatgcctgttaatgaccagaaaaatcactaactacaatcaccaactactactagaggttcctttgaaaacgaagctccagcatcccctagggttttgtcattaggcatattcatccagggaaaggggaaagagcataggaggagtacagattcttatgggcgaggcctggaagtggcactcgtctcaggttccaatggctagaattgtcatgtggcacaactatctgagggacactgggagatgtggtctgtgtgagcaggcgtgaaaggagaacatgaattctggtgaatgaaggagctgtttcttccataccctcttgtgtattagcatgtatgccgaagcttagtgttatttatatatatatgtaacatttcttctacagtgctctaccttatagtgagtgcttactgtaaaaacaacaaagtcagtgggaaatgaaagtgacaaattaatatattttattgcataattctgatgggaaaaacatagctaaaatagtgcctttggtatcttatttacagtcttctagtccgtcatctccctccttcattttatatcaagtttcaaaattggtttcatggtaataaaatcaaagttgtagacctctggcatgccctgatgtagagttttgttgaaacggtcccagcgaaaaacagggaggccaccttgtactgtgggaccacttatggcataggatgtgtactgagatgctaggtagatatctgccacctggaaagagggaggaggaggacattttagaaaatcatcgttcagcaaaaaattaaatccatggccttccccactctcccactaccaaagtcacaatattagctttttttttgagtcggagtttcgctcttgttgcccagactggagtacagtggcacaatctcagctcattgcaacctctgcctcccaggttcaagcaattctcctgcctcagcctcccaagtagctaggattacgtggatgggccaccacacccaggtaatttttatatttttagtagagatggggttttgccttgttggccaaactggtctcgaactcctgatctcaggtgatccgcccgcctcagcctcccaaagtgctgggattacaggcatgagccaccgcgccaggccgccttctttaaaacaaaattttcttgccatttttcacattgtctttatatgatacagtcttctgtatacatttggcttaaatgtcagttgactagaagtgtgtgaaatgaacaatgtagccaaaagtgagatatgaagtcagattactcatattcagaattctagctccaaagcttatttaaaaatcacttaacccctctatgaatcagtgttctcctttgtaaaatgggctgataaccctacttcatagagttggcatgaggattaatgcaagcaatgctcaaagtaatgcctagaatagatgaagttcttagaaaaagttgttattaatcagggtggtaacaagagtctgaaagtagatagagctcactgtcaaaaattgagggccgtggttctcaaaaacacctaacaactggctagcagtgggtcttaatcttagaggggaaagagaatctcttcttattttccccatattcaaaatgactctaaagagataaattacatttttaaagaatatccttcaacagaaactttctgataagaacaattgcaggcctctgtctccagaagtgagatttggtagagggaagcttggcttgagttctcccaggcaaggcagcagaggtgattttctttgtgtattctgtgatagatacaaacttcacacattgactgaatgtttgcaaatgccattttaaaaaaggaatacaaaaacattcattggggtttcatctgtgccagcttctctacgtctaccttttttttttttttttttaatgttaacattgagagtcattacggctaaagctttgccttcatcacatagctaaaaagaaggttgagctggaacttaggatactttaaagcatttcctgtttaggtattaggctgatagagaatcatgtgtaactggggtcagcattcctataattttttgagccaaagacagaatacacactttaccctgacaggtttcttccagaatttaggacagctgatgaaatgaaaagacacacacccaagccaagagtgcaaaaggatgtagtagcatgattccgccaaccaaatgcctcataccctcagacgtcccaaatccagtggtgagcaggtaaatttttaacaacaatctttctttgtgaggaaaaaagttcctgatttccataatgtaaatactttcactgactggtttgaagccatcaacacgtcaactaacaattggttcctgcatgtctataagctggctttagcacaccactgcaaacctacttattacttatattttcagatacattacagcacttatcaattctaacattgtgaaaaactgctgtgctttaggcatcttgtccaaacttgctccttcagctaaatttgactcatgtttaacatggaatcgcactgcttgaataatatgttctttggactttgggccagtctggtaaaacataagacaacaataacatcattatggttgtatacatttacaaataactcactaagtgctgttgtaaacattttacagagattaaagccttattcttcagaacaacatatgaggtaagtactgttatatccattttacagatgaggaaacagaaacatgacggaattatgtgatttactactaaatggcagagcagggacttgaagttagataataggacctaccaccagaatctctgaaaaagctgattcctgggttgagtttatggttagcgacatcgcttcctgccataaaaacctgtgcaactttgcctttggagaggcctgtgtgctggtgggaattaaattcaaaagccaatagcatgttacctttgtgtcataacaacctccaggacttgggttaggtgagttcaggtcctcacggcagcagatggtattacaggggtcacctctactgtaaggatccttcttataatctaggaaacagaaatggggaagagagtgattattggctatttggagacacacttctccacagtaaggttttgaggcctgttaaagcctagataatcagagagtgtactcccacaggcctcctcagcccagtctgcttccagatagagacatctcccttggcttgtgaggaaggagtaagtccttggccccaggcccagcctgccctcaagaaccttacacagtgaaaaatggatgggaaagagaaccagataaacgtccatcagctgtttccaacaaaataaatacaaatttgactttgatgctgttcatacaaaaaaaatgaggtatttatgaacaatgttttgttttattagctgctgttatccttggaaggaaacttgtgtttggagaaaaattttaaaggaccctctatgagttatttcttctgtgttttacagatgattttttttttttcaattaaaaaatgtatagactcttctctttcattttataaaggaggccaaagctctatttattgagtataaaatgtacaatattagttaaatacttaaataacttcttataattccttctagtacagagatgataaacttacatggattctgtatccatagggaagaaaaggagttttgaagaatgattcttgagaaatatgctacgtactgttgtatcgcatgatatatttcatggatgccgtatcagtcactttcccttggtcacgccggaaaattttggctcgtggagctaaatcataagagtagtccaagcccagcttctgaactaacagtggatagccactccagttgtagattttttcatggaaaggaacattgtaggagggccaatatcctgatttggaatggaagggaagtaagggagggattgacagggaaggagacagaaaaggagagagagcaaaagaaatgttatccatgttcatttattttgaaaatgggcacaggcatttaattacaaaataatgtacagaaaataaagctttgcatgtgaaccctggcagccaaacagccttttaaatttcctaaatcagcacagctctaggttatttcattaggggaagaagagcatcagaattctctggttttcacccaaaattcttaatctctaagccaaaaaacaaccatattctctatagagcaaaataaagtataatgcaaggtggtctggggagctcatctaagtggatttagttactgaaatgccaagaaatggttgttcacagtgtggccctataaaggaagatgtcaaatggtaatcatgaagtagtggaagcacatagcactgggaatagaaagcctgaattctaggctcagggcttaagaatcaggtcttaggcaggcaacttcatttgttttgtttctgtttctttttttttgaaagacgtcaatggggagggagaggagaagtccataatgtaaggggattggggatgatcttttaggttacattaggcttttaattcctttgactctaaacatttataaaggctcagcttcattcaaagcttcatagtgtgtgaaggccacatagcctactagtcactgagcaccaaatatgtgacacagctctctcttgtaaaagcagaatttcagaaacatcctggatgacactggcctgggttactgcctacagaacagtcaaggaatgtctccaccatgcagggttctctcccacctccacattctctcctggcccttttctgcctttctcctttgtattgttgtacaggacctcctctttaggggtgaggttactgagacaaaaagaaaatgataagacattcagcc

SEQ ID NO: 365 - DNA, 2111 bp, Homo sapiens
cagaagtagaaagtaatgaaaaggacaacaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaaaagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccagctcaggctcccttgcgaggaactgttatgcaggctcctgctgttcggcaggtcaatccccaaaatagtgttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgccagcacatctctgcctcagaagccacacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatgtactctcacccagtttgtatctggtagcaaatactactttgcagtacgagccaaggatatttatggacgttttgggcctttctgtgatcctcagtcaacagatgtgatctcttctacccagagcagttaa

SEQ ID NO: 366 - protein, 702 aa, Homo sapiens
EVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 367 - DNA, 20762 bp, Mus musculus
  misc_feature (1)...(20762): n = A,T,C or G
agccaccgaactgcagactttaagtgggggaatttctagcatgtaaattatatcttaagaaatgtactaaaggactggagagatggttcagtggttaagagcactggctgctcttccagagggcctgagttcaattcccagcaaccacatggtggctcacaaccatttataacaggatctaatcgcctcttctggtgtgcatgaagacagagcactcatacacataaaatacatgaacaaattaaaatttttttaaaaaaagtactaaaatagtcagtgtttggtaatgacaattattttctgtttcctatcctggcactttgcaggtgatgtcaaaccaccttgcagagtcccctgatactatcttttaaatggtcttagtaggcttgaagcaagataggttgctttttttctcacataaagagatttctaagtcagtgtacacattatttgtggctttgagacttcgttacattcatcacctttcatctcggagcctcggagttcatcctgactgccagagcttatcacatccccattccagtcaacaaaatgtaggaagaaatctgggtgtggtggtgcacccagtaattccacttactcagagagaggaagacaggaggatgcgaagttcaacaccagcccgagccatttactgcgacactgtcttaaaggtaaaaagaaagtcaaacaatcagaaaggtaaaagaaaaagagaaaggctggccatttcctgggatggagatgtccctaagggacaactcatacttttacttatgtctcattgtctagaaatctaatcacatggctacacctgtttgcaaaaggaattgttacataaagtctttttccttttaacattttttttgttttgaaagattttattttatgtatatgaatactgtgtgtatgcggcagcacttggggggtgggggacggcacagaagccagaaatggttattggaccccctagaactgaagttacaaacacttgtgagctaccacatggacactaaggaaccccggtcccttgaaaaagcagccagtgctcttaaccacgtagccatctctgcagccctgatgcaggcatgtggtcttgtagctcagatgcgaccacaattcagagcaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaagagcacgtcacccacatgtgggtcatatagtgactaacattttctgtagatgtcttatcatatatctacctgcctggtcatgcttctatcttacattaatccatgtcaagatttagtgcactgtagagagaacctgttatgaatattacctgtcaataaaaaacaaagcttatggccaatgagctgagacaggaaataggaggtgggacatccagcaggactagagacttctgggaaatagtgacaattgttgagacattcaaactggaaagctgaagagataaatgtaaactaggaggtagctgaactcaggatagaataaagaggagatttgcccctggaactctgaggagacagatgtaaaaagacaaggagaggcaaccagccccatagctgaacccaggttagaataaaaggcataataagttaagaggacgtcagagaacaagacaaggcttatggcctaggtatttattaataaatgattagtctcagagtcattattccaggagcaggggaaaggagaggagaaaatggatgtaatgactactaaccagtgacctcacctccaaacccatcagcacgcctgctagtaaccagtgacctcacctccaaacccatcagcacgcctgctagtaaccagtgacctcacctccaaacccatcagtatgcctgctagtaaccagtgacctcacccctaaatctatcagcacacctgctagttaccagactttagtattttttgtagtttttaccctttgcatttgttgaatgcctgcagaaggtagcctacacctgtgagatccagaacaaagtgtcccgaatgcctcctcagaacctttcaaatgatacacgttgtcccatttgctctgattgaaaattacattgtagccgggcgtggtgacccactcccagcacttgggaggcagaggcaggcagatttctgagtttgaggacagcctggtctacaaagtgagttccaggacagctagggctatacagagaaaccctgtctcgaaaaaacaaaaacaaacaaaacaaaacaaaaaagaaagaaaattacattttttgctgggcatggtgtcaccgcttatcttgcctaggcagaggcagtcagatcgtcagatctctgagtttgaggctaacctggtctacagagtgagtttcaggacagccagggctacatagtcagaccctatctccaaaaagggaagtaaatggcttcgtctcccttagcactcactgtggcacggactcttttctggttccttccactgagcacaggtttggaaacttcattctgccaccaccatgatgccggatgttccttaagttgttttgtggtttcctgttaaggatcccttgagtagatccagtttgggactgtgatcaataaggcttctatgactgacctccatgtggtctgtgtgtttgattctccttagtgaatactgatgagaactgagctataagtctatgtgttttgcctgtactaaaaaactaactgccagactttccccccccccccaaatcgctataacatttttcatttcccatacatcaggcttatacgtgttttatattcattcattctattttatgtgtggctgctttcatgttcatgtattttatgtgcactacattcatgcttgctgcctgtggaggtcaaagggggacatagaatcctctggagcgccggggcgtggtggcacacgcctttaatcccagcacttgagaggcagagataggcaaatttctgagttcgaagccagcctggtctacagagtgaattccagaacagccaggactacacagagaaaccctgtctcaaaaaacaaacaaacaaacaaacaaacaaacaaacagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcctgctgggcttatatattttgagctgaaaataaaacataaaattataaactgctactatttaaattagttcatgttccctgccccatcttttgttgttgttgttgttgttgttttaaaatttggcctcagccttcttcttttattattatttatttttattttacgtgcactggtatttacccacatgtctgtgtaagagtgtcagatttcatggaactggagttacagtagtgagctgcaatatgggtgctgggaattaaacccaggtcctctggaagcacagcagtgttcttaaaactgccaagcatcctctccaacccatttacttttatttttttgaggcaggatttcctaaaatccaggctgatccctagcttgctctgtagcagaggctgggcttgaactcccgacccttctacctctgtcttctaggttctgggactatgaatatgtgcagcatacctggttccctttctcaccttaaacctttaaatagtcaggttgaagaatacagccaacaaagaaccaccttgaacatgctttcatatgaacaatgagtcagagtgaggaggaaacatatcaagtaaactcatcaaataaatgactcttccatgattaaagacaattttcaacacaccaggaatacaaaggcatatcttcagcttataaaagccatcagttcaaaacccacagctaacgtcaaagataatggtttcctgagcataaagatgtccatggccgttctcactacttctatccaatcttgtttatagagattttaaatagggcaataaataaatacataaaataaatggcatctaaattgcaatgaaaaaaatgcttggagcaatgccaagtgcttgcaaccccaaacacttaaggaaaccaagacaggaggattgtcagaaaggctaggacagtctggactacagagcgagatactgccagagagagagaggagagagagagagagagagagagagagagagagagagagaaagaagaggagaggagaggagagnnnnnnnnnnnnnnnnnnnnagggagtcagatcttgttacagatggctgtgagccaccatgtggttgttgggatttgaactctggaccttcggaagaacagtcgggtgctcttacccactgagccatctcaccagccccaggaacatatttttatgtgttttgttattttgagcccagtggaaaagttataatcataggacttggaaagtagaggccagctttggccacgtaaactttggaagtttgggcttaatataagctgcacgagatcataggagaggagaggagaggagaggagaggagaacaagagagcagtcatctgccaaggataaattttataattccacagaagtagagattacctagatttagaactttgattactttcttcaaactgactctattacaaagagggagctgttgaaagagcctggaagcccagcacttgggaggtagaggcaggacaatcatgagttcaagaccatcctcagctacagagtgaattccatgccagctggggttacaggagaccttgtttcaaaaaaatgaagagacaaaaaaaaaaaaaaaaaaaaggaggatgaagaaaagaagaaggaagaggaagagaaggaggaagaactgacttttccactgttctgacatttctcttctctatacttgaaaaaaaaaatgaagccagacagtggtggtgcacgcctttaatcccagcacttgggaggcagaggcaggcaaatctctgagtttgaggccagcctggtctacagactgagttccaagacagccagggctgcacagagaaaccctgtcttgaaaacaaacaaacaaacaaacaaaaatgaagcagactctctctcttttttaaagatttatttattttatgtatatgagtacattgttgctgtcttcagacacaccaaaagagggcatcagatcccattacagatggttgtgagccaccacggggttgctgggaactgaacccaggacctctggaacagcagtcagtattcttaactgctgagccatctctacagccccccaactcactttttaaatatttaaagttgcatttatttagttgggggagggtgttaaagtccaaggataacttgtaggaatcgtttctttcttttccaccaagggtcctgaggactggactcaggtggccaatctcggtggaaagcattcttttcctctgcggcatcttacaggctacccaactcttcttttaaactgtttaaatgtgtatgaatgtttcgcctgcatgtatgcctatgtcactgtgcacatggaggccagaagagggtgttagtatcctctggatgtggagttagttaccaatctttgtgagcctctgggagtactgagaaccaagccccggtctttcagaagagcagccagtgctctttagtcgtgaactcttaagtcttattatttacttacttctgaattcagtctcaccattttgtctcacactaatctagaactcatggatttgagcaatcttcccaactctgcctctccagccaagtgtaagccctggctgctgcactcagctcctgctcaggactagaaagtagctgcctgaacactgtcagactcttcactggccttggtgtgtctgttcctaaatgctttatgactagggtttttttggtttttttgttttgttttgtttttgttttttggtttttcgagacagggtttctctgtatagccctggctgtcctggaactcactttgtagaccaggctggcctcgaactcagaaatctgcctgcctctgcctcctgagtgctgggattaaaggtgtgcgccaccatgcccggcactatgactagttttaaagcaactttatattacacaatttacacgttacaaattcacttattttaagttctctctctctctctctctctctctctctctgtgtgtgtgtgtgtgtgtgtgtgtgtgtgtgtgtgtgtaatagaaactaggccacagagttctgtgtatcaggctggcctcaaatttgctatttggccaggaataattttgaacttgtgatcctcctgcctctgccttcctagtgttgggattacagatgtgtgtcaccacccaggggtctgttgaagtccatttgaaaatgatcatcatcagccaggcgtggtgagttccaagacaggcagggctatacagagaaaccctgtcttgaaaacaaagaaagaaagaaagaaagaaagaaagaaagaaagaaagcggtcatcaaattactgttcgctcagaaggaaagcattcctgccatgtgcaaggccctggatgtaatccccaacccttccaaaaaaaatcattaaataaacacacttgacctagtggttcccaacctgtaagcaagaggataaagagttcaaggttatcctcagctacacagccaatccaagagcatactcaaggccctttcacaaaataaataaatattaaaaaaaaaaaaactaataaaggtttggttaaccattaattcaacaatgctatctggaacagttaagatggccgaggctctgttttcatataaccagctcaccactgctaccctttctagatgactagtcttcatttgactactgaatttcgttaacacgcattcacttgccatattacagttccttgcaaagagccagtagtcaacgcagcccctaaatgccctggaacccaagccaaaaaaccacgaaatctgtggccggtttgcgttccagctcagccatccacatcagacaaggtctccatcctcctttccatctttggcaacaaccttttcctaatcgtcactccgagtccaaacctcactccctctcctttccagcctcctctgactctgtcacccaaacctttaaaaaaaaaaagaaaaaaagccaccgcctaaaccaaaccacttgacgtgctgaggggagtgtgtggaggtgtaagtgtgtggaagtgactgtgtgtggaagaaaccaatcgagtcccccaaggtgtccatcttgtggaatgccaattaggcccggctgagcgaaccagaatcaacttcccagtgcatccccgcacacagtaggcacgccgatgaggctcgggggcagccaggctctactctgtgccctggccctacaggctcactactgccaaggagacagcaccccccggccgcgcacggtggtaggagccacgcgacgtcacccattgtttacaaatcaacccaagccggcagcgttccggctcccgcggctctaaggcgcgcggtgccactgcccggtggtccctgcctagcccggcttgggcctccgcctcgctcccgccccagccgcggctcgccgagcccgcggccaaccgagctgccagcgacgcccgcacagccgcgggggcccgggcggggggccatgccttgccggagagaggaggaggaggaagccggcgacgaggcggagggggaggaggacgacgacagcttcctcctgctgcagcagtcggtgactctgggtggctcgaccgacgtggaccagctcatcgtccagatcggcgagacgctgcagctggacgcagcgcacgatcgcccggcctcgccgtgtgccgccccgggtcccccgcccccgcaggttcctggcggcgctgccggcggacaagaccgggaccccagctaggaggctgctgcggccgacggggtcagcggagaccgggaaccctgcgcccccgggggccgtgcgtctgcgtgctaggggagcgcgggcgcgtgcggggacggtcggcgccctactgcgtggcggagatctcccccggcgccagcgcgctgccccagcagccgggccttgacggacccccggggaccggcaaactaagcaccccgcagccactgtcgggcccgtgccgccggggttggctccggaacgcagccgcgtcccgccgcttgcaacagcgacgcggatctcagccggagacccgcactggcgacgacgacgacccgcaccggctcctgcagcagctcgtgctctcgggaaacctcatcaaggaggcggtgcgcagacttcattcgcgacagctacagttacacgcaaagcttcccgcacacccgtttctcgggcctctgtcagccccagtgcatgagccgcttcgcccgggagcctcgcgcggctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccgcaggctgtcagcagggctccttttttttttttttttttttttttttttttggcgtgattcaacctggtcgctgcaattccacgcaaactctcctggccaagcggggaccacgtggccacggggcatgctctcaggatcggctcagcctgctatggaacgaaggacgatgatccccattacttgctgtactttttcagggctggttcctgatccattttcggggagggggaaacaagagtggacttaatttcggggggcgccccccctccaaaatgccacacttgaacatttaacgacagttaaaagaccatctcatcatcctttgcggtgctggtttcaatgtaaaacatgcggtacaacgagaggaccctcttggggctgaatagaagtaaccgtttttttgtccgttccctttttctttcaaagggttgctgttagcagagtgttgagggaaagctgcaccccatgagtgtaaggtggagacagcagtgagctgtgttgggtaatggaagggtatggcgaagcaaggagtgaccccctcctgccttcgtaaagtgtgtttttaaaggagacccatccctttgggggttcaaggtcactgtttcctgggtgtgcaccgtgtagtgggactccaacacggagacaaccgaatggccttgctaggaagagagcacactgttttgcaaatgcaagagtcccctaaggacgctcccgccacatcccagaggaggtggggatggcgagtgctgagtgtgcttcccgtccgaggccaccgcccctgcccctccacctggcttgcagacaaactgccttgagacagtgaccgagtaccacctttcccccttggttctgctgccctactcaagcagggtggcgctgatgatgctaggggccagggtaggggattggggagattccacataatgggcactccagggacacagcttgggacacagtctcacacagcctcttctaatgggctctcggggccatttgtaataacagctgcagttccctggatagacagagttgatttcctcctgaccctcccccagctgtgccagctggcctttgtaagggaaggaaccctagtagaaaatgtgaccctccaaatgggaaagctgcaggtttttctgctattgtgactgtgaagtgcttggaaacactgttcactctgagcgaccatttcgttttagttttctggagtcaatggcttgttcagcatccagatgtggctgttgacatatctacacttcgcaccggagtgactggaattgtggctgtcctgattataggattttaactgaaataactgtttttgaataaatgtgttgggttcccctcacacacacccccacaccccggcttttattttgtacttgcctccagtgcgaaagatgaacagaacacatttctctgatctccataaacatgaaaacacttgaaatctctgtcggcttggctcgaggctggtaattagaggcctttgtgtctgagcagctcagtagttagatgaggtctgtgcagctgggtgtgtgtcggtgctggcatgaaattaaatgaaactgaggtcaggttttggaccaatcccattcagcaacctcagagccttttgggtgccggggaggacatcagagcagtctgggaggctaactgctccacctacgtggacccagctcttctggcaccccttatcccccccagccccgtgcgcccacctcttctggtgccctaatggggttgttgaccaggtgctacccaagatataaacccagtggtaggaacactggttgagatcttatcaaatgacacctccctccttgtccttagtacatttgctaccatcctgtcctggcgatgacacgatcgccccgttctgcccttttctgaaatgctgcaatctgttcccttaaggaaggagctgagttagatataacaaaggctgaagtggagcagggaccttggagaagtattggggactccgtggcttttccatttcctctcctgtgccacacggacagtgagatacagcctgcatggtggcagcacagaatggttggtagtccctagcccttcctttccagaactggctctaagtagccaggtgactggggggggggggtccttgatttttcattcaatggaaacccactcgttggaagcattgtctgtcttgtgtattagatgtcaattcttctgattcgatgtaccattgtagcttatatccatcagacacagaggggcagcttctgaatatatcaagcagattatgtcccatgagccatgatgggggacaattatggggactcacagacaaggaaggagcctctgtagtgcggtgctgagattgtgtggatggtggtccgaggttctggtgtgggcatagccctgagtttttagttatggaggaacttctcagaggtctaagtctaagcaatccagggccttctctccatcaccaagctatccatgatcgaatgctaaggcactgaagaaccagatctcttggaagcatggtagttcatgtttatattccagtacttggggagctgagacggaaggattggtacaagttccaggccagcctaggctatagaatgagaacatatctataacagccagagctcacccctacaggcctccctgtaaagatgaaacaaaccaggcttggtacgtgctcataatcccaggcacagacaggagcatcaggaattcagggtcatccttagttacatactagagccagcttgggcaacataagacccttgctttctaaaggtaggtgtcaaactaatagatactatgcatagagatagtatgtagttgaaatacagtatagttctgaaaatctttctataaaaatcctgccaagacctgaggacctaacagtagtcaagctcctacctagaatatatacatggcccagaattacacacacacacacacacacacacacacacacacacacacagagagagagagagagagagagagagagggagagagggagagagagagagagagagccacagtaagcatagtggcatgcatttagttccaactcctccggaggctgaagcagaaaggggtgggtcagccctggggtttggtttttggtttttggtttttggttttttggttttttgagacagggtttcactgtgtagccctggctgtcctggaactcactttatagaccaggctggcctcgaactcagaaatttgcctgcctctgcctcctgaatgctgggattaaaggtgtgcgccaccacgcccagcttgtttgtattttttaagatttattttatttgatatggataagtatttgaccaaatgtatccatgtgtaccatatccatgcccattgctctcagaggtcaaaaccagggttcggatcccctgaaactggaattatagatggttatgagcaaccatatagccactgacaactgatctcgggtcctctgtaagtgcaaccattgttcctagccactgagacatctctccagtccttagccctggagtttgaaaccagcctgggcaatatggcaagatgcagcccatttctttctctccattctaagatacttcaaggagcacttatacttaataaaaggtaagtaaataaaagtgaaaaatcttgctgacttttactactcactcttacacccttttttagaatagaataagtcagaatttatatcaatgattgatgttattagaactgcatgtgtttgcgagaactcaggccagtgggttgaacgacagagttccatgaaaactgagaaagatatacccaactgtcttaaaccattccatagatgctctatagccaaagaacataggcaggacggagtgattctctgaagtcagtggtgaaatctatcagtctcgaagccagatttttttagggctcccagttcaggcctctttccaagtgctccataccattataaaaggtccaattttgtttactaggcaaagctgcacataaatggtacctccatggttgtccaaattggtgaccttgacatcagaaccctggaaaacgctgtaccaactactcagatacctggagtgccaggtatgctgtaaccattttgattttctgatagaagacctcacatagcccaggctggccttcaacttgcttcgtaacagaggatagccttgaccttctgagcatccttcctcaacttcccaagtactgggatttcaggtgttactgagcctgaggtttggacccagggcttcacgcatcctaggcaagcagtcctccaacaagacgacctcccttgcctactgtaaccatttccttccaaaatcttctgcatagtacaaagacagctggtcacagaagatgcccggatgagataaaagaccaaagctacaaactgaatgaaacaactaaaattaatcaatttgcaagtaagtgatttgaatagaagaaaggcgagtggaacactccaaagcctgccgccctaagaccgttctaaaccagacttaaatgctctgaattcaattgttatcctttttttttctagttctttttccagcttagaagcaggaacatggagtgaagatcagacaacactttcctatccagcaaagtctgtgttgaaccctgtgatcctctcctcccaatcagaaaagtgttgccttggcaaccaaattactaactcactcaattagtgcccccttccctttccaccagtgctcagtaatcacagaatgtcagccccagagagctcaggctttgcaggcgggggctcctgtcttatcgaggggtggaagtgcactctactgacgctgcggacgttggtacaggcagaggaaaaacactcctgggcggggctcccatgcctatctgaagggagtgcaaaggagctgcccttgtgcctcccagacacagaaagcaagagttgggcaatgcaggcagccctctgaggctgtgtgctttgggatggagtctacaagttcattatgccaaaaattcatctgcaaaatgggataagtacagagcataacttgcagaattgtgggagatttgataatccacacaaagcaaatggaaaaacaaatcactcctgtaagctggtttgcttatccctctccnnnnnnnnnnnnnnnnnnnnttactgccatgcctaacaacctgagtttgatcccttaggcccacatggtggaaagagagaaacagctcccgtaagttgtcacaactcttgtgtgtgctgtggcatgttcatgcccacacacatacacataaaattaatttttaaaccagcaggcacagggaagccagtaaggaggtgcacacttataacctcagtacttgggagctggaggcagaagaacaagttcaagaaaatccttgactataaaacaagaccctgtctcaagtcacaaacccaaaaggcacagagaccaggaatctagctcaggggtagcatgcacaaggccctgggcctgacctccatcacctcaaacctgtctccgaggtcagatcactagatctcaaaccctgttgcagtctcacaggaaagcattaaaggtagctgagctcacgacattatccagatgtccagtaaggcaggggcagaggtcaccaagcaagggaaacagattgtttggaacttgtagagctaggacaggaggattatcaccagcgaaagttagggtacacagtgaagggagcctggggtcaagctcttaagatcccctccatgttagaaaacccaccctcttctaattcaatttctgtgctcagctgaagtatggcttgcctgccttctgcacttctgtctataatttgtgctcagaagaaaaaaaaatcatgcaattgtgtcccaggaattatgtctcaattcattctgttcccggcttcatcttccttactgtcattacagagttatctcagggactcatgtgtgcatgtctccttcccaaagagattatatattctttgatggcggcggaatgacaaaatgaagagtgtgtattcggcagatagttgagccacgtggcacggggaatggactagggctgagggggactatttatggtcacacagatccatggctggcaaccaaaaaccaggagataaaggccccgggatgggtagggaaaggaaaagactagagacaatttcgaaaaagaaagcctacagtacagtaccatgtagccataaaatgctgtgtgtgagtcagacttcctggctccttcctataaccctgaatagatttcttcacctctctagtaataacaagagttcccacctgataagattgttgtgagactagtaaaaccactcaggccccgcccaaaacatggctgcattaaatactaccactcgggttttggtattcagtaattatttgcagagcaaacaaatgggggtggtttcaacagcatgcatggcacaaactaagggggcctggaagcagataatgagctgagttcctagaagtctgaagatggggagaaaggacagacagagcctgagagggaaaagggggaggttagaaatgtgagtgaaaggcagcatgactatccagtaaatgtcaggctctgggtttgatacctgacaacgcagaacaaaaatcacaagagagaaatggttgggaaggattcctcggccaagagaaaaagccctgcttaactgaagcaagtaggggacgaaggcgagggtgcaattaaagggagcttctttgagggaccaggctcctggcagaggaaggaagaatggagtttcttaggactagggagatggctcagtggttaagagcactgactgttttcccagaggacctgggacccacatggcagctcacaactgtctgtaactccagttcccgggtttctgacatcctcccactgacgtacacatagacaaaccaccaatgtacataaaaattattaaaagagtaatttttaaaaatggggttcctattgtgggcagggctcaaggggaaggcttacgtgtggatagttcatagggcagaaccctgggttacaaactgaccgaacacagagaatcccaggatctgaccgggtggtaaatcaactttctctataaccttttagcctgggaaagcccagtgtttctgtgaatgaactgcctgtagctaatgctacaaaagaacacaaactaaaactgatactgaggagtttagtaactgtttctccttatcggctactgaccgactcaccgggagttaagtgtggaatcccagctgataggctgctgccccggcagtttatttgatttattgatttgggtgtgttacaaaggcacaagcaggttatctctctgctacctttgccctgcctctgcttgttcttgtttaactgtcaaaattagatctcacagcctaatattgaaaagggcttccctgaaaactctttcccagacactgaagtcacagtcccaagccctttctttcttccccttcttttattttcccttaaaataagtttgcgttattttatgtaagccagacaagccctttcctccagatgcaccttaaatgcacttctttctcagctgggatgagcatgggacgaactactggagcctgcaaggttggtaaagactctccctcattgccaaacctgacaatatgaatccagttggtgacaccaacatggtggaaggaaagtactcttcatgttgttctctagcttgcatacacgcacatatgtgtacatgcatgtgtatacacacatacacaaatgaataaatgtaatgaaaagaatttccgagtcagggtttctctgtgtagccctggctgtcatggaacttgctctgcagaccaggctggccttgaaccacctgcctctgcctcccaaatgctgggattaaaggtggattttcaccacattgctgaaaaaaaaattttttttaaaaaggggctggtgagatgtctcccgcaggtaaaggtgcctactaccaagcttgattgactatgtctgattccctggaatttacatggcagaagaggatcactaaannnnnnnnnnnnnnnnnnnnnnnnnnnnnnnnnnnnnnnnnnnnnnnnnnnnnnnnnnnnntctcaaaaaaccaacaacaacaaaagactgggactgaagagaaggctggatggttaaaaggacttgttcttgcagaggacgtgggttcaagtcccagcacccacaagatggctcactaacatctgtaactccagttctgggggagtcagtgtcctcttctgatctttgtgggtaccagtttcacacataggacacagacatacatgctagcaaaacacccatacatataaaataactaactaaataaataagaggctggagaggtggcttagcagctaagagcgctcacaaccatctgtaatgggatctgatgccctcttctgccctcttctggtgtgtctgaagacagctacagtatactcacatacataaaataaatctttaaaaagaaataaattgcagggcggtggtggcgcacgcctttaatcccagtacttggaggcagaggcaggcggatttctgagttcgaggccagcctggtctacaaagtgaattccaggacagccagggctacacagagaaaccctgtttcaaaaaacaaaacaaaacaaaacaaaaataaataaataaataagtaaatctacaaaagaaagttctagattatgttcaaaactagtaggtggtggtggcacacacctttaatcccagcaaatctctaagtttgaggccaggtctacaaagcttccatgaaaataataataatgataataataaagtttaaaataagtgaatcaaaaaatcactacttaacagtgctgataaagggaaaatgaactatcaacccaggtcactgacctggatttagtccatgtgccccggacatctggagcctgggggcttccgaatagaggcaacatgagcctagctgctcaaccatgtgatcctaactgcagcggctcacccttcagtatccttggcttcccacccttggttctgctcctattttctgtctgcttctgagtggattctcatctttgtcccagaaacctgatgacctgttctttataaggtgcttaggatggagcctggctcttggtaagctaaatacattagccagtgtttttattgttgttcctaaagaccatttcccaggtttatcctcaactgccaaatccttatcaccaacccttatcactgaagtcctagccatttgagactctgggctgctgtccctggaacttcctgagtctcctaatcaacaccccctcaccaacaacccaagtcacctgatacaactcagcttctcctggtcacttccctagagctgtgcccccactccccagctcagtattatcagggg

SEQ ID NO: 368 - DNA, 745 bp, Mus musculus
gcccggtggtccctgcctagcccggcttgggcctccgcctcgctcccgccccagccgcggctcgccgagcccgcggccaaccgagctgccagcgacgcccgcacagccgcgggggcccgggcggggggccatgccttgccggagagaggaggaggaggaagccggcgacgaggcggagggggaggaggacgacgacagcttcctcctgctgcagcagtcggtgactctgggtggctcgaccgacgtggaccagctcatcgtccagatcggcgagacgctgcagctggacgcagcgcacgatcgcccggcctcgccgtgtgccgccccgggttcctggcggcgctgccggcggacaagaccgggaccccagctaggaggctgctgcggccgacggggtcagcggagaccgggaaccctgcgcccccgggggccgtgcgtctgcgtgctaggggagcgcgggcgcgtgcggggacggtcggcgccctactgcgtggcggagatctcccccggcgccagcgcgctgccccagcagccgggccttgacggacccccggggaccggcaaactaagcaccccgcagccactgtcgggcccgtgccgccggggttggctccggaacgcagccgcgtcccgccgcttgcaacagcgacgcggatctcagccggagacccgcactggcgacgacgacgacccgcaccggctcctgcagcagctcgtgctctcgggaaacctcatcaaggaggcg

SEQ ID NO: 369 - protein, 248 aa, Mus musculus
PGGPCLARLGPPPRSRPSRGSPSPRPTELPATPAQPRGPGRGAMPCRREEEEEAGDEAEGEEDDDSFLLLQQSVTLGGSTDVDQLIVQIGETLQLDAAHDRPASPCAAPGSWRRCRRTRPGPQLGGCCGRRGQRRPGTLRPRGPCVCVLGERGRVRGRSAPYCVAEISPGASALPQQPGLDGPPGTGKLSTPQPLSGPCRRGWLRNAAASRRLQQRRGSQPETRTGDDDDPHRLLQQLVLSGNLIKEA

SEQ ID NO: 370 - DNA, 35236 bp, Homo sapiens
  misc_feature (1)...(35236): n = A,T,C or G
ggagtccccaggatttttttttttttttttttttttgagacggagtcttgctctgtcacccaggctggagtgcagtggtgcgatctgggctcactgcaagctccgcctccccaggttcacgccattctcctgcctcagcctcccttcagcctccccagcagctgggactacaggtgcaagccgctacacccggctaatttttttgtatttttagtagagatggggtttcaccatgttagccaggatggtctcaatctcctgacctcgtgatccgcccgcctcggcctcccaaagtgctgggattacaggcgtgagtcaccgtgcccgtcccccaggatttcttcaatggttccagagagttctctggctaaagattggtgacgcctctgtcaaacaatgttgatgatctcatcaaaagtgatattcccactgtgtttaatgtgtttctgtttcttctgtctcttggtggttccttgagaactttgatgatcagggcagaggcagaaggcaccacctcaatctgggcccgtctgttctgaatgttcagtttcactgtaatccccaggcctttccagtcacctgttgccttggcaatggcatcaccaaccttttttagagacagaaccagggggctgatcttgggggccagtgaagaagtggcaccaacttcatccccggtgcacctcaggtatacgactttaatcttgttggggtcgaacttcggcggcatggtggaggcggctggtattggatgaacctggattcaggacgaccaaagaaagttgcaccttggcctcttctgagccaaaagctgaaagcaaaaaatgtgtttttaaaaacaaacaaacagggccaggcacggtggctcacgcctgtaatcccagcactttgggaggccaaggcaggcagatcacctgaggtcaagtgttgaagaccagcctggccaatatgatgaaacctcatctctactaaaaatacaaaaagttagctgggtgtggtggtgcacctgtgggagaatggctggaacctgggaggcggaggttgcagtgagccgagatcgggccactgaactccagcctgggcaatgagagcaaaaactccatctcaaaaaaaaaagatccagaggtaggcagtccaggaccatgtctggggccttcaaaagatccaggcaacaaaataaaagaaaaagagacaggcttgcccccttcctcacagggttactttccaaaggtatcacataatatggcccatttggccaggcgcggtggctcacgcttgtaatcccagcactttgggaggccgaggcaggcagataatctgaagtcaggagttagagaccagcctgaccaatatggagaaaccccgtctctattaaaaatacaaaattagccggtcatggtggcagcatgcctgtaatcctagctacttgggaggctgaggcaggagaatcgcttgaacccgggaggcagaggttgtggagagccgagattgagccattgcactccagcctgggcaacaagagcgaaactctgtctcaaaaaatatatatatatatttatatacatacatagcccacttatatttcattgaccagaacttaatcacatggccccatttggctgcaagagaagatgacaaatgaccccttgtcttcccatctctttgttcttttgcaggggatagagatgggttcttatggttctggtacagctacaatttggggtttattaaagaggagagtggttattgggaggcaaacagcagcctctgctatagctactacttgtgtaaaatggaggcagactataaataaataaactatctttgaaaagacacacaacacatgtagtatagtttgccttttgacttttgaactatgtggctgtagtgtctactcaaataagtaaaactagaattaaaaaaaaatactgcaggctagcaacatggtgagactttgtctctacaaaaaatacaaaaattatccaggcatggtggtgagtgcctatagtcccagctactggtgggaggatcactggagcctgggaggttgaggctgcagtgagccatgacttagccactgcattccagcctgggtgacagagtgagactggtcttaaaaaaaaaatactgaatgatgatacccaaccatgtgtctcctgacttacagctctgtcgataccacagctgtcccaggcatccatatggacaccatgcttctgcggatctaagactgcctcctctgcagtgagccaagatggcgccactgcactctagcctgggtgacagagcaagactctgcctcaaaaaaaaaagaagaaaaaaagactgcctcctccagacacctacaagcaatcatgcggcaagtttgagcatctacttttccattcccattgtcacccaggtagcaaggatggcacagtcctagaaatgggagaacttactgcttcagcctacatggagtcatcatcatggtccctgagacttggtcctaacatggccgtcttttacctatgatcaacataccatgagggggccgggcacggtggttcatacctattatcccagcactgtgggaggatgggctgagcagaacacttgagcccaggacttcaagaccagaccggacaacatgacgaaaccctgtctctacaaaaaaaatcacaaaaattagccaggtgtggtggtgcacacctgtggttacagctacttgggaggctaaggtgggaggattgtttgagcacaggtggtggaggctacagtgagccatgattgtgccattgcacaccagcctaagcaacagagtgagaccctgtctcaaaaaaatgtatatatatatatatgcatacacacacacacacacacacacacacacaccccatgagagatttattgaccccttgtcttcccatctcctcgttcttttgcaggggatagagatggggtcttgctgtgttggctggtctccaactcttgggctcaagtgataccccggcctcagcctcccaaagtgttgggattacaggcatgagccccgcgcttggcctattcacacttgattcctgttctaatggtagatcttgctgggtctgtcatgacccaacatccatcacagaggttctcaatcactgagctgccagcctgagctgtaaccataaaaaaataatctcatgcttctctgtccttggtgtttcttggtttgtggcaacatgcttgacatggtgttctcctcatgtgtctgtgtccaaatttccttctttttgtaaggataccagtcccctcattaggtcccaccctaatccagtatgtcctcattttagtttgattacatctgcacagacgctatttccaaataaggttatactcacaggttctgggtagatagaaatttaggggaagctactcaacccggtacactattccagcctccaacctgaggggtgcatccctctgaactatctccctaacctagagacctttctccttttataaatgacaaaatatcctcaggcaatgctgtgttaaaaatactttaaaaaggccgggtgcagtggctcacgcctataattcctgcactttgagaggccaaggcgggcaggtcacttgaggttaagagttcgagaacagcctggccaacatggtgaaaccccgtctctactaaaaatacaaaaatgagccaggcatggtggcgggtgcctgtaatcccagctactcaggaggctgaggcaggagaatcgcttggagtccggaggcggaggctgcagtgagccgagattgcaccagatagcaaaacattctacactgctccatcagtgttagctctgaagccatctagtcattttaactactggcttccagacccaactgttctaactcccacccccactccccactgtctaaccagtggtttatctttcctgcccagtcagcagcttcaggacatttttaacttttgccttccatggcttcctcagctgctaatctactgagatacgtttattttattttattttttgaggtggagtgtcactctgtcacccaggctagagtgctgtggcacagtctcggctcactgcaacctctacctcctggtttcaagtgattctcctgcctcagcctcccaagtagctgggaatacagtggcctgccaccacacccagctaatgtttttttctttttttttttttttagtagagatgggatttcaccatgttggccaggctggtctcgaactcctgacctcaggtgatccgcccccctcagcctcccaaactgctgtgattacagatgtaagccactgcacctggcctactgagaggtgtttaatatctcatcctcatctcttagcatctcagtttgagtcccgtaacctctctctctttttttttgagatggagtttcactcttgttgcccaggctggcgcccaagggcatgatctcggctcactgcaacctccacctcccgggttcaagcgattctcctgcctcagcctcccaagtagctgggattgcaggtgcccaccaccatgcccagctaattttgtgtgtgtgtgtgtgtgtgtgtgtgtgtgtgtgtgttgttgttgttgttgtttttaaaatttgagacagagtctcactctgtcaccaggctggagtgcagtggcacgatctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgcgccaccacacccagttaatttttgtatttttagtagagatgggatttcaccatgttagccaggtatggtctcgatctcttgacctcatgatccacccaccttggcctaccaaagtgctgggattacaggcctgagccactgcacccagccaatttccccttttctatggcttattgtttctaacactttattgtaaaatttttcaaacagccaacaaaattgaaagaataccctgttacccaacacctagatcctagtattttaaaaattgagatatatttcacataacataaaattcaacattttaaagtgtacacttcaatagtttttagtactgtatattcattatgttgtacaaacatcaccactaatttcaaaacatttttataaccccaaaaagaaaactcttacccattagctgttagtcctaattccccccttctcccatcccctggcaaccactaatctaccttctgtttctatggatttgtctattctggacgtttcatataaatagaattacacaatatgttgcctttcctgtctgatttgttcactcagcataatgttttcaacattcattccttttgtagcatgtatcagtacttcattcctttttatggtgaataatactccatcgtatgagtatacgacatttgattcatccatttatcagctgatgaacatctgagttgtttgcactttttgactatcatgaataatgctgctatcaacatttgtgtacacgtttttatgtgaacatatgttttcaattttctctggtatatagctaaaagtagaatggatgggtcatatggtaacattaacatattactatacatgttttatcacatatctacctgtctaactatccttctaatccatctatattaatccttctcacattttagtgtactttggaataaattgcaaacatcagtacacctcactccaaactcatcagcatgtctattactataattcaagctttctttacaatttattctcttcatgtaaaatctacaatttttttctctttgtttttttgttttgttttgttttgtttttgttttttgtttttttgagacagggtctcactctactgcccaggctggagtgcagtggcacaatcttggcttactgcaacctctgcctctcgggctcaagcaattctcctgcctcaatctcctgagtagctgggactacaggcatgagccaccatgccctgctacttgttgtatttttagtagagacggggtttcaccatgttgaccagactggtctcaaactcctgacctcagctgatctgcccacctcagcctctcaaagcgttgggattacaggcgtgagccaccgcgcccagcccactcaatgagttttaacacatgcctaaacctatgaaacccaaatcaagatatcaagatttagaacatgtccaccctcctgcaagttccctctgtctgttcagtgtcacagtgtcagtcctgcccctgctctaccttttccaaaggcaaccagtcttctgatgttttccccaccgtaagttactttccctgttctagaacttcatataaacagaaacatatgacatatatccgtttttatctggcttctttcacttagcatactgtttttaagcttcattcatgttactgcatgcagcaatattcagtcctttctgttgctgaactgttttctgtcatcatcctgtgtgaatgtacaataggttgtttgtccattcacctgttgatgaacacttgggccatttcacttttggcttttatgaataaaactcctttgatgtgagccaacatcgtgccactgcactccagcctgggcaaaagagggagaccctgtctcaattaaaaagaaaaaaaaatatgctatgatcacctccctgtaggccttgatgtgggcccatgtgtttatttctcttagctaagtatccaggattgaaactgtgttccaggacaggtgtatgtttcattttataagaaactgtcaggcctttttccaaggtggttgtaccatttttcatgcccacaacaatatatgaggcttataagttgtgagccaaagataaaaatgcacaaattgtaaactgctactaattattttcatttgaaaattttaagtaggccgggtctggtggctcatgcctgtaaatcccagcactttgggaggtcgaggcaggcggatcacctgaagtcaggagttcaagaccagcctggccaacatggtgaaaccccatctctactaaaaatacaaaaattagccgggcatggtggtgcatgcctgcagtgtcagctacttagcaggctgaggcaggagaactgcttgaacccgggaggcagaggttgcagtgagcgaagattgtgccactgcactccagcctggacaacagagcaagactccatcacaacaacaataacaacaacaacaacaacaacaacaaatgcccaacaaaccaggaatagaagggaacattcttaacctgataaatactatctatgaaaaatccacagctaacatcctacctaatgttgtgaaagactgaatgttttcatctaagatcaggaataagacagggccaggtgctgtggctcatgcctgtaatcttagcactttaggaagctggggtgggcggatcgtttgagctcaggagttcaagacctgcccgagcaacatggtgagaccccctgggtctacaaaaaatacaaaaattagccaggcatggtggcttgcacctgtagtcccagctactcaggaggctgagataggaggatcaactgagcctggggaagtcaaggctgcagtgagcagagatcatgccactgcactccagcctgggccacagaatgagaccctgtctcaaaaaaaaaaaaaaaagaaaaaaagaaaagaaaaaagaaaaagaagagaagcaaaactatctctatttgtagatgacacgatcttctatatagaaaatcctaaggaatccacaaaaacaaggtgatgaaccttatgacaccctgtagaaatccagatttcgtagattagaaatccaatggctttgtttaaactgtctcttcctctgtttttacattttttcctccacacttgacaaaaacaaacccaactctttttaaaccaacttccctacctctttcctgcactcatcccttcctaaaggtttgctcctataattattatcgttggaactgcccaacaagaccctcgttttctatttatctggatctccaggctcatttctttctttgtatcctattttctatatcatgctcagaattttaaagttgcttccaggctgggcgcggtggctcatgtctgtaacgccagcatttcgggaggagggattgcttgagtccaggagtttgagaccggacgggccaacatggcgaaaccctgtatccactaaaaatacaaaaattagccaggtgtagtggcgcgtgcctattgtcccagctactcgggaggctgaggtgggaggatcacctgatcctgggaagtcaaggctgcaatcagccagatcacaccactgcactccagcctgggtgacagagtgaaattctgtcaaagaaagaaaagaaagagaaagaaaaggaagaaaggaaggaaggaagcgtatctccattttcatccaaacagctatttttctctgctactacgtacctcctcagagcccatcccccctactggtctgaggcttttttttaaacaactttctggacatagcccctcttaagactaacaacctatagccaggcgtggtggctcacgcttgtaatcccaggattttgggaggccgaggcaggtggatcacctgaggtcgggagtaccagaccagcctgaccaatatggagaaaccccatctctgctaaaaacacaaaattaggctgggcatggcggcgcatgcctgtaatcccagcaactcgggaggctgaggcaggagaactgcttgaacccaggaggcggaagttgtggtgagcggagattgcgccattgtactccagcctgggcaacaagagcgaaactctgtctcaaaaaaacaaaacaaaacaaaaagagtagcaacctaggccgggcgcagtggctcacgcctgtaatcccagcactttgggaggctgaggcgggtggatcacctgaggtcaggagttcgagaccagcctggccaacatggtgaaaccccgtctctactaaaaatacaaaaattagccgggcgtggtggtgggcgcctgtaatcccagctactcggaaggctgaggcaggagaattgcttaaacgcaggaggcggaggttgtagtgagtggagatcgagccactgcactccagcctgggcgatagagcgagactccgtctcaaaaaaacaaacaaacaaataaacaaaaagactagcaacctcctctccagcaatgccaaccccagtccaggcccccatccgcccaggatctcgatcaaaaaacattaatctgtggcctttctttgccatttccaactctgccacctccatcgaacgacaaggtccccttcttcctttccattcccgtcagcttcatttccctaatctccgtacaaatccctagcctgactccctttcctttccatcctcaccagacgcccgcatgccggacctcaaaagcgcaaacgctaaaaaccggttgagttgacgcacggagagaaggggtgtgtgggtgggtgggtgtgtgttagtgtgcgtgcttgcttgtgtgtggaagaaaccaacagggttcacgctggtgcccatttctggaaatgccaatcgcgcccgactgcgggagccaggatcaggtccccagggcgcccttgcagacagcaccctgagcgaaggagctcagaaggcagtccggcttcacccagacccccaatcccacagaagcgccgtcccccagcggcacagcaccccctccccggcgcggtggtagggcccgacgtgacgtcacccattgtttacaaatcaacccgagccggcaggattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctgctgcagcagtcagtggcgctgggcagctcgggcgaggtggaccggctggtggcccagatcggcgagacgctgcagctggacgcggcgcaggacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgccctgcgccctacttggaggtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggacttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaataccaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccagtttctgccggtgctcggagaagagcgcagtgttttgcaagtgctggagtctcctgaggacacgcgcgtcgccgccaccgcgggtgtgggaaagcgcggacgtgctgggcgtctgtgcttcggtaggcgaccaccgcccctggccgcgctccgggctttcacggaaactcccgagaccgggccctgggttcctcctctcctactcggctctgcagtcctactcaagcgggtggctctgggatcctgggggcctgggttgggggctagggagacgccatgtgatggacactccagggacacacagcctagcacagcagcttataatgggctctccggggccatttgcaataacagctgcaattccctggatagacgagttgatttcctccctctgcccctcccccagccatgccagctggcctttgtaagtgcaggaaaccgagtagaaaatgtgaccctccaaatggagaagctgcaggctttgccattgtgaaccatggtgaagtgcttggaacatactgttcactcactctaaaggcgctgagactgtgctgttgttctcgtttttatagtcaatggcttgttcatcatccagatgtggctactgacatatctacacttcgcaccggagtgtctggaattgtggctatcctgattataggattttaacttaactgaaatgcctgctttgaataaatgtgttgggttttttgtttggttttattttatacttgccatcagtgaaaaagatgtacagaacacatttctctgatctccataaacatgaaaacacttgaaatctctgtcagcctggcttgtggatggtaattagagcgcctttgtgtctgagcagctcactagctagacaaggtctccgcagctgggtgtgtattggagctggcatgaaattaaatgaaagtgaggtcaggttttggaccaatcccattcgttaaaacctcagagccttttggattactagtcagtgatggagatgtgttataaagctgcctctattagcaaaggacatcagatcagccagtcactgcaaactgggaggcttatctttttttttttctttttctttttttcttctttctcaccgtggccattaagtgcacttgttccacaaggtgggccttaaggctggggcagctcttgattaggagactgctcacaatgtgagcctggtggtaggaaagctgggtggaaacttacaaaagactcctgtctttgcccctggcacatttataccattctgtccctaagcagtgacataacaggccatgtctatccttatggttctgacttacttcagtctgttccctcatggaaggagctaatttcctccctctgaggaaagagtacccagagtttaagcccacttctgaagtgggaagggaaccttggacaagttgctctacctctgtggcttcagtttcctcatccgtacaacagggataatgaaataaaaggtgggccaggcccagtagtttacacctgtaatcctagtagcactttgggaggctaaagtggaggattgctggagcccagaagttcaagaccagccagggcaacatagtgagacctcacctctccaaaaataaatagataaatggccgggcacagtggctcatgcctgcaatcccagcactttgggaggccaagaagggctgatcacgaggtcaggagttcaagaccagcctgaccaacatggtgaaaccccatctctactaaaaatacaaaaattaactgggcatggtggtgcatgcccataatcccaggtactcaggaggctgaggcaggagaatcgcttgaacctgggaggcagaggttgcagtgagctgagatcgcgccactgcactccagcctgggcgacagagcgagactctgtctcaaataagataaaataaaataaataaataaatgaggcaagaggattgcttgagcctaggagtttgaggctgtcgtaagccatgattgagctactgcactcccacctgggtggcagagcaagaccctgcctcaaaaaaataaattaataaaaggcatatggtgactggcacatgctgcagatgaacagtatctagtccctaccccttccttcccaggtggcggtgtcccaggtgtcctcattttcccacaaaacaagagcatgccatgatcccaaatctgctttctggagtgttctatgacttcgagtcctgattttctaacttcctttttggttcaatgccccattttctcaaattcacacacagacgctgatggtctctgaggagtaccttcagaacacaccaagcctgccatttcccacaacatgcccagaaagggctgtgggggcctcagtccagtgttctccagcatgggaagggtaactatggaggctctaatacaaactgaggaaaaggagcccccaatagtgtagtgggcaccacctctgggcgctgagcatgaggggaaagtggccaggtgctgatgtcccctggcatgggagtagccctgaagtccccagttcccattcttagttgatgtacgatttatccaaggtcaaggggttatgagcaatccagggctttccatcctgaaataggctatgatttgatgtcactgcaccgactgtgcatagcttcttgtaataagaatgactggttaagttcagactcaaccttagggcccatgcagaacaacccactcctaaaaaaggaaaattgggaaaaactaaagcctctctacataaagcaagttagcactctaaacacattataatccagtaaccgttcatctgtgtttttattttttatcttatttacttatttatttttgagacagagtcttgctctgtcacccaggctggagtgcaatggcgtgatctcggcccactgcaagctccacctcctgggttcaagtgattctcccgcctcagtctcctgagtagctgggactacaggcacccgccatcacgcccagctaatttttgtatatttgtagaggcggagtttccccatgttacccaggctggtctggaactcctaacctcaggtgatccgcctgcctcggcctcccaaagtgctgggattttaggcgtgagccaccgcatccggcctgtttttttttttttttttttttttaaatcctgccaagttttttctttttttttagacgaagtctcgctctgtcacccaggctggagtgcagtggcatgatctcggcttactgcaacctccacctcctggggtcacaccattctcctgcctcagcctctggaatagctgggactacaggtgcccgccaccatgcccggctaattttttgtatttttagtagagatggggtttcaccgcgttagccaggatggtctcgatctcctgacctcctgatccgcccgcctcggcctcccaaagtgctgggattacaggcatgagccaccgcacccagccaaatcctgccaagttttactattcaccccaaaatactttttttgggataagtcaggatttacataaagtgtggggttttttgtttgtttgtttgtttgtgacggggtctcagtcagtcacccaggagtgcaacggtgagatctcagctcactgcaacctccacctcctggactcaagtgattctcccatctcttgagtaattggactacaggtgcgtgccaccatgcctggataattttaaaattttttataaagacaaggttttgccatgttgcccaggctgttctcaaactcttgggctcaagcaatccacctgcctcagcctcccaaagtgctgggattacaagtgtgagccacctcgcccagccaggatttacataaagtattttaaaagtcatattggggcagacgtggtggctcatgcctgtaatcctaggactctgggaggtcgaggcaggtggatcacctgaggtcaagagttcaagaccagcgtggccaaaatggggaaccctcgtctctactaaaaatacaaaagttagctggacgtggtggtgggcatctgtaatcccagctactaggaggctgagccaggaaaatcgcttgaacccaggaggtggagcgtgcagtgagctgagatctcaccgttgcactccagcctgggcaaaaaagagcaaaacctctgtctcaaaaaaaaaaaaaaaaaaaaagtcatattagaccattttataggtggaaaaatagtccaaggaagtgagcagggaagaatgacctaccaaagttgtttatgaagccagaggcctagcagagtctagaacctaggtctcccagctcccaactcagggctctttccagtggctccatatcatcaaacatggtccaatattgttcactgcacaactctgcacataggctaccatgggaatgacatccctacaattgcccaaattggtgaccctgccattggaaccctggaaaattctgctccaagttcctaggctgagttagggaatgccatttccttacaaaatgttcagcatcctatgaagacagctggccacagaaaatggcctgggtgagatatgagaacaaagctacaaatggaatgaaacaaagtgacacatacattggcaaataagtgatttagagaaaagaatgccacacctcacagagaactccagagtctgccaccccaagatttcattctaaattaggcatacatccgacaatatttggattcaatttttacccgtttttgctctttttccagctcagatgcagaaagctggagcgaagatcagacaccactttcctatctagcaaagtctatgttgaaacctgtgatcccttccttccaatcaggaaagagttaccttggcaacgaaattactaactcactcaattagcccccacttctaccaatgctcagtaatcacagaccatcagcccccggagagctcagctttcagcagtctgatgctaccgcctcatttagagatggaagctcagagaggtttccactccgaggtgcgctccatttgaacactgtgaaagctggtgcaggcaaaggggcaaaactcttccgagtagtgtttcctcctggttttccatcataactgaagggagagcaattgacctgcccctaccagtgttacccaaaagacataataggtaagagtggggggtctgcaggcagccctccactgtcggctgtgtgatatgggacaggttcagtaagctcaatgaactcatttgcaaaatgtgggtaagggtagagcaccttgaagacttgtgtgaaaattaaattagaaccaaagagcaaatggtatgggaaccaaagagcaaataataaacaaaacagaacactgttcctgagagacgttgcattaaggccacttctttgagtcttctgcagaaaaccctgcctcttactgacttcttcaatatttcttaacaggcacaaacctgtttcttctgaaggtcagaccagtttcctgatcatgcaccccagttgcataggtgggtgttaagggaagtgtagaagaagggaataagggcggaggcggccgggtgcggtggctcacacctgtaatctcaacaatttggtaaacccaggcaggcggatcatgtgaggtcatgagttcgaaaccagcctggccaaaatggtgaaacctcgtctctactaaaaatacaaaaattagctgggcgtggtggtgcatgctacttgggaggctgaggcaggagaatcgcttgaactcaggaggcggaggttacagtgagctgagatcacgccactgcactccagcatgggcatctaaaaagagagagaaaaaaagggtggagccaagctaagcctgcaaagcagctcagggttggaactggtggaatagagggagcaggaatatcacaaaggatagggttggcagttggcagtgaacacagcctggggccacagctcttaactcccccatttcctatcagaaaacctatccttttccaaaattcaaatactcaagttctacttgctgtcctgtccagtcctggctataatctgcactgagaaaaccatacaataggccgggtgcggtggctcacacctgtaatcccaacactttgggaggctgagacgggtggatcacctgaggtcaagagttcgagactagcctggccaacatggtgaaaccctgtctctactgaaaatacaaaaattagccaggcacggtggcatgcgcctgtagtcccagctactcggagggctgaggtaggagaatcgcttgaacccatgaggcagaggctgcagtgagctgagatggtgccattgcactccagcctgggtggcagagtgagactccatctccaaaaaaaaaaaaaaaaaaaaaaagagaaaaccatgcatgcaatttcttcacaggaagtggcctttgagttcatttcattctcactctcacatttcatttactgtcattatagagttatctcagggactcatatgtgaatgaatgtgttctcttccccaatagattatgtattttgtgatggcagaggagtgacaagatgatgaggatgttttaggcagattgtcaggctgcatggcatggggagtggtctggagctgaggaaaacactgatggtcagccagatcagccgaatggtgttaaagctcccaggcacccaggcgattaagggagaggaaaacacaagagacacttccaaaagaaaaccggtaggcctcagttaactgtactgtgtagctgtaaaatcatggctctggagccagactgcctggctccttccttgaaagctccttcctgtgaccttgggcaggtaacttcacctctctaaccttacgttcagttgcaaagtcccatgataaaaaaaaaaaagtccccccctcagagggttgttgtgaggattaattgagctaatgctagtaaaaatgcttaggccactgcctgcctgcaacatagctgcatttagcaacagcaccagggtactggtatttagtaaatatttgcagagcaaacaatgggcaatttcaacagactggcagaggctaagggagtggggtgcttaggacgtagatgatgtgttgtggtgcctacaagtctgaagatgggaaaagagtgactacagctaaaaagggaaaatggccaagggaaggattcactcagccaggggagaactgtgctcatctgggtgtggagagaggatacaaaagggtgaaattgccaggcacggtggctcacgcctgtaatcccagtactttgagaggctaaggcgggtggatcacttgaggtcaagagtttgagaccaacctggccaacatggtgaaaccgtctctactaaaaatacaaaaattagctgggcgtggtggcatacgcctgtagtcccagttactcaggaggctaaggcatgagaatcacttgaacccgggaggctgaggttgcacgccactacactccagcctgggtgacagagcgatatgccgtctcaagaaaaaaaaaaaggggtgaaatcaaagggaagatgctataaaggtctaagttcctggaggagtgggacagtatggggtcctcagacagggcaggtttgaagggcagggcttagggggactgtggttgtggatgccccacatgacagctccctgtgtcactaactgtcctgccacagtgtggctgcaacctgacagattggttgctgaaaccatccttcatgcctgggatggctggacatgtttctgttgtttttgtgtgaatgaattatctgtagctgatgctataatggaatgaaaatgaaaactgataccaaggagtttaagtgctccctcttatcaactgttaactgactcatagcaagtaaaatcacaacccccaactgataggctgcccaggcagtttgtttgacttattgatttgggtgggttaaaaaaagcaagagctggttatcatcctgttacctttgccctgccttttgcctgtttctgtaactgcctaaattagattccacagcctaagatcggtgaaaaatggtttcctataggttttcctgaaaatctttcctagacactgaagtcacaaacccctttctgctgatgcagcataaatagtacttttcttcagctgggctaaggaggggaggaatccagtgcagatgttcaaaacacgctacttaagggtgctgacaaaggcaacttgagaattaacttcaggattcaaagacagtgaaagtcattgaataagatctgattccatatgccccggacctctgtggcctgactacagaggatatacatagggataatagatacagctgtgtttgtgttatgtgcacatgtggacccactactgttcaccctacagtctcccttggcttctcctgggtctacttttattttctgtctgttccttttgtgtagtcttcttcctcccagagatttgatgagttgggtatttgtaaagtgcttagaaggccgggcacacacaggctgggtgtggtggctcacgcctataatcccagcactttggaaggccgaggcgggtggatcacttgaggtcaaaagttcgagaccagcctggacaacatggcaaaacccgtctataccaaaaaaatacaaaaaaaaaattagccagatgtggtggtgcccgcctgtagctacagctccttgggaggctgaggcagaagaatcacttgaacctgggaggcagaagttgtagtgagtcgagatcacgccactgcactccagcctgggcaacagtgtgagactgtctcaaaaaaaaaaagaaaaaagaaagaaaaagtgcttagaacacagcctggcacatggcacgcactattgcacattagctagtgttattactgcccatcttccaggccccattctgcgccccaccccatcccacccccttagccttaactgccaaatctttatcttaagccctgaaccctctccaactcctagtcatttacaaggcaccaggcttctgtcctcgtaacttcccatgtgaaactcctaattctccaaacaccacacacacacacataccatttctcattatttccctattgctctggtccttctaggctagagacttgcagaatgttatcagggaaacatgggcaatggccccttcagaagacgaagctgtctcaactctgtgaccatccactacaaggggctagggatatcctagccaaaatcattcctgagctaagagtactaggaatgggctatcccaagctgcaacaccttggaaatggccattgcctcgtagacagagacacttccccaggcccaggccctccacaggctttgcaaatggctggatcagtagcaagagttggggtgagaagagcgtactgtgtgtaggctcagacaggtgacaagggtgtgtgagaagagcattgtgtgtaggctcagacagggggcaagaggaccaacttaagtgccctgagttctgattctgctctaccaccaataattcctttcaccattgtaaaaagcaaagtagggccaggcacggtggctcacacctgtaatcccagcactttgggaggccaagacaggtggatcacttgaggttagcagtttgagaccagccagggcaacacggtgaaacctcatctctgctaaaaatacaaaagttagctgggagtggtggcgggcacctgtaatcccagctacttgggaggctgaggcaggagaattgcttgaacccaggaggtggaggctgcagtgagccaagatcatgccactgcactccagcctggggacagagcaagaccacgtcttaaaaaaaaaaaaatgccaggtgccgtggctcatgcctgtaattccagcactttgggaggtcaaggtaggcggatcacaaggtcagatcgagaccatcctggccaacatggtaaaaccccgtctctactaaatatacaaaaattagctgggtgtggtggcatgctcctgtagtcccagttactcgggaggctgaggcaggagaatcacttgaacccaggagagggaggctgcagtgagctgagatcacaccactgcactctagccaggcgacagagcgagattccatctcaaaaaaaaaaaaatcttgtaaaaggtgccaaccagggtgcctgccctaacagggatcagctccatctctacctaggaagtagagaaacactcagatcttgtaggtcttttcccattgtctgtagtccttatctataagatggaaaaatagtgcctacctcgtggcacataaagccatgtggtagtaccaagaatgagcagctatcactttttgagcaatgaagtctccccttcaagtcctcatttaacccttccaactcccctattaagtactattgttttacaaatcacaagggaaaaactcagagtcttgacttgcccaccatgacacagctggtgagcagaaagggctgaggcaactgagcatcagccttcctctgcagccccagcctcgggagtgtgctgagcaggagaggttccccgggggctgggttagtagagctgggcaaggaaggggcaaggcaggggccaggtgtggtggctcacgcctttaatcccagcactttgggaggccgaggagggcagatcacttgagctcgagttcaagaccagcctgggcaacacagtgagaacccatctctactaaaaatataaaaaattagcctggcatggtggtatgagcctgtagtcccagctactcaggaggttgaggtgagaggactgtttgagcccaggaggttgaggctgcagtgagccaagatcgtgccactgcactccaacctgggttacagagtaagacaccatctcaaaataataaaattaaattaaaaagagaaaagggcaaggcaggaactaggaagggattcagcaagggctctatgcctgggaagacagggcagagagagaatgaggagaggaggagggctacttcggtcaaatctaacccctgagtgctcaaaccaagccattttacaactaccaaatacactgctgtaaaaccctgtttttctctcccaaggccatagctcaagactaggtcagtctcaaaggggaaagcaggctggcttcgcctgtgccctccccattttgcacaaaaacgtccagatgaaaacccacctccctccaccacagcacctctttgctctccagcccagaaagcatttctagaatacattgtctttccacaaagggagtggaagcccatcttgcagcttctaaaaacctggactcaattttctgatcttgtggaataaaaacttagaagcactcaagtcctgtggctctactaggattctgtgcccatcagcattggcccaaaccatttgtccaggtccccccccccccgtttagcccaagtgccctctttattaaggacatccccatatgcttttctgcccctctcccaccttccaccaaaatgccaaaccgtgctccaaaacaaaagccaaatttattcagcagacattttaattatgaaatcctataaatcaggaccaccacaatttcagacactccgttgcgaagtgtacatcaatagctacatctggaggatgaacaagccattgaatcttttaaaaattggtttagctaccttaaagtttgggggtggcaccttacaaaagcgccgtcaagtttcatacagccagcggcttcttctctgggagagtcacattttaaaaccggtttcagacacaaaagaagggctggcacgggaggaggaaataaattgtgagggtgaggagccgccgaggccgaggcccatggctccatggagggccagaagagagcagaaaaacgtccagggtctctcatgcattcctatagacaccagaaagggtggaataagaaagctcagctgggaggacaagaaagagactcaagagatcgtttatgactgtttctgagaaagctcctggcatggccatgagtggccttccgggagtcctgtaaaaaggaaagcacagaaaacaggaaagaactctccctacacgtccctctctgcctgtttgtgtcctcgggagactccaagcggtggtaaagcaccaacagggctcttcttggagcaagagaaagaaaagactccggggtgagtaagctctcccaggaaccccacagcaaaccgtgaccttgaacacagatggcaaggtcaagtcatttacaagtccacattcaaatccaaatctcccacctgcaaaattcttcacctctctccagtcccttaattggagttcacatctcccaccttcaccagccaccgaatcggtgggaaaaaggggcaatgccaagccacccaccaccaaacttttacattcttctcccctctggaatttctttgcacagcaattgtagcaccacttactaagctcctccaccagaaaataagaaaatgtatgcgtgtcgttagttttcaagtattgttataaagccatcgcgattcctacccctgagccctccttaaacaatccaagctcacgacgcccccaagggctaagtgaggtacaagtcgatgcaagtagctgccatagttctcccagtttatcccaggtccttgggcttggatggcccgggaaattctcatgccccacggaagcaccctggcgcatacatttctccacgcttaagttttctccgacggcctcgccgcggctggtaacttctctggttgagatctctccccacgcgcctccccgcagccaaagtggtcgctcccaggctggcgacgtcggcttcagctcagagttagtaggaactggacgctgttgggtctacgcagcggcctccacttcctcctccaggaggcctgcgtcagagcaaggagcctgagggctgcagggcaatgcggtcaggtccgctgcggcctcccccgggcccaggggcgcttgcggggcccgtggctgcaaccgcggcgacggctcgttggagtctccgcacggcttccttgatgaggtttcccgagagcacgagctgctggaggagccgatgcgggtcgtcgtcgccggcgcgtgccccggcttgggtccatcggcgctgctgcaagcggcgggaggtgaccgcgtccctgagccatcctcgccggcacggccccggcagcgcgctggggcctgcggcgacctccgccacgcagtagggcgcacggcgtccgcgcacgcgccgcggtcccctagggcgcacggcagggcccagagggcgccgggccaccgtctcagccgaagcgggcggcagcagcagcggcaccgccgggggccgggccttgtccgtcggcaccgcgcagcaggggccccggggcccgcagcggcacccccgggggcgcgcacggcgaggccgggctgtctgcgccgcgtccagctgcagcgtctcgccgatctgggccaccagccggtccacctcgcccgagctgcccagcgtcaccgactgctgcagcaggaggaagctgtcgtcctcctcttcctccccctccgcctcctcgccggcttcctcttcctcctccctccggcacggcatggccccccgtcctggcacccggagctgtgcgggcttcgctgggggcttggttgcccgcgggcgcggagctgcgggcgaagccggagcaggggcggacgcggaagccagagcccgccaggcactcgagccacgcgcctgcagccgctggagccggaatcctgccggctcgggttgatttgtaaacaatgggtgacgtcgcgccgggccctaccaccgcaccggggcgggggtgacgcgcgagcaggcacgggggcaaagggcggcgcgggcgtgaccgaagccgtcccgcgcctgtgttcgttgtccctccaggagggggtccggggcgtggggactgatttccgacctcccgggcccaacgagccgtgctgaaacgtggcgcctcggaggaggctgaggttggtttctcccacgcacggacacacccacacccactccgggcccgcctcctgggccgcggcctccctccccacgtgtcggccgcgcctaagcccgcccgactcccgccccgcgcacccgcagttcccggccctggtcgtgggggaggggcgggccgccgcgggtccggcttcgacgaggcggggcggggaaaggcggagggaattgggagtgaagaggcggcacgttacttatttacttatttattatttagaaaaggtctctgtcgcccaggctgaagtatagtggcgcgaacacggctgactgcagcctcgaactctggcttaagtaatcatcccactttaagcctccggagcagctgggaccacaggcgcggccaccacgcctggctaattaaaaaaattttttttgtagagacggtggtggggggggggtctcactatattgcccaggctggtctcgaactcttgggctcaaggagtcctcgctcctcggcctccgaaagtgttggggttactggcgtcagccgccgcgcccggcctaagaggggacgctttgaagcagagcagaatcgctctgaggtgaggtcccagaggctttccctcccgcagtcttcaagcccccggacatatcatgagaataggactcaccgccgctcggctaaagaagggtctttttttttttttaaggttcaaatagaaatataggggattggccaggagcggtgggtggctcatgcctgtgatcccaacactttgggaggccgaggcgggcggatcacctgaggtcaggagttccagaccagtctggccaacatggtgaaaccccatctctgctaaaaatacaaaaattagccgggcgtggtggcgggcgcctgtaatcccagctactcgggagactgaggcaggagaatggtttgaaccctggaggcggaggttgcagtgagccgagatcacgccactgcactccagcctgggcaacaaagcgagactccgtctcaaaaaaaaaaagaaaaatataagggatggaaaaaatctctcatggttcacatttaaatttttttcctttttagcctttgttctatgaaagtgtagtatacaaacacatgcatacagtgttacacacttttccactttgccttacatcataaacgtttttcgtgttattgcatgcactttgaaaacattttaatgattacataagtttccatcaagtgcctatgtttttaacatttgcctaatttcaccatcgttaagtgtgtaactaacatttttgtgcgcgacactttaagatattgatgattctttccttagggcatattcccaggagtggaattttaagtcacagtagttgggtattttaaggtttactgataaatgttcaggaagtgtctttccaagagttaggtaaatgtactctaccatcattaatgcttgagcatacatcattacaccttcactagtatttgagtattattgaatttttttttttttgcggattatatagggaaattttctcccttcagtttgcatatctttgatttcagttaggtagagcagttttctaaatgtttgttaacaaactgtacttcctttcttatgaattgtctatttcctaataagattttcctagggagtgtttcttacgtatttgcatgactcctttacataccaaatgttaacccttttcatattttgccgcaaatacgtctccaggcttttgttggctctgtacagtcattttttcccccactaaaaccaaattttcatgtaggcaaattttaaaatctctttgaaatttctaacacgatgctaaatttggagtctccttgctgccagaaagttattaaatattccattctattttctttagatttttcaaatgccttgatttttttttcaaatccatctgggattaatgttggtctttgtttcaaggagatgacatgaaattaattttttcctggagagcttgccagccaaaggtgtgtttcttcactaggacagaggtgtgagggtagcataaacacaagctgtctggtgagtttccagttgctggttaagctggtggttgtgaggagtgggtggggctgggaatgttttgatcagtctgttgtgtgaagtcaaaagaacccagaacaggttgtacaaagacctagatccaagtctcattcctgccacatcctgggtgtgggactccaggcaaatcagtttacaagtgttttcacttgtaaataggagaaataatccctgcctggcctccctctgaggattgttttcaggatcaaataagataatgggaacgggtgttgtcaggcattacacaaatgtaggattaggtccagcggtttactaacagaggtctggctcaattccagcgagtcccccctggggagcatttaacataataatgttgaagatcccccccatgcagcccactaggtgaaacgtaccctgagggtattacttctgtgcacttgccaggtttcttaaattctgcctcaggtctaccctgacctgggattgtgtagggctttactgaagtcagcccggaggctcccatgccccacagtgagtctccgcaactagttctgcaggtttgagtgatggagactttcccagtgggcagcctcccacctccatctcccgagggctgttcacacactttactgatgaggactggaagccattccccccggagagactgattctcattttcattccgatggtacttactggagaatttcgagaggaatgaaaattaggggagggcttacggatttcagtagagttaaaatggtaatgttttcctcctttctgtatgatgatgcctggctgtaagtagagaaaagcagttttatgctccattgattttaaacattaatgggtctggtttaactattgtctctcacccagcatccctggaagttgtttttgttttcctgtcagggtaattccaatagtgttcttcgtactataggaaatggagctttgagatggcattctttaaaaaaaaaaaatcttccctttgtaatgttgcttttgtgtgaagattgctatgtaaatatgctgggacttggatattatactattcattacagagatgaattcattacagaagaccagctccattttctgggggcacctctctggagagctctgagagagagaagtgctgtgctggaccagtgggaggcagagaaatgccctggattaggaagcaaaatacaagatgctagaaagactcagatgcaattaaaagtaatgagacggtatcaaaaagggaagcgatgagaacttgtgagcccagcacactggctccctgcctggaaagacacactctcggacagcattcacaatcgcccagggaagaacagaattcaagggttttctgcattcacttagattgcgttgaaattctctgcaaggagtttgctttccacacagaccttgtttcaagttacctgccctcagagacattagctacagtacagtgggatgaacactaggcttgggaataccacctggatggggtcactttatccttccgtgcctctgattcctcatctgtaaaatgggggacggtcccttctttatgaaatggttatattacatgagaataatatgtatgggaagactcatcatgtggaccctgagggtggtgttggcataggttctagggagcagaaatactcttagggatgttcgagttttgttttttgagatggagttttgctcttgttgcccaggttggagtgcaatggcgtgatctcagctcactgcaaactctgcctcccaggttcaagcgattctcctgcctcagcctcttgagtagctgggattacaggcaagcgccaccatgcctggctaattttgtatttttagtagagacgggatttctccacattgctcaggctggtctcgaactcccgactgtcaggcctctgagcccaggccaggccatcgcatcccctgtgacttgcacgtatacatccagatggcctaaagtaactgaagatccacaaaagaagtaaaaacagccttaactgatgacattccaccattgtgatttgttcctgccccaccctaactgatcaatggatcaatgtactttgtaatctcccccacccttaagaaggttctttgtaattctccccacccttgagaatgtactttgtgagatccacccctgcccaccagagaacgaccccctttggctgtaattttccattaccttcccaaatcctataaaacagccccacccttatctccctacgctgactctcttttcggactcagcccgcctgcacccaggtgaaataaacagccatgttgctcacacaaagcctgtttggtggtctcttcacacggacgcacatgaaaccaacctcaggtgatctgcccaccttggcctcccaaagtgctgggattacaggtgtgagccaccgtgccagcctgatgttcaagttttttggtttttgtttgtttgttttttgtttttttgagatggagtttcgttcttgctgcccaggctggagtgcaaggcggcaatctctaccgtgcctggccaatacaacaaaattttattcagccatgaaaaggaatgaactattgatacatgctataacattttgctcaaaaacatgctgagtgaagccagacctaatatagggcgggcgcggtggctcatgcctgtaatcccagcactttgggaggctgaggtgggcggatcatgaagtcaagagatccagaccatcttggtcaacatggtgaaaccccatctctactaaaaaaaatacaaaaattagctgggcatggtggcacatgcctgtagtcccggctgctcgggaggctgaggcaggagaatcccttgaacccaggaggcagaggttgcagtgagccgggatcgtgccattgcactccagcctgggcaacagagcgagactccatcttaaaaaaaagaaaaaaaacaaaaaacaaaaaacccatctctactaaaaatacaaaaaattagccggccgtggtggcaagcacctgtaatcccagctacttgggaggctgaggcaggagaatggcttgaacccgggaggcagaggttgcagtgagctgagatcacgccattgcactccagcccaggcaacagtgcaagactctgtctcaaaaaaaaaaaaaaaaaagctcatatattgtatggtaccaattacatgaaatatcgacaacaggtaaatctatagagttagaagcagattgatagttgattagagctgcgggggtgattgaggtagggggtgactgctaacaggcaaggggtattcctttagggtaatggaaaaattttggaacctgttagaagtggtggttgcacagcattgcaggtgtactgaatgccactgaaatggccaccctttgaaatctctatttttttttttttctgagtcttgctctgttgcctaggacagagtggagtggcatgatcttggctcactgcaacctccacctcctgggttcaaatgactctcctgcctcagcctccaaagtagctggaactacaggccttgccaccacgcccagccttgaaatcgctaattttaagcagggcactgggctgcaagcttgtagtctcagctacttaggaggctgaggaagaagcatggcttcagcccaggagttcaagaccagcttgagcacaaagagagaccacttccccgccccacagactctgaaaaaataaatacataaataaaataataaaatggcaaattttatgttatgtgaattttgcctcaataaaaataattatatactttatgcagtatttgatccacttctttcttcctttgtagttggaactgcaatctaatctatttgctgatgtaaaacaatcacatctggccaagcatggtggctcatgcctgtaatcccagagctttgggaggctaaggtgggaggatcccttgagcccaggagttcaagaccagcctggacaacatggcaaaaccccatctctaccaaaacaaaacaaaaaaacaatcagccaggcatggtggggtgtgcttgtggtcccagctactcgggaggctgaggcaggagaattgcttgagccctagaggttgaggatctattgagctgtgatcatatcactgtactcaagcctgggtgacagagtgagagaccctgtctcaaaaaagagaaagaacaaaccttcttcatattagtgtgggagatagcaactccacaataccactagcaccacacaacctggaatagctatatagattgttttgagaattttattattgcaattttttttttaagacaggatctcactctctccccatctggagtccagtggcatgatcttggctcactgcaacctccgcttcccgagctcaagtgatcctcccacctcagcttcctgagaagctgggactacaggtgcacaccaccacacccagctaatttgtagattttctatagagatggggttttgccatgttgtccaggctggtcttgaacttccaggctcaagcaatccacccatctcagctccccaaagtgctaagattacaggcatgaagcaccacacccagcctatttatttattttagagacaggatctcactctgctgcccaggctgaagtgcagtggtgtaatcacgactcacagtggcctcaacctcctgggctcaagcaatccttccacctcagcctcccaagtagctaggactacaaatgtgtgccaccgtgcctggctaatattttttattttttgtagaaatgaagtctcactgtgttgaccaggctggtctccaactcctaggctccagccatactcccttctcagcctcccaaagtgcaattctccttcctcagccaccgaaagccctgggattaaaggtgtgagccactgcacccggctcacacacattttgagaatttgaaaacaactctattgtgttaaatgctgaaattctgaggtctgttacagcatctagcataaccctaatgcacagggataaaggttatcagggaaaagagaggtggagagagcgcagcacatttaagtaccatgaaaaagttcatgagtgcgggtgggcaaagagacctgatttgcatttgaagaggagctctacccacagaagtgccaggcttaggggactgacagaggaggcagatcccaaagatgtgaacagagaaggcaaacgccagtttaggactgatggaaaaatcgcaggctctgatcagacacagcccaatgccttccttcttctgccacagcccagttgagttactattggcctccattccagacagctgccacattgttttccagctctcacaggccccctatttcacagaatcccagtgagtgtctcctacacagggtggcttgcttcattgaggcaattctgggtgtccctccctgggtagtttggtttcttggggaaaagaaagggcagatgactccacccatctgcagaccccaacatgcaagtacactttttttttttttttggagatggagtcatgctctgtcacccaggctagagtgaagtggcatgatctcagctcattgcaaccctgcctcccgggctcaagcgattctcctgcctcagcctcccaagtagatgtgattacaggcaggcaccacaactcccagataatttttgtatttttagtagagacaggatttcaccatgttggccaggctggcctccaactcctgacctcaagtgatccaccggcctcggcctcccaaagtgctgggattacaggcatgagtcactgcacccagccgcaagtacacctgatgccttctctttaccatttcagattcctgcaggtagacaccaaggatctcctcagagccagcgctgatctcatccacagagggatcacatgacctcatctgggaaaatataaaccctacccacctgcctgcccatttggaaatgcagactggaggacgctaagttcattcttacctatgtactaacaagtacacaagaagatgctcaatatcattagtccttggggaaatgcaaattagattataatgagattccagtgtacacccactagaaggctattaaaaaggacaataccaactgttggcaacaatgtggagaaatggaacccctcctacgtttctgatgagaatgtaaaatggtgcagatactttggaaaacagtttggcaatttattaaaagattaaataagcataaacttactatatgacccagtaattccactcttaggactctgctcaagggaaatgaaaatatacatccacacaaagacttacacgagaatgttcatagcagcattagatatagttcaaaactgggaaacaatccagaggtccaactagcaaatggatttaaaaatgtggggctggggctgggcgcgatggctcacacctgtaatcccagcactttgggaggctgaggcaagtggatcatgaggtgaggagatcgagaccatcctggccaacatggtgtaaccccgtctctactaaaaatacaaaaattagctgggcgttgtggcgtgtgcctgtaatcccagctactcaggaggctgaggcaggagaatcgcttgaaccagggagtcggaggttgtggtgagccgagatcacaccactgcactccagcctggtgacagtgagactctgtctcaaaaaaaaaaaaaaaaagtaaagtaaagaaaggaaaagaaagaaaatgtggggctaggtgcagtggctcatgcctgtaatcccagcattttgggaggctgaggtgagtggatctcctgagatcaggagttcgagaccagcctggccaacatggcgaaaccccatctccactaaaaaaaaaaaaaaattgccgcatgtggtggcatgtgcctgtaatcccagctactcaggaagctgaggcaggaggatagcttgaggaggtggaggttgcagtgagccgagattgtgacattgcaccccagcctgggtgacagagctagattctgtctcagaaaaaaaaaaaaattaagaccaggtgtggtggctcacgcctgtaatcccatgagtctccgtctcaacaaacaaacaaacaagtgtgtatctgcagacaatgggatacttttcagcaatttttttttttgagacagagtttcactctgtggcccagctggagtgcagtagcgtgatcttggctcactgcaacctttgccttctgggttcaagcgattctcctgcctcagcctcctgagtagctgggtctacaggcacctgccaccacgccagataatttttgtatttttagtagagatggggtttcaccatgttggccaggctggtctcaaactcctgacctcaagtgatccaccttcctcggcctcccaaagtgctgggattaccggtgtgagctactgcacccggcctggtttgtcttttctacctcaccaattagtcctcctctgtctgctcttaatggtggagaatcccaagcttaggccttgtgttctcttctctgtctacactcatccacttgtcaatctcccaa

SEQ ID NO: 371 - DNA, 2677 bp, Homo sapiens
ggattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctgctgcagcagtcagtggcgctgggcagctcgggcgaggtggaccggctggtggcccagatcggcgagacgctgcagctggacgcggcgcaggacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgccctgcgccctacttggaggtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggacttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaataccaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccagtttctgccggtgctcggagaagagcgcagtgttttgcaagtgctggagtctcctgaggacacgcgcgtcgccgccaccgcgggtgtgggaaagcgcggacgtgctgggcgtctgtgcttcggtaggcgaccaccgcccctggccgcgctccgggctttcacggaaactcccgagaccgggccctgggttcctcctctcctactcggctctgcagtcctactcaagcgggtggctctgggatcctgggggcctgggttgggggctagggagacgccatgtgatggacactccagggacacacagcctagcacagcagcttataatgggctctccggggccatttgcaataacagctgcaattccctggatagacgagttgatttcctccctctgcccctcccccagccatgccagctggcctttgtaagtgcaggaaaccgagtagaaaatgtgaccctccaaatggagaagctgcaggctttgccattgtgaaccatggtgaagtgcttggaacatactgttcactcactctaaaggcgctgagactgtgctgttgttctcgtttttatagtcaatggcttgttcatcatccagatgtggctactgacatatctacacttcgcaccggagtgtctggaattgtggctatcctgattataggattttaacttaactgaaatgcctgctttgaataaatgtgttgggttttttgccgggctgtctgcgccgcgtccagctgcagcgtctcgccgatctgggccaccagccggtccacctcgcccgagctgcccagcgtcaccgactgctgcagcaggaggaagctgtc

SEQ ID NO: 372 - protein, 280 aa, Homo sapiens
MPCRREEEEEAGEEAEGEEEEEDSFLLLQQSVALGSSGEVDRLVAQIGETLQLDAAQDSPASPCGPPGAPLRAPGPLAAAVPADKARSPAVPLLLPPALAETVGPAPPGVLRCALGDRGRVRGRPAPYLEVAELATGPSALSPLPPQADLDGPPGAGKQGIPQPLSGPCRRGWLRGAAASRRLQQRRGSQPETRTGDDDPHRLLQQLVLSGNLIKEAVRRLHSRRLQLRAKLPQRPLLGPLSAPVHEPPSPRSPRAACSDPGASGRAQLRTGDGVLVPGS

SEQ ID NO: 373 - DNA, 31477 bp, Mus musculus
  misc_feature (1)...(31477): n = A,T,C or G
cttcaacaagcaatgtatttaacatgaagcaacataatgtccataggggacagtgtgatttacctcatacgaaaatgtgattatagccgggcatggtggtgcacacctttaaccccagcacttgggaggtagaggcaggtggatttctgagttcaaggccagcctggtctacagagtgagttccaggacagccaggactacacagagaaaccctgtctcgaaaaaccaaaaaaaaaaaaaaaaagaaatacttggctttctctatcttatcagtcatattttaagaactccaagaatagaagccaggttatggaccacaggaagcagatggtcaagtctctgtttgcaaacaggaaaagccctgcaagtgcttcccctaaacctcactgtacacagcaccttggcttctgatgactgcctgtgcactcacaagtactacagatatttatcagctccagttttaaaagtgtctgcacactcatgtcccatcagttctgtatgagaacttctggccagataaatgctaggtttctgtatcctagcttcgtaaagggaaacctaatctctggagcccacaaagaaagatgacagcacctgagcctgccagtaaaatattaattaaattgaacaaagataaggataagggttttcaggtacacaggatgtctactcttaagaagtccataatttaactaggaaggaacatccaaagtagaataaattaaaatcacaattcaaggattaaataagtcagagtaagacacaaaagagtaaatacacctttcttggtgacacgaggcaagagggcttccactttctaagtgcacttacatagcccagcctcagtcctatccaaggggtgaaattcccaccatgtggcttaatatgctgattccactcagatttgtcatagcatctgtgaagctttacaccttagcttttgtggtgtctaggtttgttccatcctctgttgttctacatctgaagtgggaacactagctaaattaacaaaaaagaattttttaaagctacaaagaacatgaaaaaagaatagggggaatttagtcttctagaagattctatccttaccacctggaattgctgaagtgaatgattttagaaaatggtgcaatgactaatgagttacacattcagaggagataagtaaaagatattctaaaaacagtcagattactacacagaggccaggcatgacggtgcacacctgtgatcccaggagaggatggatctccttgagtttgaggacagcctggtttacccagtgagcttcaggacagcaaaactatacagagaagaacaaaacatagacatatttgtgaataaattataagaatggttacagatattatgagccctaagtacacagactgggaagttctaagcacttatgcattaaatcagtggtcacactaactgagcaaggtgagggactttcattattccaagcgtagttatgagaaaattgaggtacagaaagttttagcaacttttccaagtataacagctggttgctggcagaactgaataaaataaaaactagaatccttagatgtaaagggtattgtttctaggaaaatcaacagtgtaatttggtcttctaagtccagtgcttctgagtgtagtttttgttttttgttttttttcgagacagggtttctctgtatagctctggctgtcttggaactcattctgtagaacaggctggcctcgaactcagaaatccacctgcctctgcctcccaagtgctgggattaaaggtgtgcgccaccactgcttggccctgagtgtggtttttgatagattttttaaattttatgtgagtgaatgttttgtctgaatgcatagaagtgcattgcatgcttgcctggtggaccaaaggcagaagagggtatgagatcctactggagtcacagatgattttaaatagccatgatggtgcagagagctgaatcctgtaagaatagcaagtattcttagctgcggatccctttctccagtcttaagattaggttcttttaagtcagctggtattagttagaggcatgaccatgtgaccaagtgttacagatctggccaattaccccatcagctctaacatatcgcaacctccgttaaacctctgctgctctagtagatcgtatctggggttctgaccggtggataatcatatactagttattaagagctcagcacaagttcatgttcggtaaacagtaaccgagtgctcttcatccttttagaaaggtcctacctcatccagcgaggcagtggaaaatagtgatgaatgaaataaaactttttccggcactgctactcaggcagctcagctcagtaacaggtttgttagaacaggctttggcttgctagcataaagagtgcctaaaagggtccgtgaccctagaagctacttccaccaggcagttgctaggcgacctcctggcatcaggacagaggcagggcagccacgcaggtcccgcctccactttccgccctagttcctgccacctctggcagccagagcgtcaacgcgagcgaccggctggaggaccggcggcgcaagcgcgctgcttctcgcgccgcactgagtgacgcacgctcccgctctaggcctcagcctacgccccgccccctggtgggactgctcccgccccgagccccccgctacatcttcccaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcctgcggacggcagggacctggccccggcctggatctggagccgggagggcggaggctcccagcccggaccgatgggcggggcccaggtaagcagcccgtgcagggagggactgagtcctaggcgcagcggaagggagggttctgagtatagggagggtctcagtgtcactgtgccgtgagaacgccgagcgctgagcgcggggtttggaagggaagggtgggaggagttaagttcttggggggtggggggtgtcatgtgtcggccacgcccctacaggaagaggggttcatgtgtgtgtgtgtgtgtgtgtgtgtgtgtgtgtgtgtgtgtgtgtactgccaggggatggggcaataggaagggctcccaaactgagaaattggggctgttgcaaaccggacacaggcctcaaatattccaggagagtgctctcgggagtggccctgtgaaggagtttgaaagaaattgggaattgcatccttggcatagttttggaaacagtgggggaggtgaggttgcagggaatgcctgtgaaaggcgccagaggctagtgctgggtaggactgacaggaggtaggagattaaaacactgaactccgagagaaccttgagagagaggattagtaagtggtgttttagagaacagtagaccctattcctgtatttttttagaagacagtcttcccataccgacagtacttttggtaacatttctgctctgagaataggcatgacacaaacacacataaacacatatgctcaaaatgatggggatacagtatgtgcatgaaggatgtactttttatacaaattgtgtggcgtactcaagagagtttgttgactgaacacggtaaaggagtgtggtgaatatggaagtcttagaaatccactggggcatgtattagattagagtgtcatactgtttaaatgttccacaggttcccacagagatcagcctcccgggccatgttggtgttaaagcctgtttcttctcctgagccccggcagaacacaagtggaccagtggatgacttctcttgtctgagcaagagatggcctaatccctgcaatctctctaccactggcctctgagctgtaaaagccagctggatgaagggatgtaacacgcgcctgggagggacactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagtttaggtaggtgaggttaggtcaaggagagccctcaaggaaatcaggcttcaggcgggctgttggattagttacctttaaaagcctttcttccagtgagataataggatttcaaatcagcctgggctaaggctgaagtggattactctggccgatgcaggctgctctgttttggaaatctgttgacagagtaagacttcaagggaggtggggaagggagctggagggtaagaaatggttagatagcttactgaaccatctctctgcctccttccttccgcagtaaggaagcttaggtcatgaaatgtcctggaaagaacacaaacagagcttgagtttggggaacagtaaatctgtggtcgagctcagactttcctggtcaatgtgcaactcgagatatgataatcacctctgtccccttctcctcacactagaagatatttcagtcaggttgctactaggaacaaacggaataatttttacattttgaaagtaccctaggccttgtacatataaaacggcaacattaactatactggatttcttgtttattgtaacacatggaaaagctctgaatggaagttggttcttttattgaatgaacatgctggctagagccacagcagacatattgattgaaggcctgcagggcaatggtttcatcatgttatataaaggtggacagttttaggaaaacttaaattgagggatcctgcagctttggggatggaagttttaagaagagctagagagaagacagaactgtatttctcggaatgggtgctgggccttttctcttgagtcatatcccatctgttctcaggtgacaactgcctccaaactggcatctcttgggcttttagttctctttcggttgtttatcacccaagcaagtttgttcttagttgtcttggtacctgcctgcactttgcttggacttttttttttttttggaagctcagtttacttataccaaggtgcctgcttttcttagtgatgatgtcaacagcaaaaagcaagagattcggtggatgaatttgaggcagcatatgctggccagggctagcgagactcattgagcctgtaagtcaattacagagggacatcgcagtcactgaagacaacgactgttcttcttgtcataggagtccctgtctttcctcagtggcctgaagcctgagaagtctgccctgaataggtcttctggctctgagctgtttatcttgtctgaagcttgtctggactcctgaagagaccagacttttgtgtgtgaatcatggttggatgcgtcaccttccctccagccactcaataaatgcatggttgccggtctttgctcatgtatggggatcatgatttcttatggcagtgcctcctgagtgacctatagggcatgatatgttctagaagacttcctagtcctacggaggagtccctcctggcccgtgagtacctaaagcacccagagtactgaggaggtgtgttgcattgattgatggctttcaaagtgtcaggtctgttgtctgctttccctcagtgtggggattgcttttctagtttgaggaggagctatggaggccctgagcagtaagagctcactgaaggggtgtggcatatgctgattgtacttgtgcagttgcctttagcatcagcctgccagggagagaaactgagtgccctgacagcctctctggtaagtcctctcctctgtaacatgagctagatagaggctttcagctgccagaacccagctctcccatctcctgtgactctttggtcagacatttctttccagccttctcatgggatcagcagattgctagggtaccacactcaagtgtgtcaggctgtttagccaggactggtggtaaatttaatcacacgttgtgtggggatttttaagtggatttatttagaccttactttattctaaaggaagcgcaggtagctaatgaaggatttcagaggcattgctcagtgtctacattgttagtaagcttgattttctttctctatcactttgtggtttgggacagacatgttaggaagaatgagaaaggaaacttaaacaccagtttaacactttggttttgtttcctctaacggctttaagccaaggtttcttcagaaattcagagcatgagtcctttccaaactgcaaacactttcaggtagccaggctggagtttgtgagcagcaatttcctggaagtttttacttttttttttcttaagttcctttttggtggtagcagagtaagcaggcaagcatattacctcttaattctctgttatcctgtgactagatctacctgttttttccatttgcacataatctgatcccaggctcatccccagagtctagacaggcagctcccatttcttactttcttccctagtgtaagctctgtagagcccaaggcctcagtactgatacgtgcttgttgcttagaccaaatactattacccttgtttaaaatttacccaatccaaattctatgttgtagcctattttttttcggaggcagggtagcctttttgctggggatcattctgtgagccttggaatttaaacaaagggctgaagagatggatgtggtggggagtttctgtgttctgacctgcttcctgtctaagtgccttggcaggaaagtcactctgacatggcctgggctgcctcgtcttcaccatcttcaggacctactatgtatggattttatccaggatggtgatttgtgctccttatattttggatatcttcagaccagtttcccaactttttacacatccagggaacttggtcatttttttctcacactttggcactgagtgtgaaggctataagtccctaattcctttttatgggaagtagaaagaggcctaaagtatataaacattggcattctcttggcacatgcatgggcttgactttcctgtcacagtctgtgcagtcagctaaactggaaatagtgggcatacacacaccacacccacacacagtcctcctccctccctcatgcgtcagccctttcctctacgtgagggcagaattccagctgctactgtgaagcttctccgctgccccactgtgtcctgtcacatgggcacaaagccatctcagcagtccttctcaagggctcaccagggtaccaggtttggaagctgaaatgcctaaatctaaaatctggctatgacttctgacttaacagcttccatacacccaaagcctcagacttctctctgctgagctctgcagagatgcgggagagtgtacagagaggccaagaaaacaggcttggacggaagggcagcttcctagtgtctcctgacaactttgttttacttcctcacctgcccacaagggcccttaaggtactcccactttctgcataattcctggtgtctggtacgaacaagttagtgagtaacactcagtaagcacagacctaaaagtcccggttaccttggggactctggaacagtagtgatgaagtctgtaggtaggagggtctgtctgaggttgagtatatctagtaatcaactggcagtgcctctgctcccctcatgggtgaaagatccaagggtggttggagccaaggcttatgcagagggccaggcacagcaggatgtgggagccagtgggggctgtggtaccatggtgagtggacagtagggattcccagacatctctgattccaaaatggtcctgtcagtgagatgtggcttactgtgagttgctaataatgcacggctcagatctcagaaatagtttgtgctccggggccactgctgacatctaaatcagaccctgaaactcctggttgtcatctttcctcccccactcaggctgcttgaggctctgattgaggtacttaccaagtactctgttcagttgggtcctgatgagtctccctgcccctcccatgtttcttttgctttaaaaaaataccaaggaatacagatccaggggtttccttccccctcccattcatttttagggttactccaaaagcctgtgattgattctttccttcctcaggacttaggttcagtgtacaggcctgactttggtttccccgcccataaaggggcacacacacacacacacacacacacacacacacacacacaagacagaactgaaacggcggcaggctggctcttacccaccttgggcagcaggtgtttcctccctatcttcccttttgaaaccgaatacttgttgcttgcacaccctcacccctctcttgctgtttttttttttcaactaatagtctgcaacttccctcgcatagaggaatggttcccaggttcttagaattgaggttggtgaacgctcttcttgctgaggaaacgcttctaacaccaccaagtgctgcacccctcaaagtcggtgaatctctagattcactgggctggacaagggacactcttgggaaaagtctttactggacaaggctcagggtgtgagtggggttggcatctacacaggagctgcaactgagagggaaagggcctcaaacaaacatctctgctaccactgcctttcgaagttgggggacttgggaagacccgttgtttagatcttgaccggtgatcaggaagtcagcagtagaggaaggccctggaaggaggggccagcgcggactcgcccgtggcagggcggggaccaacagaggggcctaggggctggggagcgccgccccgccctcccggggaaggaccacattgccggctagcaggaaggccaaccagaccggacgaggccgctccagcgctgggtgttgccggtccggggcgagcctggttccaggcggggtgagttgagaggatccggtgagctgggccgggggacgccagcgtcctcagtcctggggcttgtcccaggaggacaaggaccccggaggagagaggccgcgcagccaggggagtcgggtctgagtcccgagtgtgctccaaagccagggcggtgagagtggcgggcccgcccggggccgcgcagcgcgcagtctcccccacgcggggaagtgggaacttaacgcacagctacaggattcctggccttcagctgctagagggagggtggcttctccaggaggagctgttgtgaaactcggcaggagggcaccttgggtgcggggcagggcagggcagggcaggggagagatggggtcgccctgaagaagtgggagactggagtggaaagtggactttatgcaagcctcaccccagcgtccaggcttcataagttactagggctggcttttgctcagccacaaggaaaatttgactcaatgttgaaatatgtgatttggcaagaaaactttttttcctagcctcctttctagtatgtttggaacagggggctcccaagaggtgcagagcccccccattgttcaaaatgtggttcagagggactgtggcccacccattcgagtctccatggaagagtggccttctggtgaagcttctttttctttaaccttggctactgtaaggctctcgtgcttgagaatattgctggccagcttgattgcctgtcattagtactatttagactagagcgtccttgattctggggtcttcccgtttccagtcactagtccttgactttttagcatggagatcaccagtaatggcaacattacatcccacttctgtttctcagaaggctgtattacagtgtgttcaaactccatgtcattgcaacaggttaaactcactttctgcttcggacgtcaaggtattgccattctaatccagacatcaagggcggtggagaagacaaaagtcggttgtctgtttacagaagaggaactgaggcagtggttcttcaggtaacggcttcagggctgtctgtctggtgccaggctatagcagcattgtgtttccctttgacctgttcccaggtgaatagcctgtatccctcctaggtcttaccctctatactcttgaattatttagcatatctactcggacttcttttcagttcttcttcccctctgaaattatggagcctggtacatcatacagagtctaacaagaaagtaattcacttagagagccgttatctgtgatggacactatgtgctctgtacttgtttaagctgtgcttgctatcatactggcaaagcagaaacaggagggacagttcatcaacggttcttccatttcgagacttagttgtaaggctagagtaatggttgctctactgctcctggctggaagttgactatttgctgtttgcttgttgcctaagaaacagcctctgacagagaggggcaagcatggaatccagagtgttagaagctagatgtgctagtgcacgcttgtaatatcagaactctgcaggctgaggcaggaggagcatcaggtgtagtaggcaagcttgcactatgtgcaccgtcttagaaaggagcctgctcttatgcgctccttcagattagaatgtgagaaggccccagagggactggcaagacttgccagagccacctggcagctggcagaaccttcagtatgccgagactcaggtctcaccccaccatggtgcaaatgttgttgtgcgtggtggtgtgggttcacctgctagtttcctcaaaggagtcctaaaaacactggaaccatgaaagcaagttttaaactgagtgtgcatattacaggcaaatctcataactgatatattaaaaactcagttcagggttgatggatattttattttgttatttgtttgcttgctcttgttgtatgttatgttttgttttggtgtatgtatgtatgtatgtatgtatgtatatatgtatgtatttgagacagggtttttctatgtaaccttggctgtcctggagtttgctctgtagaccaggctggccttaaactcaacagagatctgcctgcctctgtctctggagtatgtgatcaaacgcatgtaccaccatgccccgcctagggtattctatttttaaaaggaaaatatggcaaaagagttttcaagaggctttgttcataagtgctgttgcagtttaactttgtcctcttctcacacactggtagggttttccattttcatttctctttttaaaaaatatttgtgcatatacatgttttgcctgcatgtatgtttgtgcagcacttgcatgcctgtttttttcaaaggcctaaagaggccctttgaattggagttactgagagttcagagctgccatctaggtctgggagtggaacctgggtcctatagaagagcagccagtgcttttaacagctgagccggctctccacctcattgctctctcataggaatggtaggaactagcagtctccttaggaactgaagaaagcaaaagtgagccaaggctgcctaaagaaaaagcttcaactggccatgccgttgacgtcttggagcacttccttctctttggaacccagccactgagttcactggaagcctgggccacatgaaggagcacatgatggtgactccggccagtgtcccagtcaacatcaacattagattacacatgtgttatggaccatgcatctataggaggctagccttagcttttgagtcttccaacccgaggtcccaacgtaaaacagacaggtccttccctctgtgccccactttctaaattcttcagctattgctattggatgaggaaataggtgattgttacagtcttaagccaaagaattttgaagcaatttgttatttgcccccaaataaaaatactggtaagaaatgtaagtacagttgtctttaagactgaggctggggacctgaagggagcaggtccagagagctctcaccctgcttctcgggaattctggtccattttctcgtgattgcaaggactgaatgactgctgtaatgagttatcccaaacttccaaactttgtgggctgtgggctttcatgtcgcagtccaatggggctggttccctttcatactctgtggttgattctggcgggcggtcagctggaccctcaatgtcctaccttgatctgtagcctggattcggctcaaccttcccgagtgtctcctgcctcattacaggtgtgctccatcacactcaggtgccttgtcttttagggatgacttgtaggagtcacagggtctcagaatcagaacgagggaatgtggtgctccctcctcccccaaggaaagacgtccatcatcctgaatgagaagcttacaggaggggaggtgtggcagcatctgtgcaaagtgcagttcttcactttggctgctgtttctatcgtcattctcccttctttagttaatactacagatggtccttcatgcaccctctcatcacactgtacacatggaccaagcaccgtagcgggtgtagaggacacagcctcttttcttaaggagtgaggtaagagctaaggaaatacagtcttggattctgttacaacatggagagagtgcagtgaagagtcgtcatgggaggctcgcttgtatctgggatgtcgtaagcctaaaggatgtcaatgttcttaggtggggtatgggttacatttcaggaacaaagacacaacagtgtgcaacagtagttactggagaaataagtagccttctgcggctattgtattggatccacgtcgtttgtggttggaaatgagattgcatcgggattaaagtctgctgttgtgaagcccatttctgtcaaactaagaagttttcatctttttcctgtgggcagtggcagcttctgaaggcttttaatattaatgtgtttaagattctgttgctaccagaaggtatttagagagaagccacaggtagactagattagctggggagctaacatcagaggttccagcttaaaacaatattcataataaacagtccaggtgagagggtgtgaactgaggactggcagtggacggtaactttcaaccctggcataactctgaggcttctagggctgctcacatttctagagttagaaggggttcgtgaggcccaacccctgacaggagctgtggacagctgctggcttcagtgggagaaaagcatgagtttggtttttttttaaggcgtggctcccgcagcacaggaagacctccagagccagccagcctggacccacagggctcacggagactgaagcaccaactgaagagcatgcaggaactggacctaggctcctgcacatatgtagcagatgtacaatgtggtcttcatgtgggtcccataacaattgaagtgggtacttctctgactcagagtctcttgcctgcctttggatccctttccctagctgccttgtctgtcctcaggggaagaggatgcacttagtactgatgcaatttggatgtgccagggtgggttggttccccggggatggggtcggggtgccccttctctgaggagaagaggaggagggacgagaggaagcgggtggtagggtggaaatgggaggagaggagagaggggagctgtgatagtgatctaaagtgaatgaataaattaatgaaaaaggaaatgttgctcctggtaggtccaccatggtccagggaatggctcgacactcatgagtatatgggcagcacaaattggagtggaaacagggaagttgtgggtgggtttagtctccctctctgtctgtctctgtatctctgcctctctctctatactctctgtgtgtgaatgtgatcaaaagttatacagtatatgaaattctcaaaaaaatgatctggtgtacgtactctgttataagatcagaacactgcaccgtgatccaccatgcttatttctgtagcgaactgcgaatagacaccgaggtgcaatggagaagattgttagcctcacattaaattagatcggatgctgccggatgaggtgcaatgagatgttattatcaaatgggttttgaaaacttttttgggtgcattttggattggaatggcagtggagagattgcatgaatgtggcattcatactgaagacgctgtgtaggctgcaggtgcatctgtgtaggctgcaggtgcatcatctaaatgttgaagttcgtggcttggcagtgcgtggcgctggtcccaccttgtgttgtcttttgctggttccactggtgtggatggtaatggggaggtgtactcttatgatctgaaggcatcaagaaagaatatcttggcatttattttgttatgtagctggtactgttctaaatatgctatggaatatctcatccaatccttaaagcaacttgctgaagtattcagttatgctttccatcttagaggtgagaaaactgagtcttacagatatagaaaaacacaggctgatggcaagccttgcttcttgggtatctggctttgattattattattattattaataattattttaaaatctgtaccaaagtgcatatggtaccagaggggactgagcagtgctccctggaggagcttccaccccatcagccaaggctcatacctctagacatggcacctgctgtagatgtagatgtagatgtagatgctgcatcattcccagccagtgtaagttcatacactactaacatccagacgtggatgaacgccctgccctgaagagtatgtaggaacatgacacagggaatcttgatgagtctgtgtggagaggcagctagggcttcagcaggggaactgtgcattcttgtggcaaaagaatcaagtattgttggagggttcatagagaagggctgaggaggggggtaggaagagactaagagccaaagagagagaggtttttctatgagctatccagccactctaaatggctgtagacttgctaaaaatcctgctgacaggcaatccaggcttgctttgatctgcactctagtgaatgcattgcacctagttcaacatctagagaaaacaagtcatttgaaagtaaaatcacttgaagggtaagtagggatttcttgaggatttgccgccattctgagaacttgcagatagaactgaagtgacaaatcaaggccactgtcctatcccagtcatttaaggtaattcctttcgctgtttgtctcccatccttttgttttaaagactttcccctacttggtcacctatttagaaagcaggaagtggggggaaatcctgaaatcctggccattggaattcttgcaaagtttcaacattgatcacattctgtaggggactgaaggagacctggcaactggtgcatctctcatctctcaagaaagtagtgtaatgacacagctgagaggaagtggctcaaggtttctgctacatggcattctggattgtgtgggtgcttggttttaggaggaaatctaatggccaggagcttggaaagacaggacccagatcagagggctgcagagctgggattcaaagttttagaaaggatagagaatagggtaagtacagagcaaggctgattcttgtgtcctggcccttccaagagcctagcaggagcaggcatatgattgaggggttccaggtaaatctgctcatctctgcttcccttactgcatgtccccacctggggcaatactaatggatgaagtcactcggaaatggactccatgttgccttattttattgcttatgaaactttatttggaaaaaaaaagtttaaggaataaaaatggcccttcagagtgacatacaggtattattcattgttattaatgtcttgctccattcactctgtgtagctatgataatttctgttctgaactacttgagggcatctttcatagacctttgccccaaagatttcattgtgtatttattccctgagaattgccatgtcctctcttagatacctcagtggctatcagccactacacatactttaacctactgtctgcatccagttttacttgatgattatattaaagataaagtgtcttactttttttagatttttttctatgttatatgtatgagtgttttgcctacttgtatgtatgcattcttgatgccttcaaaggtcagaaggagacaaatcccctggaactggagctgtctgtagatggctatgagctgccttgtgagttctgggatctgaactctggtcttcttcaagagcaacaagtgcttttaaccactgagtcatctctccggtcccttagtgtcttttctataagaagaggtttattggagtgtaattgacacttgcatttaaaaggtacagtttgttttgatatatatacacacacacacacacacacacacacacacacatccattaaactatcactgtaataaagacaataaatatatataaataaatgtttatatatatatatatatatatatatatatgtgtgtgtgtgtgtgtgtgtgtgtgtatatatatatatatattaaactatcactgtaataaagacaataaatatatccactcactcgaaagttcaactgatttcctccagccccaaattgagaacttaggttcctcagcagtcactaagagacttagtcaggttttaattattattattttttttttgccagtttcatgagtaacatcatctcaagatagttttaatttgcattttgcttatgcttgaagttgaacattttttgatatggttaaggactgtaggtatgtatttcttacaagttaccattattggctcattttctatatatatatatatatattaaacttcttttttatttgaactttccccccgagtgtggtattgtgtatctgtggctgatgctacagaagcacccagttggctctttggcttccttgtgcagtttctatctacacagcagtctttcaagtaagaaggataccagcattcttttgttacaccaagattttgagtcataattagaaagcctttctgtgcaactggatttcctcccatcctttacatttgtttctttgttttattttgtttttaatgttttaaaattgtggtgcacttggtaattattcttgaatattgatacaattttacatttccccaaatgcctgtatattccagccctgttctagtccattggttagtctgcttattcataactgtctagttgctggcctttagtggatactgctttgatagctcattaagaggtccctccttaccactcattgttagtgtttgcctggtgttctgatgtgtgtgctgcttcttgagagctctattgacttttttttgtagctccatacaacagctttgttgcttttgtttgtttgtttatttgtttttgggtttttttttttttttcaaggcaggatttccctgtctgcatagccccggctgtattgaaactcactctgtagacaaggctgaccttgaactcacagagatctgcctgcctctgcaaaagcattttcattgaggtgtttgatggttccagtatggtttaatgaaggagagagatgttgaagtgtttttcagaaattgtaattttgtttcatacaagtttttgaatgcttaagtttatttttaaatattttgttttcatggatttttccatagaattttttaatgtccattacttcttctagttattattgtggatatgagtatatttgtatgttagttgtttttaccattgattgcagtataactgtttctagaaaccctcacatatcagcaaacagatagttctacttcggccttcagttgtttcatttagtctacttgtattggctaattaataaccattgagattgtgggcgtcatggcttttaaagttaatatattactaccacacagatgcatctatcttgctttggttgtacccactctctctctttccccttctcattccttctggactgcaggctcctttccctttcctaataatctatatcttttctactaccctccttcttttgtttttcaggacacagtctctctgtgtagccctggctgttctagaacttgctctgtagaccaggctggccttagactcagagacctgcttactgcagccaccacctcctcttcctcttcttcttccttctccccccaagtactggaattaaaggggttcatcaccacacctggcctcccctctactttgaagttgttatttgttaccacagtgagagaaaatgtacatatttggcttttgcttaacacagttcttttgacaggattatgctctttctggctgatactgctccattgtgtttctaaaccacatttgtgtatctgttactctgtcaccgacaccagggctgattacataacttgcatattgtgagaagtgcctctataaacatgagtggtgtaggctgcctagccttgcttctgacatcattgtatcaaacaaagtgacctggacacagagagacaagtgttggcttgcattgtattcctcactaagtcagttagaacatttgattaaaaaaaaaaatcagtaattttagtgcagtttgacatgaggaatgggggttaaatggtcttacctctcactcctgatctgacctagactagatcaaaggcaggagatgaagtctgtgtggtagggaaccaggagttggagtctttccattttgttttattatttttcggctctcttccacaagcaccattctctgcctccttgtccaagtcacattgctttcctgaggactcattagctcgttttgaagtggtagagggaacatgtcagcttaatcctgcagtcagccaccctctctcctccttcctcagtctctcacctgtgcccagcctctccccactgctgtgtggaattatacaaacttgaggtaacaattggttttctctctccccctctttaggtacatggcttcttcctactctcagcctagaagaataaacccttagtgtggggacctgagccaggcaagccaaaggcagccttgagccctccctcccctgccctcccctgcgggggccaggatgctgaagaagcagactgcagggcttgtgctttggggtgctatcatctttgtgggctggaatgccctgctgcttctcttcttctggacacgcccagcacctggcaggctgccctcagacagcgcccttggtgatgaccctgccagcctcacccgtgaggtcatccacctggccgaggacgctgaggcggagttggagcggcagaggggactgttgcagcaaatcaaggagcattatgctttgtggaggcagaggtggagagttcccactgtggcccctccagcctggccccgtgtgcctgtgaccccctcaccagtgcagatccccatcctggtcattgcctgtgaccgcagcactgtccggcgctgcttggataagttgttgcactatcggccctcagctgagcgtttccccattattgtcagtcaggactgtgggcatgaagagacagcacaggtcattgcttcctatggcactgcagtcacacacatccggcagccggacctgagtaacattgccgtgcagccagaccaccgcaagttccagggttactacaagattgccaggcactaccgctgggcactaggccagatcttcaacaagttcaagttcccggccgctgtggtagtggaggatgatctggaagtggcaccagacttctttgagtacttccaggccacctacccactgctgagaacagacccctccctttggtgtgtgtctgcttggaatgacaatggcaaggagcagatggtagactcaagcaaacctgagctgctctatcgaacagacttttttcctggccttggatggctgctgttggctgatctgtgggcagagctggagcccaagtggcccaaggccttttgggacgactggatgcgccgacctgagcagcggaaaggacgggcttgtattcgtccagaaatttcaagaactatgacctttggtcgcaagggtgtgagccacgggcagttctttgaccagcatcttaagttcatcaagctgaaccagcagttcgtccccttcacccagttggacctgtcgtacctgcagcaggaggcctatgaccgggacttcctcgcccaggtctatggtgccccccagctacaggtggagaaagtaaggaccaatgatcagaaggagctgggggaggtgcgggtacagtacactagcagagacagcttcaaggcctttgctaaggccctgggtgtcatggatgacctcaagtctggtgtccccagggctggctaccgtggcattgtcactttccagtttcggggccggcgtgtgcacctggcacccccacagacatggactggctatgatcctagctggaattagcagcacctgcctttccctcctgggtctccttgccgcgtgctgagccgaggcaggcctgcagggcctgggctacaccatcctgccagtgtctccctctcagtgtctccctcttggatctgtagatcttccctttgtgtcctggccagcccccaaatggcattctagtgcacaaatcataggatgagagttatactcctgttgtcaagggagtattgtgtggtatgttcggggcatattgaacaagaaaccactgtgtggtatggggagggttgggcctgttggggccaggtttgtaatgtctccaagggcatctgcagagagcttggcagctccagctctcctcagcaggcctctccaccctgatctggcccctgttagcccatgagccctctttatgtacccatcctccctttctgaaccttccctcagggtggggctggattatggaggaaggaatggatctttggtcagatgagactaacagagggactcactgtcagagttagcgtggattgctgctgccggggcactacctcctggcttctctccctgctgacgtggctcttgtcctggagcagagcagtgcgttgttgggagatggaaagtctatgcgtgggtaccctgtcttcttgcctgtggcccccctcctttctgaaagttagttctctccgcattctttaggaggattcaggggcggcctagtggaagacagtgggctccatgcctctttcccctggggtttgcttcaggggctcctccccgagggcttgctcctggtggcagcagctgagatcaggacatctgtggccctgagccggctctggtcctcggcctttcccagccttcccacatcttcccaggccaagatgcagggggcaggctgaagagaaatttgtgtgtccttgtttgttgcctgatcttagtttcatggaagaaaatggaatctacagaattattttcaaaaataaagtaaaggctgaattgctgaaaaataagtgtgtgtgtgtgtcctagggaaggaggcgaaggggtgggggaggggttggcaaagggagagaggaaagtctacaggacagaaagcaagtggacacctcgaggaaagagaatgagaagaaaaatagggttggggggagtttgggggacagggacagttgaggatggggccaggtgaggtagcaaggccagcttgtgaggagggccctaggttgcgggcctgctggtaatctcaagctggccacaggctcctcagttggcaagtaagtctgggagtggtctgcaaaacagaaatagaaaaccctggcatctgaacgttccacgttgtgccgcataccctttgctggctcaggcagcgtctgttgggcaactccgaaagctgccagtgagcccagggtttgtagtgcatatgtggcaggctatgcagtggcacctaaggctcctggtcaggataatgacaaccagagtatgtctgtcccaccctcagagttgactgaaactttacacatatcaaaggcagcattctgtgcgtgtacatgtgcgtgtgtgtgtgtatgtgtgtgtgtgtgtaggtacaaatgtatacctttttatgggagccctattcctcagaacactgtccatgttacttattgagacagggcctcccactggcagagaacttacccattatactaggctgcctggccagtgacccatgccagggatccactagtttccatcttcccggtgctggctgccacactggcatttatttgtacatagataggttctgggggctgaactcaggttcttttgcttgcatcgcaagaactccgttacctgggttacctccccaggtcaatttttttttttttttttttttttttaacaaattgatacttgaaaactgaggcaccgacttatgacaggatctaatttggatcttgcctctggtggtagaaatcactgggtaagctctatccagcagggaagaagagggaactagtggccttgtttgggggcttagggctgcagaccatagagtggaattcatttcccacatctcacccctttacttggtggccttggttgtgtccccccttgttgctctgaggtggattgacattgattttgattttaaagggaggtggttcattgtagctacagacacagggattggagagaagacacaacatccctgaccgtggaggggggagtagtttgtccggacttcatggtctcagcgcttaatgtatttaacagtcactggccacgtgctttgttctgagcactgccagttctgtgttactgcagtctcaccaaaggagaggcaagtataagagaggcaaactcggtcaggcccatagggatggcttgggcagacccaggatttggacggaatgcatgctgtaaacaaccgagatactggttatataaaggacaggtactagtctatcctttaatgccctcttcaacacccctctccagcctcatttgaccccaaggcagcaggtgatagcagacttccagactgcagttggtggtctcatgccgtgccatggatgctgggtggggtagagtgagtccaggacatacaaagcaggacaagaaggcagagaataacttgtggcccactaaagctgcacggatatttcaaagcagcctgcgctcctcagcgtttccttgaaacgagtgcctttttgaggcctcttcgcattctgtttgcttttgaagtatgccccaaggtctgcttgctgctcgttatggtgctcttggaggtcacgtgttcagagttgactaggaacccccgtgctcctgtgttcctatggaaaccacgtgggcgtggcagctgaaaacaccatactgttaatgcctttgccttctgctaccttttggtttagagagtccacactcaccatgaggtcacttatgccctttcactcatgactctgaggacttcagaactgctatctatgccttccgtatgtccttgccctcttacctaggtctcattgacgtttgtggtgcgactcaccccagtgtagacaagatgtattgggtggttcttccccccagctccatgctcccagaaataagactcaaactccaaatacatttacatttggaaatatccttgcccatataactaggctcttctttgattagatcataaaaaaccatttattctagcctaccttctgccacgtggctggttacctgtgctcaggtaccgtgtgtctgtctcatcactcgttcctgggcaaatttcccgagcctggcactatcccagaatcctttctgcctccaggatgtcccacctcctgtttcctgcctaagttataggccatcagacttactggcaggtgtcacctccacacggacgcaggatgttctctacaggtctctgtggcagggcttctgagtgttcaatagacgtccacatctgatccctgtcgggtgagttcctagagctgaagctcttagggaagactgaaagggtgggagttagaaagcaattaccatgctcggttggaaactcttactaagaatgtcttctccccttcattacataatttatgaagacaaaacggatgacaataacagctatacttttttttaaacgagattttaaaaaatttgttcactttttattccaatatcaacccctccctgtcttctcagtataccctcatgcagatcctccccccatttctccctccccatccccccaacacatcaagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaagtggtttgctacccaggaagtccttggtcctgttttctacccagcacacttgactagcctggtacagtatcagagggaatttatgtttggatgcagaggttaaaggccctttcagctaagggatcaagagcactgttctcttcccagaggctcagagaccaagcctggtggcacagatgatccaggtgtgatgggcctgagctggagtctgcactgggcacactgtctgtatgtctcactctggatcacacagtggtcctgccagcactttagtctatgaggtcaagatagtagtatagtagtgaacggggaccacgtggatggcaccgaggttggtctgctttgcccccaccccccttgctcatttgaagtgtggctcttcctactaaaactgtaagtgactaagaactagatttagctccccgcaacaggaaatacagatctaaagaaatgagagccaggggctggagagatgactgatcaatgagaagtatgtactgcccatgccagttcagttcctagtacctacaccaggcagctcttctgtaactccagttccaagggatttgaccccttatgcttcctggggtacctacacacatgtgctacaatacacacacactcaggcacacacacacattcaactaaaataaaccttaaaaaacaaaggcggtggaggtgatgtaggcctggcatagtggcttctgatgttatcagggcctcagatacctgtgtcgggctcaccctccttagcacaaggcctccgttctaagtgtcattccttggctgcaagagttccagctaacacacacacacacacacacacacacacacacacacactcacatacacacacactcacacgttaggctgggagaaaggaagacaggccagaggagggtctgcagtcagtgcctgatcaaaggttcacggccactaacaacacacaggcgtgctgtcagcaaaagagattacgaaagaaatccaccagctgagttgatttttagttaaacattattaccaagaaaaacaggagtgaaggttatgctttaagaatcctgcctgacctggaaaaggtaaaattaaattcccgggaaccctcactggctttggtgagaactgtcctgctgtcctgtcgtggtggtgagactctcaaggtcacacaagagtagttttcttaaaggccacacacatctccagaagtgccgattgacaggaaacacacaccgatgaaccaaggcgtcatcttcaacgtgtggctctccgctcgccttccaagatggatctaggcatcaggaaaggggaaaggaggtgcacacacgcgcacacacacgcatacgcaagctagaactcaccacaaccctccattctttcccagaagagaacaattagcacacactgggaacagttgactccatcctactcaaggctccaacagaagtcattgacggtacattagtccctttatgccaccataacaaaatagtagacacagatcatctcggaagtagaggtttattttggcacgtgatttggaaggttcaagtctaagccgggccacttggctgcctggtgggaggatgcgtgtgtcactgtgactgctcacatctccagctaagaagcagaccgatgagataggccagggtcctaccgcttgctttagggagcacaactccaagtgactgtagatctccctgtccagcacacgactctggggaccaagccttacatatggctctctggagggtgtccaatgtctggctataacaacaacaaagaagcttgtgggatttctgcctgtattgcttagaacaatgagtctcattcttcctaaagctgctacactttaataccattcttcaagtggtggtgacaccaaacaaaattatttcaatgctacttcataactaattttggtactgttataaattgtaacgtaaatatctgatatgcaggatatttggcgtctggttgagaactgctggcttagaaccttgggctaaaagctaagcgtgtaagaaatctcactgttctgggaccacctcacgggagaggccagatgggaaggttagtgggcaggaacatctgctgccgtgtgagcgaaccgtcttccatattcagtcctgtggagccttttgaaactccaagcctgggtcagtatctgctacaacttggtgtgaagcagcagctagccagccggtcaaagccagtcagccctcctcaatgtttaacccatgaccagcaaaatgaatggttatttttagctgctgtttgaaagtttttgataagttaaaatagtaaccggttggttaaccggtcggctttcctgttctgtccttgaagtggagaagtctctgcaaccggaatggaatgcttaaacaaatgtttcgcggatgagaaattccagacatttatccattagtaccgaagggtgagtatggtgttctcagtgatgctcactctattactaaggtagaaattatctttgaattaatgggtatattcttttattcacgcccagctttttccagttttatatttgaagtatttttttcaagtttttaattatgagaatttaaacccgtagggacatcgaaagattagtgacccacatttttttccactgagataatacaagaatcaatactttgtcacctgccagctacacacatattataccccagcgcctgtatctgtctcatcaaatacaaggtcacagggcaaatcttttaaaactaacttttaaaattaattaattcacacatggggcactggttttctctgtggcatcttcacatgtgtatgccaccatttgttgttcttttgtccccccttctctgcttgctcaacaccccacccccgccctcttcctttttttttattacgtatttttctcaattacatttccaatgctatcccaaatgtcccccacccccccccactcccctacccacccattcccattttttggccctggcattcccctgtactggggcatataaagtttgcctgacccaatgggcctctctttccagtgatggccgactaggccatcttttgatatatatgcagctagagtcaagagctctggggtactggttagttcataatgttgttccaccgatagggttgcagatctctttagctccttggatactttctctagctcctccaaaattcaggtgacagcagatgctggcgtggatgtggagaaagaggaacactcctccattgttggtgggattgcaggcttgtacaaccactctggaaatcagtctggcggttcctcagaaaattggacatagtactaccggaggatccagcaatacctctcctgggtatatatccagaagatgtcccaaccggtaagaaggacaaatgctccactatgttcatagcagccttatttataatagccagaagctggaaagaacccagatgcccctcaacagaggaatggatacagaaaatgtggtacatttacacaatggagtactactcagctattaaaaagaatgaatttatgaaattcctagccaaatggttggacctggagggcatcatcctgagtgaggtaacccaatcacaaaagaaccccaccctcttccaaaccactctcctttcttcttttgtgggcgctgagtccagcggttctcaacttctgggtctcgaccctcgtgtgagtgtgagtgtgtgtgtgtgtatacgtgcatgcacacacaggcgaacggcccctttcgcagggtcgcatatcaaatatcctgcagatcagatatttacgttatgattcatagcagtagcaaaattagagatatgaagtagcaacaaaaataatttaatggttgggggtcaccaccatatgaggagctgttaaagggtcgtggcactaggaaatgccaagaaccactgccttatactgttaccctcacttctgcctctaagatctcttcctcttttctcaggtcatggtcgtctttctttcaacacacgcatgcgcacacttaaatcaatgttctacatgagaggaaagacggtatttgtctttctgagtctggctcatttcgtgtagcaaaacaatctccggatctctttacttcaccctgagtgttatgatttgattttttttcttacaactaaagaaattccattgtatgcgcacaccacatgtcccttaggtgttgatctgcctgatggacatccaggcggctgcatttctcagctcttgtagacatcaacaatgtaggcgtactggtatctgtgaggtatgtagacccagaatccttcagatatatatgcaggagtggcacagctgagtcatattttatattctatttccctaactctttttttaaaaatatatttattatatataagtacactgtagctctcttcagacacaccaaaagagggcatcagatcacattacagatggttgtgagtcaccatgtcatgctgggatttgaactcaggacctctgggagagcagtcagtgctcttaaccactgagccatctctctagcacttagttctattttcaataaatagtgcagtataagacacatgttcccacaccatccccagcatttgttttcctggcgatagccctttcgactgggatgagataggacatcaaagcagttttactttgcatttcctgctggctacagatattgacatttcaaacagtttgaagtatctgctggtcacgtgagtctcctttgagggtagtgtctatccagatcttcaccccatttgattggatgatggtggggcgctacttttcatcagttctttatttataaatatttttagtaaccatgaagcaatgtgttagtttcaatacaactgtgaaatgtagaaaattagaagcaaatgaaattcattcataatttcacttcctagatttaatttttaaaatatttttattaggtattttcctcatttacatttccaatgctatcccaaaagtcccccataccctcccccccactcccctacccacccactcccactttttggccctggtgttcccctgtactgggcatataaagtttgcaagtccaatgggcctctctttccagtgatggccgactaggccatcttttgatacatatgcagctagagtcaagagctccagggtactggttagttcataatgttgttccacctatagggttgcagatccctttagctccttgggtactttctctagctcctccattgggggccctgtgatccatccattagctgactgtgagcatccacttctgtgtttgctaggccccagcctagtctcacaagagacagctatatctgggtcctttcagcaaaatcttgctagtgtatacaatggtgtcagcatttggaagctgattatgggatggatccccggatttggcagtctctagatggcccatcctttcgtcacagctccaaactttgtctctgtaactccttccatatgaaacaagtgtgtagttggactttggtcttcattaggcaggagtgccctctcgtggtaatttgaaaaaattgcactaggcgggaatttgcaaggtctcttgaggtttggttgaattgactagactcagagtttctgaaactgctgaagatactgatgtcccgcccccagggcttccatctctaacaatagctgcccatctcctctcctggtctggcagctcaacaactcagtcagatggccacacattgaagtcagtacctttcttccctagcggagccgatacctgtttttccttaggttcattcccttctccctcagttcgtccttcttgcccctccctccatttgtcttatgtacatgtcataccttctagaacttttcatatggtttactcttgatatttttcagcctatcaactttggctctgttgcaaattagtaagttctctatgattgctattctaaaatactttaaaaatactttcttcttctcacaaagttaagagcaaaaaaaaaaaggccctagtcctatcacttagaagccattgactagaaagacacaggcaggaagctacacactttctgcaagcaaacacgtttcacagacattgagttgatctgttgtgtccctgcatttgttggtatgcaagaataggaacaattctttctctggggaataaagtgaataaagttattgtagtttagaacttccaagatttattgtgacaaacctgtcaggaagaagtaagatggaattgtttgtcgctgtgctgagcacacagtgagccagcaggaagaagagaatagtctgtgatctggtggtaagagggccgcctacatgtctagtctctttttgcacaggggagaacactagtatccacccagttcccttcactagtttatgctttcgtctgtattctctctcccccaaatcctgttgtcagctcagaacaggctgtctccttttggaagcacaggctaccccactgtggggcagggaggtcagtgtacctgtgtgttcgcctggaaacaatttctgccttccaccctttatcaccacatagtgtaaaaattgatcaaagtggaggttaaaaactgtattgatggaatcctatcattcagttggaatgtgggttccccttaggggggcaagaaatgcacacaattcaaagtaagataatgctaacttctaaccacagactcctggggtccctcgaagctttgttttactggaaggcttatgctgaatcctagaggtctgggtacccagcagaccttgatatcaggaggttttcataccttcaaagcccaaggaggagcacctgtcctttcccctgcacctccatcttttttcctaattgtaaaatgtatacgcattacagacaatgtggtaaagatagtccctgcactttaatcactagcaacatttctgtctttcactacttctctgcaagaattctaagacagctatcacgggaactggagagttggctcagtggttaagagtatggactggtcttgcagaggtccaagttcccttcccagcatcacgttgggtggttgacaactgccagcaactccagctccaggggatccaatgtccttttctgggggccctgtagtcagttacgtgcccgcgccatgcacggacacagaagcacatcatcattgc

SEQ ID NO: 374 - DNA, 2580 bp, Mus musculus
aggttaaactcactttctgcttcggacgtcaaggtattgccattctaatccagacatcaagggcggtggagaagacaaaagtcggttgtctgtttacagaagaggaactgaggcagtggttcttcaggtacatggcttcttcctactctcagcctagaagaataaacccttagtgtggggacctgagccaggcaagccaaaggcagccttgagccctccctcccctgccctcccctgcgggggccaggatgctgaagaagcagactgcagggcttgtgctttggggtgctatcatctttgtgggctggaatgccctgctgcttctcttcttctggacacgcccagcacctggcaggctgccctcagacagcgcccttggtgatgaccctgccagcctcacccgtgaggtcatccacctggccgaggacgctgaggcggagttggagcggcagaggggactgttgcagcaaatcaaggagcattatgctttgtggaggcagaggtggagagttcccactgtggcccctccagcctggccccgtgtgcctgtgaccccctcaccagtgcagatccccatcctggtcattgcctgtgaccgcagcactgtccggcgctgcttggataagttgttgcactatcggccctcagctgagcgtttccccattattgtcagtcaggactgtgggcatgaagagacagcacaggtcattgcttcctatggcactgcagtcacacacatccggcagccggacctgagtaacattgccgtgcagccagaccaccgcaagttccagggttactacaagattgccaggcactaccgctgggcactaggccagatcttcaacaagttcaagttcccggccgctgtggtagtggaggatgatctggaagtggcaccagacttctttgagtacttccaggccacctacccactgctgagaacagacccctccctttggtgtgtgtctgcttggaatgacaatggcaaggagcagatggtagactcaagcaaacctgagctgctctatcgaacagacttttttcctggccttggatggctgctgttggctgatctgtgggcagagctggagcccaagtggcccaaggccttttgggacgactggatgcgccgacctgagcagcggaaaggacgggcttgtattcgtccagaaatttcaagaactatgacctttggtcgcaagggtgtgagccacgggcagttctttgaccagcatcttaagttcatcaagctgaaccagcagttcgtccccttcacccagttggacctgtcgtacctgcagcaggaggcctatgaccgggacttcctcgcccaggtctatggtgccccccagctacaggtggagaaagtaaggaccaatgatcagaaggagctgggggaggtgcgggtacagtacactagcagagacagcttcaaggcctttgctaaggccctgggtgtcatggatgacctcaagtctggtgtccccagggctggctaccgtggcattgtcactttccagtttcggggccggcgtgtgcacctggcacccccacagacatggactggctatgatcctagctggaattagcagcacctgcctttccctcctgggtctccttgccgcgtgctgagccgaggcaggcctgcagggcctgggctacaccatcctgccagtgtctccctctcagtgtctccctcttggatctgtagatcttccctttgtgtcctggccagcccccaaatggcattctagtgcacaaatcataggatgagagttatactcctgttgtcaagggagtattgtgtggtatgttcggggcatattgaacaagaaaccactgtgtggtatggggagggttgggcctgttggggccaggtttgtaatgtctccaagggcatctgcagagagcttggcagctccagctctcctcagcaggcctctccaccctgatctggcccctgttagcccatgagccctctttatgtacccatcctccctttctgaaccttccctcagggtggggctggattatggaggaaggaatggatctttggtcagatgagactaacagagggactcactgtcagagttagcgtggattgctgctgccggggcactacctcctggcttctctccctgctgacgtggctcttgtcctggagcagagcagtgcgttgttgggagatggaaagtctatgcgtgggtaccctgtcttcttgcctgtggcccccctcctttctgaaagttagttctctccgcattctttaggaggattcaggggcggcctagtggaagacagtgggctccatgcctctttcccctggggtttgcttcaggggctcctccccgagggcttgctcctggtggcagcagctgagatcaggacatctgtggccctgagccggctctggtcctcggcctttcccagccttcccacatcttcccaggccaagatgcagggggcaggctgaagagaaatttgtgtgtccttgtttgttgcctgatcttagtttcatggaagaaaatggaatctacagaattattttcaaaaataaagtaaaggctgaattgctga

SEQ ID NO: 375 - protein, 459 aa, Mus musculus
ALPPLPSPAGARMLKKQTAGLVLWGAIIFVGWNALLLLFFWTRPAPGRLPSDSALGDDPASLTREVIHLAEDAEAELERQRGLLQQIKEHYALWRQRWRVPTVAPPAWPRVPVTPSPVQIPILVIACDRSTVRRCLDKLLHYRPSAERFPIIVSQDCGHEETAQVIASYGTAVTHIRQPDLSNIAVQPDHRKFQGYYKIARHYRWALGQIFNKFKFPAAVVVEDDLEVAPDFFEYFQATYPLLRTDPSLWCVSAWNDNGKEQMVDSSKPELLYRTDFFPGLGWLLLADLWAELEPKWPKAFWDDWMRRPEQRKGRACIRPEISRTMTFGRKGVSHGQFFDQHLKFIKLNQQFVPFTQLDLSYLQQEAYDRDFLAQVYGAPQLQVEKVRTNDQKELGEVRVQYTSRDSFKAFAKALGVMDDLKSGVPRAGYRGIVTFQFRGRRVHLAPPQTWTGYDPSWN

SEQ ID NO: 376 - DNA, 32323 bp, Homo sapiens
  misc_feature (1)...(32323): n = A,T,C or G
ttagtaaattctgaagcaactgaaattaaattgtaattgctcattaataaataaacatcattacatactaacatttaccttaaataaactagatttcatttttctactatgggaggaaagacctaaaatacaaattgactcgaattatagaaaataaagttacaattcaggaatatctgtctttggactgtgaaatttgtacctgttatgtatgtgtgtgtgtgtgtgcctgtgtgtgtgtgcgtgtgtataaaaaatatttggaaagatatccactagtttaaaagtggttcctttcagcagggtgggatgagagggggacaggagacaaatttttatttacacaactctgtatgacttgttataacaagcacgaaaaatcgaaggtcacttaagtaaaaatggttataattatgaaaatacttagaaatatgtaaagtctctatggtatgattagaaatcataatgcaaaatctgtatactgtgcttatacctatgttcatatatttccatgtgagagaagcccgaaggggaatactctgcggtgaaagtagcttttcaagttcattcattggttcatttattccacaaatgtgtgctgagctgctaccatgggccagccaactgttgcagccaccgggatatagcaatcaaaaatcaaatgtgcctccactcagggaacttaaattctagtagtgggagacagacaatacatggtaaacccggcgagtatttcaggaagtggtgagcgtcctgggaaaagtggagcaggccaagggagactagcagtgctctgggtcaggggcaggtttaaacaggttggtcaggaaaggcctcactgaggtgacatgggaggaaagatttgaaagagctgaagggttcagtcctggaaatgcctggaaggggtgttttacaaatagacaacagccggtgcagaggccaatgcagctaacagaggaaggggagagcaggtcagacagctaggcaggccagtgggttgtccggctctgcagccattgtaaggactttggcgttttatttcaagtaaactgaggagccgctgtgcagtttggagcacagaaacgacaggatccctgtggctgctgtacggaaacccagcgactgggagggtagggagggcagggagacctaggtgttcaggtgagggatgaaggggggtgtggacatgttgaggtgttgcatcctagacacagattgaaggtagggtcaacaggatttctagtcagattgtgtagagggggtgagagagtgaagctggctcttctggttctggcctgagtaaatggagccgccattaatgcccatgggaaagacaggtgggcggagaaggtttgaaggtgggggaagaaagggtcttattttcttcttccttgcaataatatatcccaagcaatataattaagcaatatgtatttttccctttaaggaaattccaaaaattatatcgttccaaataaaaaaatcatctccagagtcctgacgcagcaaccattacattcccagtaatggaaatgttaagtcagtccgtgctctggagaaatcccacgacagaacacaggccaggagaccgggcctagattccggttttcgaaccgtgggggcaaacacggaggctgcaaatccatccccagtccggcaagattctcgaacatgtcgggagagggctgcataggaacttcaaaaacgagtagcggctcccctggattcagcgtgagggggaaaccgcggggcaggttcgaaactcaggagtccgacgtctgaaggagcgggaggctgcttccgaggagcccggggcacgacgggaagggccgcgccggccaggcagccctcctcccggcagcctcgggcaggccgttcacgcgccggcgacggcgggcccggccgcaggtaccaacagcacctgtcagagggcagcgcgggcgcaccctgcaagggccctgcctcgtcaagagaggcagcgagaaacagcagcgatgaacgaaacaaaaccttcctccaccacggctacacagagctcgcgtccgaggaagcgggaacacacaggccccggtgctttccgaaaggcttctcgccaggacccgcgaccagcgtggggcgggggggggggtcaccctctttgagaagccaggtcaagcaggccgtcgctgggcgacctttgggcggagggagagggcaaggctgcaccgcacaggttccgcccctacttcagcgtcctcgcccctcccaagctccgcccagcaccccaagggccaacccccccgcgacgcatgcgtgcttcttcccgcgcggctccacctgccgcgcgcttccgctgctggccagtctcttctgcccctccccctcctgtacggccgctactctgcgcccggcttccttctcacaacctggttctgcccacacctgttcttcagccctgtgaacagtggctgtagaacagtctcaggccctgcagacccacctccctcgctcccgtggtggcggtggtgacgggctggggacgtggggtagaaaaatgggcgggatgtggaacgctgcgttgccggggcccacttccggaggacgggcggaagtggctgcggtggatggtgggaggggggaaggagtgcgaggggagggccgggccgctgggggtcgagggggtggggcctgggccagcgctggggatcgggcctggggcctggattgcgacccggggcgggccgcggctcctagccgagacggggcgggcgggaaccaggtaacgacccggcgcagttagagcgagggtcgtccgcagggcggacgggtgggggtcagaagtccaggaagggtcgcagtgtcaccctcttctcttgtgaacacggggcacggggttccggggagaagggtgggaggagttaaattcttggagggggtggaggtcatgtggacgccacgcccctacaggaaggaaaggagagagagagtgtgtgtggatggatgtgtgttgagagagagaatggatgtgtgtgtgtttacgaataaacttggaggggagggggcaacaggggtgggttttcgggctgagaaatgggaacactgtggggctgctgcaagcaggacttgggccttaaacattccaggagagtgttctcgggagtagccccgggaaggactttaacagaggttgggaattacatctctggcacagttttgcaagcagagggggagcttagttaaaggagcaaagaatgcaagtggaagatgccagcatctcggtctggaaaggatttattaactagttgaagagggctggtggattaaaacactcagcaccctaagaagcttgggagattcgattattatgttgcgctttagacaggagggcaggagaaagggcgttcttttctcgatttcttagaagagtctccggttacttttctgtggtgagaacgggtacgatccatcttttatcctgaatcatgtatgtttgtacatacatataatatgtttatattatatgtgtttatatatgtaaacactattgatgaggtgactgtgttctggcgtgtgatacgtgagttaagtaggtgctttgtataaccttgcggagtgtttaacgaaggtgttttgatgatagagcctagtatggactcttaggtggggagtggaaactagaaggttttaggactctatttgggtatctagattagagagcgttataatgtttaaatgttctgcaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaattagaggagggggggggtnnnnnnnnnnnnnnnnnnnnnnnnnnnnnnnnnnnnnnnnnnnnncccccccccaggctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtaaggctcctgtctcatttcccacttaatgtcttgctgtgcctgtgcagaaggtgttgagctggcgagttcgcggaggctactattcaggaaatcttatccagatgagtacactggaagctacacctctccattactctgtccaggtatagacttgttcccaacttccccttacccaagctggatgagtgccttgtaagggattgtgagcaatggcagttgtgaggttaggccaaggagaacatgataataattgaagacttctgaagggaggttggattagattacctttaaaggcccttccaacactgagataataggattccaagtcagtctgggttaagactggaatggattacctaggcagaggcagctgctctgttttggggagctaactgaaaaggactgctggtggggggagaaggcgggaatggtctagataacctcctaagttgtctcccttcctacttctataaggggagcttagcccatgaaagctcgggaaaagagcagaggaacagaacacaggtttgggggtcaggaaggagtacttgtgttctagctttgactttttgagtcagtgtacaaccctacacaggccatgttctcttcacctacaaaatgggggaaaactgactttccaggtcccttacaagttgttacgaggagcaaatgaaacaaggattttgaaaagtatccagggccgtgtacacaggaaacaataacatcgatgttgctctacgtgccttaaaagcacagaaacaactctgagtcaggagttctgttttcttcttgaaatagtgtgctggcaacagcctaagaagatgtccttagtgaaaagcctgcccctgaatgtgtttcatcatcttgttggtaaacagtacttgggatcatcaagttgtagaacaggtgaatagatccaaggagaacttggattgaaggagtcttgcagatactgcattggcccttatggctctccagtccaatttcagtgtgcccctttgaggtagctgattaaagagggggtggaaggatgcttaagccttgagggcaggtgtctggctaggcacttttcttggagtgagtggtggtctttaccttcctgtgccatatgctagttatctctcccgctccttaagatgacgtttttttccagacatctcttcgccctttgtattttctcaggctgtattccctataaaagcagccctgtttgtctttatcttctcacttcctgtctgctccctccttcaattccaatttacctgtgccaagatgcctgcttttcccagggacaacacacagcagaaaggaggggtagagcacagtgttgggaattttgagagacagtagggtatggtggcctgggcaaagggcaggaggcctggcttctggcatgtctctgcctctccctagctcagtaacacctaggcctcacatgttccttgaggatgggtgacagtgaggtcatctgcaaactgaaaatcctgtacttatgccttactttccatgttaaatttttttcttccatccccttccccagtctttccttttttgccacaggagttttcctcactccctccagcggcttgagaggtgggcagtggcctgggtggagctgctgctcccgagctgtactttctcctctggtctggtgcctggggcagcccctttgaggccaggctgctcctttataaggtgtgggtctcaagatgggtgtaccaccttccccagcttcacccagcaaatttctgttgccagtctttgcttagacacaggggtcacagtgatccctcggggatacgtgatgccacggtgcctcctcagccatctctggtatcccaggtaccagggagttgcgtatttgcgtaatgcttctatcacgtgatccagtcaatctgttttgtctgttttccctcaccactttgttgtgaggagaacagagcagggattcttttcccagtttgaggggaagctacggaagccctgagtgggaagggtttgcctaagggtagagcggtaggcactgaaatcacctcccagtgctgtgctgtttccacagcatctgacctgaccaggccatctgggttctgctgcaaacctccagggagagaagctctgtgccctgccagacagcctctctggtagaacgtttcctccttagagtgagcaagcattcctctccctgaccttcccaccctcctgccctgcacctgacccttccatgagacagtcccttcaagacaaccattggctttttcacatgggcaccaggatgccaaggcatagcactcagcaggtgtcaggctacttagccaggagcagtgatagacttaaccagactgtgtgtgcattttttttttgagacagagtcttgctctgtcgccaggctggagtgcagtggtgcgatctcggctcactgaaacctccacctcctgggttcaagctattcccctgcctcagcctcccaagtagctgggactacaggcacacgccaccacgcccggctaattttttgtattttagtagagatgaggtttcaccatgttggccaggatggtctcaatctcctgaccttgtgatctgtctgccttagcttcccaaagtgctgggattataggcatgagccacggtgcccggccgtgtgtgtattttaactcaattaattatttatatccttctttattccaaaaagaattgtaggtggctaaccaaaagttacatttcacagacattgtttagtgattattatgttaatctttcctctttgacctggatgagatgaatttctgggtctccattgtggggtgagggagaggggcaagcagagatattaggaggcagggagaagggaaacaaaacactgatttaaaaaatttgcttttactttttttttttgagatggaatctcactctgtcacccaggctggagtgcagtggcatggtctctgctcactgcaacctccgcttcccaggttcaagcaattctcctgcctcagcctcccgagtagctgggactacaggtgcatgccaccacacttggctaatttttgtatttttagtagagacgatgtttcactatgttggccaggctggtctcaaactcctgacctcgtgatccgcctgcgttggtctcctaaagtgctgggattacaggcgtgagccactgcgcccagcctgcttttacttttactgatgttttcaagccaacatatgttttaatttaagggcatgaattctttccaaattgtaaaaagtgtcagggatcttgggcatggtttatgggagggcagtttcctggaacagttttcacttccttttcatcttttcagttctcttttgtcagtggtggagtgggcaggggagagtattgttcctctgcctaatcttgtgactgtttatcctcctggataatctggtctaatcttgtgactgtttatcctcctgttttttccttttgcacataatccaatcccaggcccacccccagaatcctggccccttgtttctatccttcttactccagtcactgctccccatgtaacctctatcaagagctcagagcctcttttccccaggtcagtttggcactcatttaccctggtttcttgcctctcagaccaagtgcttgcttttgcctccatgaagcccattctgattccctaaccaggccctttctttttgggatggtctcttgcagtccgggaatttctccttttggatcttcctgtgagccttgggatttcagccaagggtggtagagatggggtgtgcgttacagtgcacgaacagccgccatcctgtttccccttcacctgccttagatggagaagtatcagggtcagtggtgggaatctgatcttcccccacctttcagcaccccctgatgtctgtcctttctcctggaaggtgattttggctcctcatgtcttggatctacaaaccagtgtttcccagccttttcacttttaggaaacacaattgttttttcctttacgccttgacacctagtgtgagtgtgcagagcccccaggcccctgactcctccattaggcaaacatagggcagaggtgacagacactggcctctgactggcatatccgcctgggttcgaggctcctgccacagtgcgcgcagtcagctaaagtggaagccacgggcttcccgcacatcgcacactgcacacggcggcctcggtgggcctgcccttctcccactccacctccaggtctgggctctggccacttaagcggaggcttcacggcagcgcctgagaggagacagagccctctcaaagcactggcgctggaggatgtgtgcgggggtgttggggggcgcacaggagtgcccggtctaaaacctggctatgctccccaccaggtctggtggcttgcagcacgtttgcacttaccctgagcctcaaactagttatctgtagaatggggatgataacgctcactccgcagagctgctgaggcttgaaggacaggccgagggagggtttggcccgtgaggcccctcaccatgcctggtgaccccttagcagttttgatttaggtcctcgcctccacgcaggggcctgcgggtgcgcgcggccctttgtttctctagaaccctgcacgattcgtggtttcatgtagaaacaagttagtgagcagtcagtcagtaaccacaggccgcagagttccgggctgctccgtgctctggaacacgggggaggggttgatgtcaggggcgtgggtcctgatcacatggcagcagcccttcttggggaagtcagctacccagcagcctgtagtcctcggctacccaccctcaccgcctggggtcccatggtgagacagctgggtgggcatcaggcttctgcagagggccaggccggagggagctgggcgagggagtggggctggctcctggcttgcaccggcctcgtggaatccaggcctcagacctgatcgctggcgaaactggctctgtgcgctggagcccctggtcttctgcgtctgtcctcctcccggccagactttactcctggctcagcgacaggtatttgctatggaagagctgtccctccctcccctcggtgggcctgggtccacctccacctcctcttcaggtccgcaccttcctcccctttaaaacaccagccgggcgcagacccgttctaggcttttccatggtgcttccgccaaagcttgtgaccgagtccttcccgcctagggctggtgggcctcccctgctggtaggtctctcttcgctttctttactcagaactgaagctctcattccccacccaccaaggaaaaacaaaagggaagaagccacagctggccccggcttgctttggcacaggtgtttccccccggccccccgtcgggcaccctggttcctgttctgtccctgccccacgcgaccctggggctcccacccgggctcctcagcctcccctgggttggggtggggggactggctcccagcccttggcctagggtttggtgaacgcctttcctggactgcgggcccacttcaggcgcggctccaggctgggcagctgcgctggagggccgagggcaggggtggggtcgggcgtccaccctcagggttgcgccagggagccggaaagccgactcccgaagttggggtcctgggaaaacttgggtcctgggttgactgagaagcggcggggaaaggaggcgggccaggaggagggggcctggcggacgccggccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccgccccgccccgcctgccggggaagggccacgttgcccgcccggccgtccggccccggcgcgccgcagaaagggctggcgagtcgaaaggcgaggcgcccgcggcagcgcttgggacgcgcctgggcaccgggctcgctccctgcgccccggagcaggccaagttcggggccaggacgtcgggaggacctggtgagtaggtgtccggggacggaggtcagaccgggggaggcctcgcgggcgccgagagggagcccaagggacgtcgggtcgccccaaagccccggtgcccatgagtgctagcgagagggggcttggctggggagcggcccggtccgacccggtgccagctgcgcgttagtcccttcccgagccgagaggttggaactccgccttctgctttcggaatcccgggcctccagctgttagaggaagggcgggctccgcggactggggaggatgttgtgaaactcggccccgggcgtccgtgcgtgcggggcagggagggggtgggattggggagtggcctttcccccctaacctcactccagcatcctttccccaagttaatagaggctgattctcctcagcagaaaggaaatgttgattcagtgttgaaatatatatataataagttggcaagaaaacttttcttcctgtttgctaacgtgtgtggagtagagagccccgggacgtgcagtgcccgcgtctgataaactctgaagtagagggactgtggctggccggctccctgaaggctgaagcttcactttggttaacccttgctgctgtagtgggtctgccgttttgttttagaacatcactggctgagatgttgcccagctttattttcagtcatttacggtattttttcaggccgtgtagcctttgctcttacgtgctcacatcatccaggatctgccttccatcagcaatcactgcgtcctggtccttcccaattctggggaccattgagctcacccatttccctgcttctgtgtctcattctcactgttagaagcactgcggtatgcctgacctcagtggcctgtgttaacaagggaaactcattactgttcggggcagtagggaaattgtcactgtcgtcagtatccaggcagtgggaccttgtgatgaaccaaatcaaccctgtcaccttatagatgagagaactaaggtacaagtgggtcaagtgacttgtccaaagttgcctggcttgctggctggatcgcctgaatcccaggcctcatgccttttgtggcacttgtatttagctcttcttttccaggatgaataacctgcatcccttccctcctaggtcttattctctcaactcttgaattatttagtgtatcttctctgactacctttcttttttttccgtcctgaaattatgggcctggtacatgatacaggagtccagccaaggtctaagaacgaacatgaaagcagttcagttagagttccattacctgtgacatgtctatattttctggaatttttacgtagtgctttttaactttaagcaaagcagagatagaagggaaaatctgttaccatttcttccacttctgtacttaattttacagctaaatataacttctcgcttattgctcatgattggaagttgactatctggtgttcacttgctatttaagaaacattttttgccagataaaggaaataggctggagaacaccatggtatcagagtgttagaaaggatctcacagctcctaggcagtccttcaaatgcttcagaaactgagtgagccccataggggcaggtggcgcctacccagagccacctcggttttagctgaagggttttgtactgaaaagactcacttctcatctcccaccatggtgcagatgtctttgtacctggtggtgtggattggctgtgtcacctccctaaaggagttgtgaaaactctagaaagtcaaagccagttttgagtctgtgccttgcatgccagtctcataaatgacatcattaggaactcaggtcaggattaagggcagttgttctatttaaaaaggaaggtgtagcagattgtattttccctcaagggcctcacccgtaagtatccccttccacatgtagttatagtttgacattgtccacttcccacctagtggtggggtttatgattctctccccttgcatgtcaatagggacttgtggttcccttgaccagtgagtaagacagacctgatccaaggctgaatcaggaacaggatacactttcacctggcttgcccgctttcttggaacactcacctttggaatgcagccaccacttccaggacatttccaggccacatagaggggttctagtgagcactcctgctgataaggtctcagctgctgccaacatcatcctacagacatgtgagagaatgtgagagcctctaggggcatctggccctcagcttttgagtctttcagcaaggcctcaggcatagtggagcagagacacgtcatctcctctgtgctgcactgtccacatttctgaccaatagaaactgtgaggagtaagtgataactattgttttaagccactaaatatcgaggtaatttattatgcaggagtagatacctactaaggaaggagacatgagtggagacagggcctcagtgtttggacttggagctgagcacagagggcagggagggcacttgccctgcttgtcaagattatctagagtctgtttctctcattgcttcaggtactgatggctgcataatgagtcaccccagaacttagtggcttacaacaacagaatcattttattaacatctcagctatgtggttcttgcttgtggtctttcacgccattgcagtcagctggggctgggataatctggagggctgtctcctgtgtctagcggttgatgctggctgtcagctgggaccttagctggggtggtcagttggaatacctatgggggtcctgtccatgtagcagtgtcctgtccatatagcagggtcctaggagtcagcatcttaagaggaccaggtggaaactactgccttttatgagttagtctcacaagtcacatagcatctcttcccagaaccaaagggagggaacatagaccctcagctctggaggcaggagtgtctttatcacttgtaagaagagcatatggaatgggatatgtgcggtcatctctggaaaatgtcacacttcactctcttgctgctgcgttggccatctttctccctgatttcggtaatagtgcaagcagtcttccatccagccacttgaacctcatacatgtgccaagcactgtggtgggcacagaggtcatagagtcttttttcctaaggaggaaggtgggagtcaggtcagcgtggccacagattctgttacagcgtggagagagtgctgtgggagtgtagtcatagggaggcctggctctgtctgtgatgttacagaaggagtcacctgaagtggcctgaaaggatgtgtgggtggctggcaggtggcgctgtgggtcaaattccaggatgagggaccagctggagcagagacacagcagcgtccaggtatatgcttactggggaaaaagcagcctgctgaggccagagtgcagggtccatggggttagtggttggaggtaaggttgaaaagggatgtttcagacagtctgtctgaagggctttggatgtcatcataatgagtttgagtttgagtttgtgggcagtgcagcctctgatggtttttaaagcaagttaatgtcgtgaccaggtgtacttgtcaggaaggatgcgctgttgctgttgggaaggtttgtgagagggaagcaagattagtgacaggtggaccagctgggaaactacatcaagagtccagacttaaaacagtgtttcctacgaaggaatgagttcaggttaaagggctggagggcttgacatgggatgctagcagtcaatgagtaactttgtacttccattttcatagttttgaagttcttggtcctagatgtatttcagaattgagaattttttggattttgaaaagatgatctggtgaatttactctgtagtggaagatcagaagcagcatggcataagccaccatgtttatttctgtagcaaaatgtatgaatagccacagcaggagagagaaaagactataaatagccccatattagatcagatcagattttaccaaatgaggctggatgaggttttactgccaattgagtttagaaaacttctgtgttttagtgcttcttggatttggcagttacagttgaggaactgtggatgtttttagatcccaggcacatctgctgaatgttgagagccctagcacagcggcttggcagtgctggtggagccaatccctgtcttcatgtagcttgcagctgagggggcctgagagaagttgagcaagtggttgcgcttgttgctgttggtgaagggtaggtggaccttacatggtcccaggcgtcaaggaaggcatcttggcagagacacgaatcagagtgtgccaggtgaagaagatagggaagagcagagctggcacatgggcacatgcaaagaccccgacggtaggcttggctgttggggtaccagacgggagtgtggtagagtggagcaaagaaaatggggagaaaggagtgaaataacggccgatatttacgttgtcatgccggcactgttctaaacacctaacatggctcatctcatccgatcttcacagcaacccagtttgagtctcagaaatgtggcaaaacgtagggtgatgcctctgggctgtctggcttgcctttgttgctgctgcactctcctgatggtggcctgagcagtgcttcctggagaagcaggtcaccgctgctggccaaggtctgggcttgatcatccttttgggcacagccagttgtgagagggtgtatggctcctggttcatgtgtgtgcacacagcactaacttccaggcagagctgaggatcctatcccaggaactacgtggataaacagtaggaaaatagcactggggcccaggctgagcctaaggaggtgggctggaactaggggtgtcatgtcctcttatggcaacaggagcaagtttgaagcacagggctgtggggtggagaacaagggcccagggattgattaaggtggaggccagggcttggccggggcagcttttcctgtgggctctgcagccactccatgtgtgtgcagacttgccaagtaaaaactcagtcagaagactggtttgctctgcatggcttagaagggtggggcaggaggtcctaagcatcaggtannnnnnnnnnnnnnnnnnnnnnnnnnnnnnnnnngcatctaaagggtgcagaagttatctcaagggtcccaggaggctttgccataagggcctgcaggtcattgatgagtcagggacgggctatccctctgggccccccccccctttttttttttttttttttttttggtgggggatggagtcttgcttcatcatccgggctggaaggcagtggtgccatctcagctcactgcaacctccgcctcccaggttcaagggattctcctgtctcagccttctgagtagctgggattacaggcacgcaccaccacacccggctaatttttgaatttttattttagtagagatggggtttcgccatgttggccaggctcctgacctcaggtgatccgcctgccttggcatcccaaagcgctgggattacaggcttgagccaccaagcccagtggggccccacccttctaagccatgcagagcagcacttcactgaatagagttcagtccctcttctccatccccatcctgttatataaagtctttttcttgcacagtcatttaggaggtgggaagttgggagacagggaatcctggccattagattggagggaaagttccaacatggacaacatcctgaggggagagcgaagaagaaactgaaactcttctgggcccagtggctcacacctgtaatcccagcactttgggaggctgaggagggtggatcacttgaggtcaggagttcaacaccagcctggccaacatggtgaaagcccgtctctattaaaaatacaaaaattagctgggcgtggtggcaggcacctgtaatcccagatactcgggaggctgaggcaagagagtcgcttgagcctgggaggcagaggttgcagtgagctgagatcatgccactgtactccagcctgggcaacagacagagtgagactctgtctcaaaaaaaaagaaaaaaaactgaaactcttttgtgcatcactcttttcttccacataaactttcttaaaaatcaaatatggggatatggcccacagctctgagtagcttcatccatctgtatggccccagctgggcacagcagtaaggccaactgaaacgacgtttgccctgaatttctcggtcacttgacaacatgtatctaattgatacataatatttgagccctgatataatagaatttaattgcacagttacatggaaacagacttgacgtttctgagaagactgatgtcctggcgtggtgggggtggttggtttctaggaagaagacaagtggttggtggtgaatgctggcaggggctggtgaagtctccccaggagggagacagaatccatgtctctttagaggcccttcaggatcagcccttttataccagatctgctggtttgagagcccagagcctcagaggttagatctgaggcccaaggttttggccaggattagagagtagcctgtgaggcagagggcaactggcagagctgttggtgtaagagggtgcacgcctgaagctttggggtgtaaagggtagaccagaggcaggacagtcaaggagttatggtctggagtggcagctggctgggaattggggagtgtttcagatcctttcaagtaatgtggtctggtagagcttggaggattggtgggaccatgcctttttctcactggtttgtgtcctggttccttcccagagcctggcagagagcaggtgtgtgatacacgtcgtcaggtgactgaccgaggaattcagggcaaacagatcatctcaatttgccttgctgatgtgccagctgggattacgctgatggatgaagctcttcagagctatgggcaatatctacatatttgattgtcaagaaacttcgtgtggaaatagcttcaaacttacacaaattgcaagaataaaaaatagtataaggatattcgtacacactctctttactcagattcacctgttaatattttgctccatttgctctctatgtgtgcagagtatgtttttgttctgaaccatttgagaagttgcatctatcctggtcctctacttctcaatacttcagtgtgtattacctaagaattggaattaatcagttatcactgatactttaacctactgtccatattccacctttgtcattttacccaataacgtctttttaaaaaaagttttttgaggtttcattgacatacaattgatatcaatatgtgcaaagaactgcatataaagtgtacaatttgataagttttgacatatatgtgtgtgtgtgtatatatatatatatatatatacctgtaaaagtatcaccacaatcaagataataaacatatccacccttctagaagcttcctaatgcccctgtgtagtaactaccctactgcccttctctgcctccatccccaggcaacaactgatctgctttctgtaatatagattagtttctattttcggcagttttatgtcaatggaatcacagtgtatgtgctcttttttgtttttcccaaaaagacccatattgtgtaattatttggagattgtgttgtgtatgtcagtggtttattcagttttattgctgaatattattccattctatgagtaaaccacaatttgtttatctgtatttccctgttgatgggcctttgggttatttccagttttgagtgattatgaataaagttaccatcaacactcctgtgtaggtttttgtagggacatggctgaaagtagaaagaaatggggcatgcaggagagactgggcttggttataacagcctgttatccctggggaactagctcactcaccagaggacgttaggaaggatctgcccctgccccccttgtgatccaaacacctaccactagaccccacctccggcagcaccaccacacaggggatcaaatcccaacatgtgtttcagagaacaaaccatattcaagctatagcatagctacgtaattattataacactattaataagaccatctttgccttgggaattttaagtagcacctttattacatattagatttttttgtgtaatgagtctgtttctggagcttaaattctatttcactggatggtctgtttatttatgtaccagtaccacgcagttgtaattatggaggttttgtagtatgccatatatatatatatataataaaaaaaaatttttttgagacagagtctcactctcttgcccaggctggagtgcaatggcacaatccaatcacagctcactacagcctcagcctcccagactcaggtgatcccatctcagcctcctgagtagctgggaccacaggtgcgtgccaccatgcccagctttttttttttttttttttaattgttacttgtagagacagggtctccgtgtgctgcccaggctattcttgaactcctgggctcaagtgatcctcctgtattggcctcccaaagtgctgggattgcaggtaggagctactgcatctggccagtatgcagtattttcatatctggtagggctgagtccctcctcacagcttatttttattgttttcctagtttttcatgtgaactttactgtcagttcgtctagctccataaaaaggtatttttattgggatttttgatgatgctgaaatgtcctgaccaagaacaagggatattcagatgttcttttgtgtctttcaggaatgatagttttgttcacataagttttgaatgtttaagtttatttaagtttatttctaaatattttctcatttctctggcttttgtaagtagggttttctcatccatgttttcttctcatgagttatttgtggatatgaaggctatccattagtatatgttgatttttatattacacttccttgctcagttcattattgattctttttgagttttccaggcatattctcacaagtaaagataatagaaatagtttgcttcctttccacttctgctttgaatttttttttcttggttcatttgcattggctgcttcctccagcaaaatgttaaataaccctggagatgatgggcaacttcgttttgctcctgacattcgtggggtgcctctggtgcttccctgttggtaaggggttaactgtagccctgaggtgggacatttgattttaaaaatcagtcatcttggggcgcttaggttagaggaatggtaggcagatgctgtcactccttgcccctcccctcctccttcccacctggaggggaaatgaaatctgacaggtagaaagaggggagttggggttctttttctctctccctccaccagcatcactctctgcctctccctcaaaaatacgttcctgggtcaggatatatgttgactccctagagagctctggagtcaacctcctggccttcctccaccctcactcttggccttttcctgcccccatttcctctacctgtggggcatggagccacgagcctttgtgtgacggtttgctttctctctcctgtctttaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaatatttatgtgtgtgtgtcctggaaaaggaggtggcaggcagggaaagaaaggaaaagggagaatgaagagttaaggagagggctagacgggtgggaggaagcaaagttgaggaaagaaagcagatgagtgggagggaagagccagggacagcccaggggatgggggccaggtgggaaaggaagtccaggccacaaggtggagaggagccccggactgtgctcctgctgatcgtcctgtagagccaggaggccgcagcaggaaagctggtgagtgtctcctgcttctgcctcctgctggctgggcaggcctggtctggggaagaaccaggtcctctgatcagggtggtccctgagtggtgctttgtgcccggtgccctctgctggcccaggcagtgcttattgagtgccctttatgacgtgccggggagcctcagggtacacagctgataccagggttggcctcacagtggcgcttggactcccaaacgcaaccccagtgagagtgcctgttttgctaatacccagaacacagacagactgttacctctgcatatcacgtgcaacattctgagagtttctgttctccactaattcatttaaaagaacaaaacgcggccgggcgcagtggcttacacatgtaatcccagcactttgggaggctgaggcggacggatcacgaagtcaggagttcgggaccatcctggccaacatggtgaaacctaaaaatactctactaaaaatacaaaaacttgctgggcatggtggcacacacctgtaatcccagctactcaggaagctgaggctggagaatcacttgaacccgggaggcagaggttgcagtaatccaagatcataccactgcactccagcctgggcgacagagcaagactctgtctcggaaaaacaaaacgctttttgtgactcacgaacttgatttcatgagtgggtttgaaaaccctgggctagtccaggcgcggtggctcacgcctgtaatcccagtactttgggaggctgaggcgggtggatcacttcaggagtttgagaccagcctggctaacatggtgaaaccccatctctactaaaaatacaaaaattagctgggtgtggtggcacatgcctgtaattccagctacttgggaggctgaggcaggagaattgcttgaacccgggacggggtggttgcagtgacctgagatcgcaccactgcactccagcctgggcggtaagagcgaaactgcgtctcaaaacaaaacaaaccaaaaaccctgggctaggcaactttcttggcagaaactactttggagctcgacaccagatggtggcagagttgtctggggagctgtgtcgagggccgtggccttgggagcagctccaacctcccatctgggctcagaaaccagtgtcagacattggttttattttaacctttgagatttgtgtggagcgggttttgccttcccctgttgcttagatggattatttagccatattttttgttaaataaggggaggtggtcattatccgtgatttcagacgtggaatcggcccggcgatagctgcattgtgccctttccggtggagccaggaggagtttggccgccacgctccatgcgcatagcatgtcatgcagctagccaagtgcattgttctgagtgctccaggataagtaccaacttacttagtgctccaggataagtaccaacttagtgctccaggataagtaccaacttacttagtgctccaggataagtaccaacttacttagtgctccaggataagtaccaacttacttagtgctccaggataagtaccaacttacttagtgctccaggataagtaccaacttacttagtgctccaggataagtaccaacttacttagtgctccaggataagtaccaacttacttgatcctcagagcaagcctaggcggtgggtactgttttgctcctgttttaccagtgaggaagcaggcacacagaggtgaagttgcccaaggtcacacagatggttgagggagagccggattggaatgaactctgtgctgttagccactgtgtgaggctggactgttccattccagcctttacggcctcttccaggccattccccagctgcacttggattctcaggccaggcaccggcggtctcctgtgagggtggagaggaagagggggctgcgtggctcggggaggtccaggagagatggcgggaggagtagagtttggggcctgcggtgccagaggacccccttacaagacgaaagactgggttctcaggctcctgaagcaaggagcaccttcaggggtctcctggtattcacccatcaaggcttgctcaggtggcatgcgtgtgtgcgtggcggctgcccccgggcccggaagcgcctgtggataccaaagcaagtggaaatgccagatggaaaagccccgtgttagtcaatgctgtagagttcagccagcctcgagtttgcaggtttacagagctgccttgcgcctggctgctgctgctgctgcattcctgcttctgcctccagctgtgaccacctcctgccactcctgctctcactgtgggttcctgctcactctgtctccaggacagactgccttccgggcagccttccctcctcaagcctcttggcctttgcaatcctcttacctgggtcactggtgggatctcatttgtggatcaagtcgcccccagtggagacaaatgtctgatggagtctggccaaggccctcctgagccttcactgggccctgcatgagaagcctgccaaggctgaggggccagggaaacggagacgaagccctcagagcaggccaagagggtgggaggtggggggcatttagagggttagatacagagcacccctttacaaataccagctactggcttttcgtattacatgttcattttagatacaacatactgcacacgctcccttaacgtgtgtttacgcgtgggtggtgtatccttccagacgtcttcctcacatctatacataatatgcatagataaaacatttaccaccaaaacccatagtgttatgtacatatttgtctggctgtgtaactttaaataacatacaaatgtatagaacagaagcttgccctctttctgaaatatctaacgtgggatttcaggctttctgatgagacctctgtagaggtcagtgttttgccaccagaggtccttcagcctccatctgttctcccacctacccacattctggcccctggcaattcacagggagtttaggaagtagacaccagggccctatttcctggagaccagcctggtggccgatgtcatagagtgcggtgggcctgggccggccctgctctgggcccgtgacctgcgtgtctgactcgggtccagctgttcttcctgccagagcctcttcctgtgaggcgggggtaacacaaccttctgtggtggctgtgggattaatccgtatggctgcattgtgagtaaagcctggtggaaatctctgtctccactgctttccttttcctgctgttcaccttggctccctcgacacttaatccccctccacatgtgtctggagcgggcagagcgggggcagttgatagaaagggggccgggtagtgccaaggctgttactttcccccactgcctcccttggctaacttgaagtctgaccctttataccagaactgtaagacagtgtgtcagaatggattcagttgcagagcaggaagcctggatcccagcgccggacggaaatgagaggtcgatggtgcaggctggtgtgggggttcctccaccgtcagggcccaggctccttctcaggtctcagtctcactcttcttagcacgaggtcaggtctcattccttggctgcgggagctccagccagcacacgttttaggaagaaggaggaaggaagaaggtaaagggtggatggcagctgcctcctcctctcttggaagctcacagagcgctgggtcacaattccctgggtagaactggatcacacaggcacccctgtcagcaaaagaggctggaaaaagtatttctgaagctgaatcaaattaagattcctgttactaagaagggagtgattgtatgggcgactacagggaccacggccatacacggtgcctggaagaccaagcttgtgacagtgacgaggatttggagagggcagggtgatggggagctttggggggagtgcattaggaaccctgacctggagaggggcagaatgaaacctgcgggcccctaaccctagtgggttgtttgagaaacctgtcctactgtggcagggggctgagtcttctcagggtcatgcatgaaaactgaaattcctgaaggccacacacagccccggaagtgctgactgacaagggcacatgccagtgatgcagttttcttttttgtcttcacttttgttgttccgccgtcttcaacacatggctcccagctcacagcaaatgctgccctggttcagctaccaggaagcaggagaggggaagggagggcaagcctcattctttatggaacaaaagcagtgggcagacagccttccctcacgttccactcactggaatgtggtctggctgccttccctgcaggaggtgggatgcaccctcagtgcagcagccctgccccagccaaaaacgtctcagcacagctgtaagaagaggaagatggctagagacaggcagccttccctgcaagggcaatgaggcaagcctgccaaaagcctcctttggaaatactgtttgattacttttcagagtttctatttaggaaaagggcaaaacctttcaggatcaggagtaggtgagcggcgatcaggcctcactcttcaccgagggccttccctgaggaggggcctgcaggacgctggcagcggaatggggctgtgtggctgctagattaggtcatggcagggagacagcctcttcctggttcttgctagaacaggcacacttggggccttgagctccagggagttcatggaagacatctgactaccctgagccccttgctggagggttctggggagtggcccacggccaccgtcacccatggccaccgtcacccacaggggccgtgaggacatccctggccagcatctaacacaaccacatgggatgccctaagcaactactgcccagccgagggctgcctgaatttctgactcacaaatggtgggcaatgtgaaacgggtattttaagctgctgagttctgcgggagtttgctgagcaacagtagaaaccagaactctcggatactgtgttctgtccttgaaacggtggaagattttatgtgaccagaatggaatgtttgaacaaatattttgagaatagaattttaaaacatttactcatcagcatccaagggtggggagcagtgtcatctaggagactggttctattatttacgtagatgttcttgaattaaaggatgggaatattttttccttccaaaactttttttcaattttatattctgtttttcaagtttttattatgaaaatattcaaactcacagggaagttgaaagactaatacaaagaagaaccatactctttccactgacatgatccaacgaggaatattttgccacacggcaaatatataccgtataattttctgtaccacttgatagaaaggtaaagaatgaatattgttttttaaataacttttttcgtatataagtaatatgtgcttatcgtgtaactacctaaaaacattgaaaaataaaaggaaaataaaattcatacataaccgccctgcccagattaactatctttggttcttggcttgctgagcaagcttctgacctgaacttggtcttcattgggcacggctgccctctactgacagctgggagtcctcggcctccttatgaatgaatcaagccagttggttctgaaactgcagaacagagcctgatggcctcatacctgggtttttaaaaatcaaaatctggccgggtgcggtggctctcgcctgtaatcccagcactttgggaggctgaggtgggtggatcacgaggtcaggagatcgagaccatcctggctaacacggtgaaaccccgtctctactaaaaatacaaaaaattagctggtcgtggtgaagggcgcctgtagtcccagctactcggggggctgaggcaggagaatgggtgaacccgggaggcggagcttgcagtgagccgagatcacaccgctgcactccagcctgggagacagtgcgagactcctctcaaaaaaaaaaaatcaaaatcttgggtgaggcctcacctgaaatatcaagtgtgacttccctgtccttgtcatattgctcccttgaattggagcctgccctgatgcccgcctggctccaggccaagccctagcagttctccaccccagttagacagcatgcagctgtggttccaacgcccctccctcagctgaaccgatgcccctgattctccctaaattctcctttgtccttcagttcatctttcttgtccttttgctccaatcacatagtgtgagggaagactctcctgaaaccatgttttccctccgctctcacactgcaacaatcatctacacagaagaagacttctgtgaccaaacgtgtggggacctctccccactcccaagcggtggacgtcagccaggtgtcctccaatcagttccaaccctgtctacctggagatagtgccagatcccacaggttgagggctccatccccaagactcatccttgccccaccccaccaatcgaatgttggggcctccagaacttctgaccaactgggttcaagttggggttcccacaaccccctctttgagtttgattaatctgggggagttgctcacagagaatcagtttactaagaaggatattttaaaggatatggataattagccagacgaagaggtacatagggtgaggcctggaagcacaggagcttctgttgccgtggagctggggtgccccaccctcccggcatgtggacgagttcttcaccctcctgtcggcctccacgtgttcggcccagtccccttggttttttatggaagcttcatgactttagcattccttcccccagggtataggatgggaccctctcatgggagggccttgagtcctgcctcagggcagtggaaggtcagagtcctgcccctgaggcctgactcacccaacactgtaacaaaagactgtaacaagggctgtgggaattatgagccaggaaccctgggttgaaaaccaatacataaaccaatatacgtacacatattgtgaagagaaaatacaacttgggacctcaaaatcactaagccgaagggacagatcaagctgggaactgtgtcacacaaacctgccttccattcacaaataaaaaagctacatgcctccctcacaatttgcccttgtgggcaagatctttaccctaaaagtgttctgttgaattccaccctgacaatgtaaattgatagtctatcttcgcagtgatgggacaaaggaaagaactcagccatttctttgctcacctgagacaaatgcatatgtgattgcttcctctgccctactttatcttatgtgaaagtgcagattcaccccagctagctgactattcctttgcctcccttacatgtggacggctgatcaaaggctcaaaagaaggcaaccacttgccttttatctacccacaccttttaaaaatgtcttcctctttctgcaatacctgccctttttcctttaaatattgaagccctcaaaatcatctttggagaaaggcacagacttgggtcctgggtgcatgtccttaacattggcaaaataaacttctaaattgactgagctctgtctcagatactgtttggtttacatggtaaccatgaagggattctgagtggagctacccctgacctttggcaaatctcctacgggtacttggtgccagcttgagctacctttattgctcaaatcagttggacaatttgctgagccctgggagctcctgtctccagagaatccctgatcttccaaaatctggttgaggtttaaggattattctgctgtgaaactctttttctggagttttattcactttcaacaaggagggagagttttcctgcttccatgataatggggtgcaggcaactcctttgtggaatttcagcccacttccaacagggaaagcaagtttgagttttttcctacttctaggatagtagtgtagcaggaccagccgcagacaaaactcctcagacaccgagttaaagaaggaaggggtttattcagccaggagcattggcaagactcctgtctgaagagctgagctcccctagtgagcaattcttgtcccttttaagggctcacaactctaagggggtccacgtgagagggtcgtgatcgattgtgcaaccagcgggtacacgactgggggctgcatgcaccggtaatcagattggaacagaacaggacaagggttttcacagtgcttttccatacaatgtctggaatctacagataacataatcgagtaggccggggctcgatctttaactaccaggcccggggtgtggcgccgggctgtctgcttgtggatttcatttctgccttttcatttttacttcttctttctttggaggcagaaattgggcatgagacaatatgaggggtggtcttctccctcagtagagcacagtctttagccaggtctcattcctaggtaagtagctgaatgggggttttgtcttggaaattctccttaatcactaaagttaagatgaacaaccagttggtcttaattcctccttaccattagagtgctcagtaataatataaattgtgtgatcatttgtttgttttgattaactgctttttaaaaatttgttagtttctgtttttgttgttttggtctctttcccattaggtttgaccaactctacccgacttgatcaaatccagagaaaagttccaaattatggggaacaaggcctctggattggctaaattccctcagctgaaaaaaaggaaaaagaaaaaatggccagcaacaaggaatgtgggagttaccaaccagcaaccatggatgaaagccagtacatgcatctctatgtcataacagcacacacaccttgtcctgttgtactttccacctcctggggtctctggggcatttcattttactcttgctcttttttcaagctatcaatttacgcctcattgcaaatagcatattcatgtatccatatttgtataaggaagcctctatcatttttttctttttcttttttttttttttttgagatggagtcttgctctgtcacccaggctagagtgcaggtggtgcgatctcagctcactgcaacctccacctcccgggttcaaacgattctcctgcctcagcttcctgaatagctgggattacaggcatgtgccaccaagactggctaatttttgtatttttagtagagatggggtttcactatgttagccaggctagtctcaaactcctgacctcaggtgatccacccaccttggcctccttaagtgctgagattacaggcatgagccactgcacccggcctaccattttcataaaaaggatatactttgtttctccttcacaaaatttggggcaatgagaaagatcccagtcatctctctctctctctctctctctcattttctttttttagacagtgtccttctctgtcacccaggctggagtgcagtggcacagtctcggctcactgcagcctaaacctctggggctccaatgattctcccacttcagcttcctgagtagctgggaccacaggtgcataccaccgtgcctggctaattttttaaaaaaaacttgtagagaccaggtcttgctatgttgctcaggctggtcccaaacttctaggctccagcgatcttcctgtgtcagcctcccacagtgctggtattacaggcgtgagccaccgtgcccagcaccagtcatatctcttaagaacaatggttttggaggagttg

SEQ ID NO: 377 - DNA, 2753 bp, Homo sapiens
cgccccgccccgccccgcctgccggggaagggccacgttgcccgcccggccgtccggccccggcgcgccgcagaaagggctggcgagtcgaaaggcgaggcgcccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaata

SEQ ID NO: 378 - protein, 478 aa, Homo sapiens
SRGGIPRTAGKGAGQAQGSLEPSPGLPSPVGARMLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPLTWEGYDPSWN
